United States Patent 9,328,346 (POLYCOMB-ASSOCIATED NON-CODING RNAS) - sequence listing, part 17

SEQ ID NO: 2786 - RNA, 17504 nt, Mus musculus
cguggccccagcggucgcccgcucucccaggcugccccgcgcgcgcgacggcaguucggccacgucccuggccacgucgcgcccgcucccgccaucuuucgccgcuuccucucuccggggcugcugucgccgcgucccgagucgcugccuagcuccggugccgcugugccgcgccgaccgccgccgccaugaacaucuuccggcugacuggggaccugucccaccuggcggccaucgucauccuacugcugaagaucuggaagacgcgcuccugugcuggugagcggccgccggggcgaggcgcgcggggcaggagcgcgcgcguuuggcccauucgaccgacccauucggcucucggucguuccggaggcuuugugccgggcuugcgauggccagacacacccaucucggccugcucggcgggcaacgaaaccccuccgagugugcacacgggcugggguguccgucgcagcucugggccccccaguucugcgcuugguccgcucgcgaacuugauccguccuggcucagcgagcgcuggcguaacugcccccgcguccugcugcaucugaaaaguuuagcacgggaucuguggggcucuagugggcgugucccucuccaugggacuuuuggggggcgccucugaguccccaggaaucaaugggagacuugcucgaggaggauggauaggaccacagacuagcugggccugacguggcagccaggccacccgcgaagguggggcuggcuggaggaagaggggcauccugcuauucauucuguuaucuucaaggacaagcagaggaugggaugugggggcaggauggugucaggucuggccugugcuuacaguugaugaggcuacaacucaagccuugggguucgggaucucaugcgucauaaaaagagauguggaucuuuuaagugaguugcuuggcauaguuuucauguuacucugagaagcaagcuaguuuuucauccuugaguguggccgucuaauaacugguucucuuaaacugccagcgcuggguaccacagaggccucuguucucggcuaguauccuugcuccacgucaccauugaguuggcgcuguaccucccucaaacuacauugcagagaggcaguagagugaacuuuccucacauaauagcuguggacuucugccuuucguuaaauauuaggaaucuuacaaguuuuagauaaguucuuggugagugugauggugcuugccuguaaucccagcacucgagaggugguaaccugagguucaggaauucaaaaugagaauggacuacaugcugguccugucuccaaaaacacccccugcuccccaaaaacccauuaauuaauugauugauuaaauaaauauauucuuaaaauacuguccuuaaugcuauguccccaaaugaaauaacuuuguaaacucaaauuuaauuuuuuucagagacagcagaaaauagaaguccuaaaggcccugggugauggagacgccaccuaucugguuuauuaauaacaccucaucuaaaguagcaccgccccuuugacucugcucucugaaggucucaucucucccuggaacauaguugagauccaggaaguaagcacaacccaaaagaccuuugcccgaucgaaguggacgucacaaaguccuuguacugaaccaggggaucugacugggaggugaacugggagcccagugugggauucagaaugacagucaauuaauugcuucaguugcgauaggugugcauuaaguagucagcugaguguuauagcgcuccucucaggcaguacuuaaaauaaccaugucaacgguccccggacuggaugagggaaccgagucuuaggcagguuagcaggcuuucgaugaagccaggauugacgcauaagcaguaaugaauuuggaauuuccaauuaaccuuuguuucggccugagcaguuugaguuugcacauuugaugccagugguucugucacguuugcuguuggauuugggugcuacuuuuagucuuuagcugucuuucuaaaccucuaagucucuuugucuucuuucuuauguucuucugccaagucaagauauauuuuauuuuuaauugugugagugcugguuccuguggagaccagaaaaagacaucauacuccccuggaucuggagucacagacaguuaugaguugccuagugugcugaaacugaacucagguccuuugcaagagcaguacccuuaguggcugaacccucucuccagccccaagaaacaggguuuuuuuuuaauuauuaauuuuuugcgugccugugugaguuuacuacaagugugcagaagcccuuggauuccagaagaggggcgugagaucuucuggaacugaaguuacaggcaguuauaagccaccauguuauugcuggaaagugaacccagauagucuacaagagcagcaggugcucuuaacugcugagcugucucuccagccccacaaacuuagaauucuuaagggaacguugaguaaccaggaaaaaggaagcagguugcuacuuaauauucauuguuuccaugggagauuagagcauugaggaaaacacaguauuuagcugaugugccaagaauggaagguaaaugggugaguucaguuugugauucccaaggaugcccuggauauuaguaagccgcccgcacucacucuuggacuuaagaucuucuuuauucugcuauauacaauuuuucugaccuuucaaaaaugaaauucaccaaggccauuuauuuugaguuaaaugcuggcuuguguuagaugcucuguuuuccaugcuaaguuuaaaaguucuguagaggcuuuggaaagaggaagaacuugaucagaguuucucaaguauccggaaccugagccaaccugagccgcgguguccaggccggcguuuucaguuggaaaagcggagcuccuuuuaggguuucagcaccagcuuagaaccuaaaccacagggccuuucccuaaggggaagacggggcaggcugcucaggaagcuggacguuacauuuuugaguacucaguguugcucaagcuggaauccuccugcgucagccuccugagagcuagguuuacaugugugcuucuccaugccaggcuuuaaggaccuguugugagcugauugugcuugaauguaaacuuuguguugugucuggugucacuguagagggggacaucagugacaaugucuuguguuacugaccugccaggcagcuugauggucaaguugucucuuuuagggugugguuuguuuuuuuuuuuuuuuuuuuuuuuuuugcccuaaucccuugaaacaaucagcuauaauauuuacuuauuuauggcgcuggaguuugaacccagggucucacugaagucaagcaaauaccgguugagccaaauccauaucccaaagcuuuguuuuuaggugaagugcuuuuucuaacuuccuauaggcugauagucauugucagggcuugcccugaguuuacgugacuagugaguccugcaaugagugaccuccagccuccuccuuuauuuacucuuucccuccuagcuguuauggugguuguaaaccugucaaccuaucaaacuugacagccugucaaacuguaugguuuuuauauuugaagcaaauagaaaacuugccuuucuuucucuccuucuuuuuucuucucugguauugaggcuugaaccuaggaccucgugacauggugcauacuggucaagcucuuccguagcucucuacucccagugcuaacacuuguuguuguuguuguuguugucuuccucgguacuugaagcuuuugcaucacauuccuagacuccuccuggagcuguuuucucugauccuuugagggcuaguuaaucucuuaauaaucauugccaugcacggccugaccacccucucugugugcccagcccugagagcacucagcugcagauggcagcaagccuugcugccauccuuggguguuaaggaguguggcuaugagugcugcaaucccagcauucugcaaguggacacagaggacuagaagcucagagccaucuuuggaagacucuggagaguacgaaagaagcugcagugggagaacacuugucuagaacgugcgaggccuggguuugagccuuuguguugcacaaagaaagauacaggucaggugaggggguaaaucaugugugaaggacagacauggcugucaagcuaugaggacagugacuugugugaaguggagggagggacccaaggacaacuccuuugacuucccaacaagaagugucaagauugcugaagaaaagaguggucauguagccaaagauaaccuugaacuucuuacccuccugcuuccacucggagugcugagaucacauguauaugcuguccuucccacuuucuggagugcuaggcacucucucacugagccacaucuccagccacaaagcacugucuguagauaagagauuuuuguguagaauuuguaacaaaaauuauaaacauccuggagagauggcuucaagguaaaacuuauuugcugcuguucaaaagaucagaguucaguucuuagcacccacauuggggguuucaaaccacugauaacuccagcuccacgggcucugaugcccucuuaugcucuccguguacacgcacacacacacagcagacacacaaguaaaaucuagaaaauacaagucuacaaaaauaaguauaaaucuagguaggaaauuauaaauaauucaaauggucaguggucucauaauuuuuauuauguccacacuggaacaggauagaacaagaaaauauguguucauaacaaggaaagaugauuugaagaccugaauucaaacaacagguuauaaagaauaagguuacuuuaaaggguaaaaauguauagggcgcacauacaaaugcaauggaaaggggacaguaaguggcuggaagguggcucagcaguuaagaucaccugcagauucagagucacuucccagguccuacauggugacuaacaaugaucuguagcuccaguugcagggacccugacugcuucuggccuccauagguaccaggcacaugugugcacauacauguggccagacacccauacauauaaaacagucuuuuaaaggcaggggcauuaaagcagcuccugcuuaaauauacuuaaaauagagcuaggagggcuuuuuaagagacuagcacugucacuuaagagauggcugccauugagaacuuucugcauuucuagaggacuuagguuugggucugauaccuucuugucucugagggcaucugcccucaugugccuucaacccacagacaaagacauguauaauuaaaaguaauaagauaaaucuuuuuaaaaagaagacacacucuuucuguacauuuuagcccauuugaaauuuuuuaagaaugauuggcauguuuuuucuuuuuucuuuuuuggcauuuuuuuuuaaauacuaaaacaaacagcaaaacaguauuuaguaagacugucauuucucaaguauucacagcagcauauguacuauaaagcacucuccuuaucuuuucagcauucccaacaaguuagugugaucugucucuguaugacaagugcagaaaguagaaucagggugcuauguaauaggacuagccuuacccugcaccucagccaagcuugaaaccuagacccucugguucccaaaccacgcccccuuccugaugagagucuaacagagucuuggacaugcuagauaaacacucgacaagugagcuucauuuccugcccuugugggcuuuuugagacagaagauacugacauguagcuccggcuagcuuugaacucugaucuuccugucucugcuucauaauuacagauaggcugggauugcaggcuuguucugccaugccuggcugugagguuguucuuagguauugaguuguggaguccagcaaaaggucaaaagcuuuaaaagaauguccaagcuggauauggcggugcauaccuguaauuccaacaccuggagagguggaggcaggaggaugaaaaguucaagaacagcuuugacuccauagcagauucagggucagccugggcuauuuguccccacuaaaagacguuuguuuguuuuuucuuaaaagauuaguuuauauaaguacagugucacugucuucagacacuccagaagagggcaucggaucucaugacagaugguugugagccaccaugugguugcugggaauugaacucaggaccucuggaagagcagauguacucuuaaccacuuaaaguccguggucucaagugcggagaugugugcuuucguaaagcuuacugagcuucuggggacagacaagcaugagugauaaucauuugacaaguuuugcucuugaguguagcugucagauggauuugguaccaggaugucacugaagugcucacagugagugugcccgugagugcuuguuacauggaacaaacauuggaacuuuugguccauagucagguugguauugccugugauuguaacucaguaauaagguacuugccuaacaugaggcucuagguuugauccucaggauuucggguagacagacaaaaugacugauggccagcacugcagauccaucaaaggacagauaagguagcagcuauuccauuccacccuuacccccaggagauuccugccacccugugcccccaucuuuagcuugcgauugcuuccuucugugaagaugggacacggugguaaagggaaaagcagcuacuugcuagagagaaugguugcugcacccugaaagcaucccagagucccaggugcuaguuacuguguggauucccaccgcacacacugccugucuucuccuuuguccaguguucacucagggaggcucucacccuccagcugguaguaaauuagggcccagggccaagcccagagccaagcccagagcaagcccagagcacacuaucuguuuacagugcuagagacacaguaggauucagagucucugaaaguuuuauccagaauagcauacugugagacugcccaugacaugaaagaaaaugaauuccauuuucuuuugagcauguguuucucuggacccugcuguaugucagguguagugggcagcagggaaauacuaaauggaacaagucacaacuuccacaagagauucuguauguaauggaguuuugcagagaacagaaacuagaguucaccuuaggugucccugccuuccacuucauuugagacuguucuccauugcauaagucaggcugucuggcccaugagcuuucagggauucuccugucuccaccccuaccccacccccaucucucaguucaagugcugugaucacaaaugccugcuacugugcccggcuauguagguccuggggauccucccacuuguguuucaucugcugagccagcuccauagugugucuuauaaagucccugaagaagccagggcagcagcuggcaugaaaugucugcugggggaaucagcagcaccaagacagggugucugcaucucccagcggaggcgaugguuguguaggugggucucggaggacagggaugagcuaccacccuggcuuuuaguguaggaaugcugaaggugauaugggugucccuggcuccaaagccccauuggaauaaacugccugucuguauccugucuuauuggaaauacuggaaagaaccauauagcaaacgaacuggaaaauccucaaggcuccaccaaacguccuguaggaccugucugcugcuccugucuuucuccauuguguccucacuccaggcuuuaguaucugcuucaccguuucugcucuagaacgguaaacucugauagaaaagcagucggcagcagauuggcugcccagcucuccccaggccccuguguggaaaaggucaacuuuccuccuuucuagucagguguuuuuaugaaggaccuuguuccucauacugagaaagugcucauaacaggcuuguagucuguaagcuguaacugaccugaggcugugagaaauguacacucgcuggguucaugccuggcacuguagugugcaccacagcugagcuggucagacuccaacaccagccaccuuccauuugucaugaauugcucagucugcaacaucuugacgugcccacagccaugcgggcagauguaggugucugaaaggucagcuggacacuguguucugguucuccccgcugugagcugugacugcccugcucugcaggugcaaacgugggaucaggguauaucaguuuuuauuuuguauuauuuugagacagggucucccaguguagcccaggcaggccuggaacucagucuuccugcuucccaaguguugggacuucaggcaugugccagcacagcuagccucggguguuaggcuuaugcugggccuaugcccaggaagguaaagaggguaggaggcuggagugaagcaguggccugauggagcuccagccuugugggugccugucuugguguaguggccauaguuuaaugaggcugcuuugcucgagucauccaccauagcagggcauucuaggagcaccuaaaaggaggguuauaaggaagaaaaacuuacuuuccucuggccuaaucaguuguuuccagagccuuccccugucugcuggcugcccagggcgaucccaugaccucaggagccagaguucuucccaggcugcccuaacucacaccugccuuuugucucucagggaucucugggaagagucagcuccuguucgcacuggucuucacgacucgcuaccuggaccuuuucacuuccuucauuuccuuauacaacacgucuaugaagguacgguaugacgucagcgccaaugcauuuauccaccucugcacaccucaggaaauaguagcuuuuuuuuuccuauguaaacucuuucaagaaugauagcuaggugugcuguucuuuuaacuuuuuccaauuucagugugugugugugugugugugugugugugugugugugugugugugaggauugaacaugcuguggugucuguccauguggaggccagaggacacuuugggaauaaauucucuucuuucuccuaacucagauuaucaggcucaauuggcaagggcuuuuaccuacucagccaucuugcugguguguguguauguguguauguguguguguguguguuccuaucuguauguccuaucucucuaggacaaccuucccccuucccgucugcucucaugucucuuucauuuauuuguuuguuuguuuguuuaauaguguuggggauugauucagagccuguucugcaaguaguuuauagcauuguucuaagaacuugguuugcggcucccucuacccagcacuuuguauuugaaagcaucgugauaacuauaaguuaaaguguacauuguaguauuugggcuuacgaucuuugcuaaaaacaaaacaaaaauuugagggccagugagguugcucaguguuugaaagggggcuugccgccaagucugacaacuugaguucaguccugggaacucacuugguggaaguagagaaccaggucccauaagcuguccccaggcugccacacacacauacacaaacauauauucaaaauaaagguuuagaaauuuaaggaaaaaaaagcaaguuugagucaccuguaaucauucucuucuggacucuaguaaucaggaaauaauuagcugccuuaaaaauggcuagguuggggcuggcgagauggcucagugguuaagagcucugacugcucuuccgaaggucccgaguucaaaucccagcaaccacaugguggcucacaaccaucuguaacgaaauuugaugcccucuucuggaguaucugaggacagcuacaguguacuuacauauaauaaauaaauaaaucuuuaaaaaaaauuuaaaaaaaaaaauggcuagguugggcugggaggcaggucagccuguuaaaugcuucucaugugugccugagggccucagugugagucccggcacccauacaaguugggcaugguggcacccacuuguagucucuagagagguagagaccgguuaggaucaccgagggcucuauggugauccugaacuggaccuaugccugaguugcuaggagcacccacugcucuauacagcaccuuagcuggagaguugacucagcgguuaggagcacacacugcucuguagagaacaugaacuggagagaugacucugcaguuaggagcacacacugcucuguagagaacaugaacuggagagaugacucagcgguuaggagcacacacugcucuauagagaacaugaacuggagagaugacucagcgguuaggagcacacacugcucuauagagaacaugaacuggagagaugacucagcgguuaggagcacacacugcucuguagagaacaugaacuggagagaugacucggcaguuaggagcacacacugcucuguagagaacaugaacuggagagaugacucagcgguuaggagcacacacugcucuguagagaacaugaacuggagagaugacucagcgguuaggagcacacacugcucuguagagaacaugaacuggagagaugacucagcgguuaggagcacacacugcucuguagagaacaugaacuggagagaugacucagcaguuaggagcacacacugcucuguagagaacaugaacuggcuucccagccacacauuaggaggcucacagcuccaggggagcuggcuuuuugugacuucaguuggacaucccuacacacaucauauacuugcacagacauacacauaaauuaaauaacucauaaacgagcaaacaccccagacugauuuguguccuaccugugugugcaugugcgcucauccccacacacccaggaacacaaauaaaccuggauggaagcauacguacagaauggcuggguuucugccuguugucugagugaggugcuggagauggagucagaagcuucucuuuuccaagugagguccagcugaggacagggccugggaagcucccggcuguagugagccuggacugguaugguccagaagggucucgugcgggugugcuuuguuuauucuacaugcauaggguugaaagcaacagguuuaauacugugcugacuauacauguaaaugcauaacaagggucugggaacuguuuaaugucauugugguuuuuuaaagcauuugagggcuuggugauuaaccucguuuucccauuaagucauuugccccaauguuuuccuaauuaaguuucucaaguuguguuuccuagggaggaguagcuagacaguguggcccuuaucccagccugagugucugcaguuuacaaauugauauaauuccagaauaucaggcucuuccuuagggccaggugaccuuuugaagauaaaagaacauaggacuaacucaauugugaguccuugaacagcccuguuguacacaaauugcugucuuggaaauagaaauguuucacaaacuagcuuucaggagccugaggagguagcucagaaguuaagagcacuugcugcucuuacagaggauagggguucaggacccagcaccuacagcagcuuugauuccagccccagggcuccugacucccuuuucuggccuuugcaggcauacaaacauuuacacauacauauaaauuaaaaauaaaauaaauuuguagcuggagagaugccucaucaauuaaaauguuaaaguucauacugcuuuuuaaaaacauuuuuaagacuuauuuuacguguaugugugcuuugccugaguuuauguaaguauaccacaugugugcucagugcccgugaggucagaagagggcauuggauccuguggugagcugccuugugggugcugggaacugaaccagauucucugaaagcgcgcguaaccagcucauaaccagcuccucuuguugugccacucuugcaguggacaccaguucaguucucagcccccaugucauguccccuguaacucacuuccagggaaucugauaccucccggucugcagguacacuaacccagucagacacagauacauaguaacuaaggaggacaucuucugaaaaguaguaguaaggagagauggcucaguggguuccaucauuuguugcccuugcagaggaccugacacccauaacucgaguuccaugaacaucagucccuucugcccuuggagggcaccagauaggcaugugauguauaaauaugcaggcaaacacucacaaaauauaaaacaucuaaaaagauaaauaaauagccuucaaauaaauaaacaaaaguaacucuugguuuuucuuuguuacaauaccagacugaauuucauagcaacaauccaaguauuuauuaaguaacaacguuuuaaauuuguuauauguucacuuauuuuaugucugaguguacaucugugagugcacacaggacacuccuaaggagucgguucucuuuuuagcauaucugucccaaagauuggacucuggucgcuaggccuggccccugagccgucuuucuggcuguaaacaaagcaaugcaguuugaguaaaagccacgguggcagaauuuaacuuggauuacagugcuuauccuuacagaacagcuagcuuggacggaguccucuguccagaagugcacgaacuuugcauucacuuuuuccccuagcucaagaggagauuagagggcuggagagauggcucagcgguuaagagcacugacugcucuuccagagguccugaguucaauucccagcacccacaugguggcucacaaccaucuguaaugggaucuggugcccucuucuggugugucugaagacagcgauguaaucacauaaaauaaaugaauaaaaaaaaaaagaagaggagaugagaagccuguuucuuugaaaguuucuuauaguuuuaagauauaugcuuaacauuugauccagccaaccugcuccuaaguauaaaugcaaggaaaaugaaacuuauauucacacaaaggcuauaacguguucauagcugcuacugaccaccuuaccaacaggagcuaaauaggacaucucucuuuaacuggugagugaauaaacagauugugauacaccugugcauuaguccucugcucagcacaaaggaggaaaugggcuagagauucggcucaguggauacggaugcuugcugaucaaucgugaggccuggaguucaaauccaagcgcccacauuuggcagcuuacaacagguuguaacuccaauuucaagggaucugaugcccucuucuggacucuauggguacaugcgcacacauacauaaauagaaauuccuuuugagcucuaaaaagggagaaauuacuaacguauagugacggguuguuucauuucacucacguggcucucuagaaaaggcaaaacuagagccuugagggcuuaauacagaggcagcgagguaggauucaggguuauaguguccuaaggaugccuguuuccuaaggaugguggcuuugugaccccacagaguguacuuuagccaaacaugaaugaggguguguguguguguguguguguguguguguguguguguguguaaagcugacuauguaggggauaacaacaguguuaggaacagccgcacugugcuucuaacucggugucucuccuccaucuagcuuaucuacauugccugcuccuaugccacgguguaccugaucuacaugaaauuuaaggccaccuaugauggaaaucacgauaccuuccgaguggaguuccuggugguuccuguaggaggccucucauuucuagucaaucaugacuucucuccucuugagguugguuaaggguuauuuaguggucacaucugguucccugcguaaaaaagaccuauugacaggaauggacucuuguuggcuugcuuugguuuugguuuugcuauuguacagacguccacuguuacagaggcagcgagguacagcauccaguguuguaaauagauugguagauggaaaugaagcacccggugcuuggggcugucguaagcucuccagguucagccuggugcugcgguacaagccuguccucccaaccucgggaaguagaggcaaaaggauuaggaguucaaggucaaccucauagugaguuugaggccagugugugcuacuaagaccuugucucgguaaaaaaaaagguggggggggggggcgagaaggcucuggagauaaccuguuagcaaaguguugaacaccugaguucccucuccagagcccacaugaauggacacaggggugcacauaauccaaguguuggagaagcagagaugguggucacuggggcucacuggagagcucauggcuaaugagaccuguuuuuaaaaagaauagauggauggcuccuaagaaaugacaccugaaguuauucuccagcaugagcacauguacaaguacacacacucgcacacacacacaccccacacucacagacaccacacacacacacccacacucacagacaccacacacacacacacacacacagacaccacacacacacaaugcagaggcuccuugacuucugaugugaauguauccauuuauugauagacuuguuaguugaaaaguuuaauauggcuagcuuaccaacccagcacauuguagacuguuguuucccaguggugcaggcgaugcacugugggugacuggacucugcagcucauggcugcugcccagcauauaucccaccagcccaaacggggaaaguaaguaugcgcucuagugagugugcauugauuucauauugucagaaaguugaagaguuuaaggcagagccaucuauagugaagaauacagucaccugguggagagucagcaggaaguagaauggguuggggacucuggaucuggacaagccacucaggaacaucuuccauguggauucaugguagacagaucaugacaguccccagcuuccccagcucaggcagccucuugcguggugucugccauucuguguuguaugugguggcugguugcuccucccagcugaagccagccuccugcuuuucagaucuuauggaccuucuccaucuaccuggaguccguggccauccuuccacagcucuuuaugaucagcaagacuggcgaggcugagaccaucaccacccacuaccucuucuuccugggccucuaccgcgcucuguaccuggucaacuggaucuggcgcuucuacuucgagggcuucuuugaucucauugcugugguggcuggugucguccagaccauucucuacugcgacuucuucuacuuguacauuacaaaagguacgucagcuccagccugcacuucguacguaguucagggucugucaggggccugccugccugcccugcucccuucuuggugcugugguaaaccacaagagcacuuugcuuuaaugcucucagcgguguuuucauuguaugaauuacgcucaucaagcugguggcucaguugguagcaugcuuuucuagugugcuccguacccuggguuuaauccucagcacugcagaacaccaggcauggugaucaaagcacugggagguggagacaggaauucaaggucauuccuagguacauuuccacuuugaggcugacuugagugcccccugcaugagccccuuucuccaaacaaaaugaacaaaaaacuccaagguucagucagggcuaagauuucugacagccaucaaagcucuuaccacucaguugcaguaagugccucauuaaacaguuugagguagcugugcucacagaucugggggaacacugcaugugagucuguagccugccccucuccuucaugucaguaaacagaaccaacacagagcuuuccaauuguaccuuuacuuucgcagacucuguuugcugguauucaggguuucugguugcugcuguggaaaugcaguggugagcucagcacccuuauauaugugcauuugcacauuuguguaaauauaggacauacagauuacuagcugaaaacuauuuguggucccuguucagaaaagaaagaugcacaucugauggaugcaggcagacuccugcagagcugagcucagaccuagccugggacccuuagccacacagccaggugccugguggugggccugcuccgugccaggacauagcaucuuagguuuguuuucuguuuugcuuuguuuuuucuugagacagagucucacuaugagcacaggcuagucuaagucucguacuguugcugcucugccuccugagugccgggacuaaaggugugcgccacucccgacuagucuggcugugugcguuucuguuagcuccuuguauuugggcauguguaugaagcaaggaccggggaaaggagacugagcucgcccacgugguaaccucuuguuuguucuaucuguccaaucgcaguacucaaagggaagaagcucagccugccagccuaagugccaaagaccagcagcagccucugcccuucggggugcucggacagggucucaccauggcgaaggcgaaggcgaaggcucgggaugcucagugggcagaagcagaggcuucugcggcagccacucacugguggcucuucgaggaugcagaggaagagaccaggaggcuucugucuacugcauccugccuuaucuuuuuuauuacuauguacaaagauuuuuuuacacaaagaaacuuaaugcuguguuaauaaauucaguauguagaugaauugggacaguuuccaaaagugacgauuuugugcacaauaaguacaagccuuuuuuauuuuuugagaauuuguugagguggucaauucuuugugucuacaaugaaauuauacuccuugacacuugguagauuauccaaacaucugucaaauuuccaugcuauuuauuuucuuucuuuucuuucuuucuuuuuuuuuuuuuuuuuuuuuuuugccaaaaagauaaguuguguuuguuugaaaucugagacauuguguuccauugguguuucuguccaaaagaguccucguuguccuggaaacccuuccucagaugucacacuacaugucagguucgggaggaugacuagaaaguccuaagguuucauuaccaaaacuugaagguucccagcagaaacucagcugaugcucaccaaacgcucacccuucccccgcugagguguggcagcuugagguuauccgagggugcugagagcugccacacccagagggucugagccaccugcccucugacuauggagagggcugggggugauggcuguuuuggauagaggacucagcuccucugaggaauggaacacaaauagccaccugucacugucaguccgaaggaucacuacaaccauguuagacucaaauguuuuucucauagcacuuuuggugauaaaaugauugacaaucuuuuuaauuggcaacaccaguuaucauuccuuacauucuuuuuaguauuuuuuuuaaacugggcucuugcaugaccuauauuguguuaacauccuaaauaaacauuuuauuaaacagaau

SEQ ID NO: 2787 - RNA, 1935 nt, Mus musculus
uuuuuuuuguuuuuguuuuuguuuuuuguuuuuuuuuaagacaggguuucucuguguggcccugacugucccagaacucacucuguagaccaggauggccucaaauucagagagccaacugccucugcuucccgagugcuaggauuaaagacgugugccaccacacugguuaagagccugaauuugacuccuuagcucccagcuaaaaguuggauguaacucuagcauugaggggauucauauagaagugugcuagcaagccagaccagcugaaaaaaaaaaaugagcucuaagugagagagacuacuaggugggguucuuuagagucacagaacuuaugaaaugucucuauauauuaagugaauuuauugaaauggcuuaaagucugcaucccaccuaaucuaacagugggcagcggugaaugggaaguccaagaaccuaguaguugcucagucccacgaggguagguguuccagcugcucuucuguauaagcugccauccugaagaagcagguuccaacagaugugcuggcaaguaagugcaagcaggcagagaagaggaaggccuuccuucuuccaauguucuuauguaggccuccagcagaagguauggcccagauuaaaggugugugccaccacgccugcaucuggaacuugcuuuuucccaggauggccuugaacugaagagaucugcuugccucugucuccuaggauuaaaaguuuguacuaccuugccugggccuaagcuuuucauggccacuguggcucaagaucuggaucaaaagugugcccuccauuucuggguuguaguucauuccagauguagucaaguugacaaccaggaagagccaacauagagaccgugucucaaaaaauaagguaggagagagugcuggagagaugagauggcucagugguuaagaacacuggauucucuucagcuucaauucccagcacccacauggcagcucacaaccaccacuaucuguaauuccagcccuaggagauccaacacuuucuucuggccuccaagggcacaaagcccgcauguaguacacagacaaaacaccccuauacauaaauaaaauaauuuuuaagauuaaaguggucaggugugguggucuuuagucccgcacucaggaaacacaggcacugaguucaaagucaaccuggucuacagagugaguuccaggacagccagggcuacagaaagaaacccugucuugaaaaaaagugaauaaauuaacuaauguggagugauagaaaccuaaaguugaccucuagaguccacacacacugcccagaaaggcagguugaugguggaucacuugccuagcacgugcaagguccugagaucuagcuccaguguuggaaguggaagagaaaaggacaaaggcauggccagggaguggaggagaagagcaagcugcagcauaacacagcaucaauccuuuaaaacaauaacaugcauacacaccaaucuaacauaggcagcuauaacgaaaauuacaugcaaagacuguuaaggccugacaccucacaccauuuaguuccaugcccaccaucguugcugugauaggucugccagucauggacacugaaacauaacuugacucagagcagggucaugcugagcacauacccuguuuuguucucuauguucugagguuugcuaaucuuaagaaauuccacaaagcuuuauguaggaccccucaaauuaaaggucaacaugaacuguuaugucuaagaugacuugaaucagagccaacaccugggcaacuuguccugcaccugcguaugaucucacuguggcuuuuaugguuuuguuuuuccuuuauacgccagccaugagaaauguuugcuaacauagccucaucuaugacccugaccaaucaguaugaggguguucauucaauaaauuauuccugucugacu

SEQ ID NO: 2788 - RNA, 21973 nt, Mus musculus
cggcggcggcggugcccggauggaggcacgucauugucccccgccgggcggcugggcugugugcggcggcggcggcggcggcggccgagggggauggagcgagugccgagccgggucagguaagcucccgccuccuucccgcccgcugcaggccggcguggggccgggccgcgugucccugguucgcggccucagccgccccgccgccuucagccggccgcggcccgccgggacuagcgcggccccucgcccgccgcccccucuacagccgccgggcggcccggggaccccacggcugcgggacuggcgcugccgccgcccggccgggccaggcccgcagagcaggaggcgguggccacggcgggcgggcucgcagcgaaggcagcgccgggguugcacggaagggccggaccccccugguugccauggccacagcgcucccacccccaccggccccagcccgcccccucgguccgcugcucgggcggccggcagcuaccgggccgcccggcgcguuuggagcugccggggugggcgugugcacgccgggacaguguagccggcguagccggcguccggggcccgcccgccgcccccccgcguggcugccaccuccggcuccagggcgccccucggagcuccgggcuggccuccccgcccccaccccaccccgacaaacuuucccacccgggcgcaguccacuaggcuccucagcagaacacccgaguugcccacgccguagcggagcggacacccgcaagagaggcggacagccggggguguuggggugggggggaggagccccguagcucuuuccccuccgaaaaagcgagugugccuuccucccccaggcucuuuaucuuuuggggcacagagaaccaacuuaccuggaggaaagggcgggugggagggaucagauucagauguuugaaaugaaaauuugacgggaccaaaguuuuacaaucuaggacuuuaaccucccuagaauacaguugagauuacuuuuguugaauagcucuuuuauaucugaaggccuuaggacuugcuuguuugugguucuuucaaguaaauacacucaaguaacaaaaagugucggggaaacuaguuaacgccccuuuuacaaaguaacaaccggauccagguucgcacagcuguuuauggaggagaacuuuucuucaaagcaugcauuuuaaacguucugcuuuuaccaugucacucauucagaugcuuaggucugugaauaaugaguuacacuuauuuguuuuuacucagggacaguuucacuuucuuuucuguaaucauugauucaagacuacaguaaguacuugguuugcagaguuuuacggcuaaucauucuguuuaccaaaauacaauuaaaaaccaaguggugucuuuuuuuaaaguuucuuaaaacugaaauguuaccagaacuuguauaauacuguuuaugaagaguucgcauaacagguuuuuuuuaaugcguugaccuuauuucuucaguguauguggggggacacaauguguacauagugauauucuuucuuaaaaugagaaagauaaauguagccuggcauuuacuuaucguaaaagagaccuaagcaaguaauuagucuugcacauuuauucagcuuuggucccuggucagguuucaaaauggacuguuguaacuuuguauaucaugaaaagguguugggacuggcugggcuuugaguaaguaguuaccauucacaggccguuuugaacacuaacugucagacgcuucacuuagacuaaaaacaggagccauaugaaccugucuuacacaauauagcuggguuuuaagaaagguuggcucuuauagguggaguuuaguuugaucccuggugacuuuaaggugauauucauuggcugaauauccaagugaagaagauagauggguucuguuauucuugccagaaucaaaacaaugacauauuucugaugacuugaguuguguuuuccuuaauauuuaucuccuaagccuaucacagcaucuuugcuagaaugaguacgguguuuuguuugguugguuguuaaucauuguauggaaagguugcuugucccaggaaaaucaagggguuuuacuauaaauguuauuuuaaguaaggauagacuagccuuuccuuauuacggaguuuugucuccuuccccuaacucucccuccuguuccuuuuuuuccaucaauacacugugugugugugcacgugugugugucuguauguguauauagaauuucuuuugccuguagcaugagaaauauauaaacuuuauuuggcuaguaggcccaaauuuucuugugacugaaggugauuuaucuucauuugauuaaguauucaaguuauugacuuucugauuuuauguaacugccccuacauuguuaagguuguaacuucacuugaauuaaaaauuguaaacaagaagguugaaacuuuuaaggaacaacuugacuguaagcaccaacauggggacaucuguucacugaaguacacaaggauuuuauuacccuuuguacuuuaaaaggggugaacuuuuuaaaggccaaguuuuagagguacucccuuuaauucagagguuuuaaagaauuaaaugagaugccauauauaaaucccuaagcacaagcuggugcuacaagcaaacacuaguaacuuccuguuugcacgauuucauucauuuguugaacacauguuuggaaagcuucccccauaccagguaggguggaguuaaguuuuuacuacaugcuaccauggagaucagcacaaggacuuuuuaggauugguuucuuacccaaucuuggggugaaagguguugucaaggaaacccuuuaggauggguuucuaaaaagcauuguagaggaaugaguucuaacccugacaggggaaguguuaacuaagcagagguaggagauggagaacaugugaagaauagcuugcaggaccucagcaaggagcuuggacuaaaaaugggcccugucuauggugggaguguaacgugcggaguguuccagagacuaaagcgugccaaguucagaugcugggaagaacauagggagggcagcugagcacuccugaaagguuuucuucaaggucugacauguagauuuggcugccuggacauuuugaggaccauuccuuaaaagcacuuugcugacuuggguugcauaauggcuagacaacgguccugcugggugcugggugcugggugcugggugcugggugcugggugcuggggcucagucacugaccuugcagauuuuggcugaucuuccaaaggguuaucaugaaaauuuagcaaauaaauaaauauucagcaauuaauaugauaccuagcacaucaaaaaaacucaauuaguagauuuaaaaauaagauucagagauuuaaauacauauuuguguucaaaguuugauguuagcaaaauuacagguuuaauucuaaaaguugaaauacuuauaaaugcuggacuuuuucagaaaaauguauuugcuucacugguaagacuuuucuguagcuaaaauuuuucaaaacuucaaauuucauacaauaguauuuuagacuuucaauuaaaaauuaaagcuaaauauucucuuuaugcaauuuaauugacuuuuuucccugaaaaaugguauaugauuuaaaaauguaaucaaauauauuaaauuguagacuguuccuagcuuuaagcaguauguauguauguguauguguguauauauauauauauauauauacacacauacacacacacauauauaaaauauauguguuuuuaguguauauaauuguguauaucauacacauauacacauauauauguguguauacaaauauuauauacaauauauauauauauaugguguuuuuaguguacauaauuguggauugaggagccugaguauaaccuugcaugguuugcgggaugugguacaggaaaaggguuuuuugguaguggugcugcugcugcuuccaaaacaaggucuuuccaagacagagucuuguacugaauucuugaucuuccugccuccacuuccauugcugggauuacaggcauguaaccacuaaggcuaggcaagaccucuaccacuggagcuacauuccuguucccacuaaugguuucucuuuguuggaugauuuguuuaaagauaguuucacuugguuagacacaaguuuggaggacacagugacuggcaaguagacugcucuguucacucuuugaaacaaauguacuuuuugucuuuugcaggguugaaaaaugaccauaguugacaaaacugaaccuucagacccaucaaccugucagaaccagccuggcaguugugaggcggucucaccugaagacauggacacaggcucugccagcuggggcgcugugucuucaauaagugaugucucaagucacacacuuccauuagggccagugccuggugcuguaguuuauucuaacucgucuguaccugaaaaaucaaagccaucaccaccaaaggaucaagguaugaguacagaguuacugccgccaggggcucccaugccggggauucagaagggcauugguccaagauugacaccauuucauuuugcucuaaugagcauucauucauuuaucuaccacacccacccacagaucauuauuaccauguauaacaaguaggauagauugauuuuuaauugucagaugaauuuuuuuuuaaauucccaauuucuugaaggauagacuuuuaucuuggccucagacucauuauguagccaaagcuggccugauuguuuugucuucuugauucucuugucucugaaugccgggaucacaggggcauuguguggggaucaaacccaggacuuucucugcauucuaaggaagcauucugugaauugagcuacauuuccagauaauuauuauggaaaaaauaaaaaguuguagguccaguaaacccauauauccaucagccagcugccgacaguucauggccucuuagcugaaccuccaaccacagaccucccucguuugugugugugucucugucugucugucuuucugucugucugacuuacacccucuucuggcucucacagcaccagugcuuacaugugcacagguguggcacacagaaaugcaucuagucaauauuuagauuccucuauuauauaauuuuaaaaguauuauuuguguguuuccaugcuaugguauauauguagaggucagaagauaaguuucugaggucagauucucugcuucugcugcagguuccaugauuaaacuuggguugucauguuuguguggcaaguucuuuuaccugcgagcccuccugcagguccuccaguguaaaugaagcccacguuuggcuuuagguggacuuaugucuuugaagauucuuuaauuuguuaacacccccccccccccgccccggguccuugaagaugauuuguugaagccaagugaauguggaguuaaugucacccuaggcuuuggacuuugucuucuguguuuguggcaggcuaguaaugagguguaggguccugaucagauuuagacguugcuauguauuuugcuuauuuguuuuuaauuuuuuugcucucuuuuuuaaguccuaggugauggcauugcuccuccucaaaagguccuguuuccaucugaaaagauuugucuuaaguggcaacaaagucaucgaguuggcgcugggcuccagaauuugggcaacaccuguuuugccaaugccgcauugcagugucugacuuacacgccaccccucgccaauuacauguuaucccaugaacacuccaagacaugugagugccucaugcucuugagaaccuguuuucagugcuguggucugcuuuccugaugcugucuucuucugaaaugaaugaagaauguagugacauuacacuaccacgggcuggguguguagcucagugguaguagcucaccuagcaugcagaaggcuccagguucaguccacagccugcauuaaaaaaaaaucaaaaaaauccaaguuaaaugaucacagagaaguugguuugcugguucagaagcuagggugggugggagggacuuuuaggauugguuuuggguugcauaaggaacauuucacaccuaauuugaucuguaaaguauuuuaaaagaaguuuauuuauuuuguuagcuuuugacauuucagaaucccuugggguguguaugugugugucuugcuguguaaucuucaaaucgaguccaaaauccugcucagcuuccagguaugaccuggcauuccuagauuuuuacauuucuuuuaacucaguagaagcccagcuuaguguuggcuagagaaauuugaagguugucugcugucccuaucccucccugccacaguucuuuugaggugugauugauagaaagccuguacuguagauucacacgcugaugcguguugacuuugugucucugagacgaugaccacaguuauauucaucaaacccgaaaguuuccuggugccucuuugcaguccccacuuccucagucccaggcaacuggcugauccaccuuacaacacauuagcuugauuuuauuuacuuuuuuguauguugcauauauggaguuacaacauauauauuguuuuauuuugcccgaucugacauaauucaacauuauucuguugguuguguguaucacagauuacacaguuacacacuugggaagugaaggccaggggaccuccagagugaguucaggccagucuggguuaccuggauccugucucuaagaaauaaugaaaaaaccaagucuuuguaaaacauuuuuuuuuuuuuuuuuggucuuagguccauguguaagaaugaaauggcuuccucguguucugggcacaauaacuuuuaaacauuucagaaccagcaggggguaaaaguucuguucacaccauuucccaauacaagaugugcucagggcguuuugguuugguuuguuuugguacuggaccuugaggcugcacgccuguuaguaggcaaauggucuaucccucaguuguacccucggcccggucuucaccauugagagcauucucaggagucuucugacuguggggcucugcucugcccuucucugauuaguaaugaugcaaacaucuuguggggauuugaacucuagauguuuacuuggcugaaaugaaaugucuuuucgauuguuuuuccugagauaggaucucauguaggccggacaggcucagccacuucuccuccuccauccuccuauuuuuacucuugaguccuggguuuacagguggucauaaccagggcuucccacaugugaggcgagcagucugccaauugagcuacagcgccuucucccucuccccuucaaauaguucaucuaguuuuccaauauguuggauuuugaggguuuuauaguuuuuggaaaugguagacugagauuuguaaauguuuuuuuccugccucacaggugucuuuucauucaucucagugucuuuuggaaauugaaaauacuugucaggauuuguaguucauuaaucuuuuuuauuuuuuaucaguugugucuuaaauguuuuauuaagaaauacugagcuggcaagaugauuuugaggggaucaggcugcuugcugccaggccugacaagcugaacucacuaccuggggcuccucuugucgaagggaagaguugacucccucaagugguccucugaucccuacacacggccgugcgcguccaaacguaacacauacauaagacauaagagauaaaaaaucuuugcccagucugaggucagagagaguuuuacuacauuuucuucuauacauuacccaaagggcuugugauaccuucuuaguuaauuuuuguuugugaugugaagaauguggguuguuuuuuuuuuccuuuucagugcuggggaauugaaugcagggccucacauacgccaagugagugcuuugcccacggugccacaaagacgucuacuguugcaguuguucauuuacacuguuuguacucagagaguaguagccuuucuccacugaaacacccggcaccuuugccuugcauaucugcugcuuaauaaauacuuuccucuggguauauuucuccucuugauuuuaaaguagucaggcuauacucaucccucgguguccuagaugaauuaaaugaccacuaaugauaguagugagcucugcacacacacgguagcuggcacuguugcugcauccugggcaccugccccucaucucugcucuaccuuccuguugcacauugucauuuugcucauuuggauucucauuaucuugcaggccacgcagaaggauuuuguaugaugugcacgaugcagacacacauuacccaggcacuuagcaacccuggggauguuaucaagccgauguucgucaucaaugaaaugcggcguaagucucacugcaguagcucagggcagagccaugucuaguuauccuccauacccuuuccuucuugacacaucucccgaaucauccucucagaugcugacagggccaguguaccacgugcggggcuuguaugcgcuuuuuucuucuuaccccuuuugcucucugagacagcaucuccuuugucucagucuggccugacuccucugauucccacaucccaagcacagagcguagguguguguugucagacccacuggaugauguacuuuuugcuuuuccuacugcaacuuuuuaucauuuaauuaaucaaguuguaauaaaaaggaacacaaaacgcgaggcuucuugcugaguagcuggguggcgaguugauuuacacagugacaaacuaucagccuuuugcuuaaaaagcugcugaaagucagagacuaugugagugugcugaugcacauuuguaaucccaacacuuggaaacugaaggcaggaggcucagggguucaaggucaucuucauuaaauggagaguuggaggccugacugagauacggaagacucggccucaaaaaaccaaacaagucauucagggauuuuuccaggcgcauacuucaagguguugcuuuuaggaguguugcuauggcauaagguaaguaauaauaaagccuugucuuucuucaaaucucauagguauagcuagacacuuccguuuuggaaaccaagaagaugcccaugaauuucuucaguacacggucgaugccaugcagaaagcauguuuaaauggcagcaauaaguacguauagcagagcauauguugcuucauuagaucaugcacuuagccugucuccuugaaggcacacagauccaucagucugauguaucuuggugucucaucaccuugccccaagauuugcauaaucuuaaaaugauaugcuuacuauaaccauuugauuuuguugcucuuagaugcugggcaauaggcuucuguccuguugcuguuuaguuuccaggucugaauguagcuccuuuuacuuuguagccaugcuuaaugguuuccuuguucaccuucagacucaacaaucugccccagccccacuuuagucagcaguucugcaguuucuuaaaacccaaauguagacucaggaggacugaagaugaaggugcuaaggcagcugcuguguugcagacagcuacgcgcagcgcacaccuugcuguugcucucagucuuucccgguuauaggauuggcucgagcaaacgcuggugccgagcagaggaaggcgcuggccuucagcuccccuggccaggccuuggcaaagaaggccagauuugcaaagagcgucuucuccauucucugccucaaguucccucaugacagagugcuuuuguguccucuucacaucucuagcugagacacauucugaugucauuugugauucuccugaguucuuauuccuguauaagcauagauggcuuuagaauguagacgcagugucucuccauagcaguguuugccuggcucucaugucaccgucugacuguuuuucagauuagacagacacacccaggccaccacccuggucugccagauauuuggaggcuaccuaagaucccgagguaaaauuuuuguuugaagguucaucauaacauacaugcuuacaguuuuaaauguuaacaguaggggcaggauaguagggaaaacuagaucccaggucugcccagacuucuguuuacaguguagccuucuggugcuuccuuaugcgugcgcaagcugggcgcauguuaugcauaagauuuccauaguucucuuacuguuagaaaucuuaugugugaacacagagauguaagaagucaguuccauuuuauuuccuagugagggacaagucaguuccaguucugaugguauccgauacacguaccuucgugugugugcaacuguguguucaggguaaaguuuuuaauuucugaaucaugcaguauccagaggguauagcaauuuauauuccaaccaggagcuccuagggacuaggcucaucgcacuucuacccacaguacagaguaucuauuuauaguuguuuuuccauuguaauaaaaguuguauucuuaaguucuuuauuuggaguauuuucuguucuuucaguaguugguaagacaauaaguacacgaccuuacucacuauugauauuuucuuuuauuucaguuaaauguuuaaauugcaaggguguuucagauaccuuugauccauaucuggacauaacguuggagauuaaggugagcucagcguuaaccguagggaaguuacgcagccuacugucaccucggacucuuuaugcauucuugucgcugucaaacuuagaugguuguuccucuuagaaacuucagcccauugaauuuuuuuacacauucuuuuuuuguuauugcuuggagcuuuugcuuuucugauuauagauucaguucuaugcuuucuauauaaagaaaauauuucagagaaaugcaaaacuugccucucagaguucauucuuuagugcugugaucuauucugcuucacaaggagauugcuugcuuaaaaaaaaauuaaucuucaauguauacgugcaugcauguuucgucugucuauuccucucaaccuguggcaguacgcauggugaccugauguuuaugccccuuuccuaggcugcacagaguguuaccaaggcguuagagcaguuugugaagccagaacaacuggauggagaaaacuccuacaagugcagcaaguaugacuggguggugggcucuuccugcuugcccgugaugauccaacuuagaaacuggcucaguuuucagugcuuuuuuuuuuuuauugauuuuuuuuuccuuuguuuuguuuguuuguuuggguauuggguguuggguccagagucucacaugugauaggcaaaugcuguuagccacuuaaugucaucauuuaucgagugcuugucauuuuaaaggcaggucuucuguguggcccagccuggcuuuagaucuuugauuauucugaacugccagcuuacaucuccuguuauuggucaguucccucuguaauuauuauuacuccucuguguguguguguguuacagaggauugaacaugggcccuugugcauacucagcaaacgcuccacugccgaccuccaggccucauggaauuuuaauuuuauaauuuugacuauuggucuaguuuccuuguuuuaaaauacuuuuuaaaaauuuuauguacauuggugauuugacugugugugugugugugugugugugugugugugugugugugugugugagugauauccuggaauaggaguugugagcugccacgugggugcugggaauagaacccaggucuucugggaagagcuaccagugcucuucacugcugagcuaccucuccagcccuuguuuuaaaaucuuaacguaagguguuuuagaaaguacagaccaauacacuugagauguuucuacacugaguaucccaacccuuccuucuugugcuuuaaggugcaaaaaaaugguuccagcuucaaagagauucacaauccauagguccucuaauguucuuaccaucucacugaagcgcuuugccaacuucaccgguggaaagauugcuaagguaugcccaugauucaugacuguucucaucucuguacagugaguuuuccccuuuucuucacaauuaaugaaggguaaaguggucaagaugcacagucaugugcaagagcuacaacaccacaugcuccagucacagaaacguuaugaguaaugucuagagcuguugcugcugcugcauuuguugaacauucacaguguggauccuuccuuauugauggcaaauaaaaucaauggggguuuccuucaggucccuucuguuccaggcauuagguuucuggggucaacaguuguagguccugcaagucccuuccucaaagcccuuccuuaggaguuaugccaguagcugaaaacgugggguaccugugucuucaaaaauggcagaacuuucucuuguuuccauuuaucuuuaggaugugaaauauccugaguaccuugauauccggcccuauaugucucagcccaauggagagccaauuauuuauguuuuguaugcugugcuggugcacacugguuuuaauugucaugcuggccacuacuuuugcuacaucaagguaagcuguugggugacuaauaagucuguugugggacagcacuguaaacaugggguaaacaguggagcgagacugaaugacaucagacugagugcacuuaccaccccuaccccacccuccaucucuuugcaggcuagcaauggccucugguaucagaugaaugacuccaucguguccaccagugauaucagagcagugcuuaaccagcaagcuuacgugcucuuuuauaucagguacugcuguggaaacagguggucagccuuacuguuacagccauuucuucucccucaucuggagaguuaguuacacuuggagcuaauuuguacaaacaacaaguuaaacaugaguugccaugcacccgagcacaaggaggccuuucugagugaugaguucguugucacuucugacagguguagaaggcgggaauggcccugaggaguggucuagggacaguggaagccaugggaauggguucugagugccugugugcucucagccaguugagcacaggccuccagucaggcccugccagcgccaaugucugaccugcugcuguaggugcaagcuccuaacucagcagugcucucuagagaaaugggaugccugccccaggcuggcuucucucuuugugagguacuuggguuagaacccagggccuccucaugugccaagacuucugucaggccaggcugcauccccacaagguaucccaaauagcugaaaauuaaggcuaucugcagauacucacccaugacagagugaucguauccacauguugaaauacuauggcaauguuaagagugauuuguuuguuugggaaguugugggagauaagggucugacugguauacaggcugaccuugauuucuugaucuuucugcuaagaaugauuuugcauaaagccuuuuuaaaaauguucugggaaagugcuugauguauauggaaggaagggaaacaagucgaaauauuaaaugcagguauugaaaagaacagugggcugaaagccuaugggagaauguaaaucagaaggggagaugugggcuuagugacaguucucugaggaacaguuuuggauauuacaggguuucuauaaugcuauauacuuaaaauugaaaacauaaacagaaaaauagcuuuucagauaacaacuaucaggauauacaguucaaaaaaaugaauugagagccagacauggaggcucauucucaggcaggaggauugccacaagugugaggcaguggaaacugcaugaggguuccaagccauccagaguuuuagaaugaaacuuccaaaacaguaacaaaaagacaguaacuuaaggcauaaaaacucaaacugaaacauuucguugacucauucggugcuaggugugguggcacacagcaacacucagaggcagaggcaucucuauauguuugaagccuagucuacgcacccaguuccagacuagccagggccguaucgugugucuuagggggagaagaaggggugucacugaaucgugcagcgccuaaugcaggugaugugugcagcucugaguuguccggagcuccagcuccugugucugacaggcugaguaguuggauuuguggguaaaucuccuaaggccccgcccuuccuuacacagccauuucauucuguguccccaggucccaugaugugaaaaauggaggggagucugcucauccugcccauagccccggccaauccucuccccgcccaggagucagucagcggguagucaacaacaagcagguggcuccaggguuuauuggaccccagcugccuucccaugugaugaagguaacacuugagagucaacauuuuucccuuucugcuugaauccaaaccugggaucacuguagaaauugccucaucuacaacugagcuucuggcuugagggcacugcagcccguuauuacagaggccucaagaugggcgagugauccaguggcugccuaaggacuguguagcaggucccacuuacugugcacucccacacuucuuacaggcuaaauaguuggacuuggggaagugaagcucuuuacauuuuguucaugucuguggggucaucuuaggaauguggcaguguaaaaggggcuugggcucaucaguagaugagagaaugguagguauuuuauagaggugaagcuuguuagucaccaagaccaaaaugagaaggguccuagccauugugcgucuuguguccaaagugcugacccagcuguucucuuccuccuucuagaacacgccacacuugaauggcaccacgccagugaaagacacaccaaguaguucugugucaagcccuaacggaaacaccagcgucaauagggccaguccugcuacugcuucgacuucugugcagaacuggucuguuaccagacccucaguuauuccagaucaccccaagaaacaaaaaaucaccaucaguauucacaacaaguugccugcucgccagggucaggcaccacugaauaacagccuccauggcccuugucuggaggcuccuaguaaggcggcacccuccuccaccaucacuaacccuucugcaauacagucuaccucgaacguacccacaacgucgacuucccccagugaggccugucccaagcccauggugaacggcaaggcuaaagugggcgccagugugcuuguccccuauggggccgaguccucagaagagucugaugaggagucgaagggccuggccaaggagaacgguguggacaugauggccggcacucacuccgauaggccagaagcugcugcagaugacggugcugaggcuuccucccaugagcuucaagaacccguccugcuaaauggugcuaauagcgcagacagugacucacaagagaacagccuggcauuugacagugccagcugccagguccagcccgagcuacacacagaaaaccucuuuuccaaacuuaauggucuuccuggaaaggugagugggagggaggauucucagaccucagagcucccauagcugggguucaguaggcacggagcuggccgcaggagcucagguaccuuuguuucauuguaggugacgccugcuccuuugcagucuguuccugaagacagaauccuugagaccuucaagcuuaccaaccaggcaaaggguccagcgggugaagagagguaggagccgugccaccggugugcgccaccacgccuaguguguuaauaaugaggacacaacccagggcuuuguaugugcugggugagcacugccaccugagccacaagccccagcccgggacguguucacacgggaucucaccguguggugcaggcuggccucaagcuuccuguguagaucggccuugcuucaaguucuugcccaguuucucagaugcugggcuuacaaguauguguagcuaccauucucgucuacacuuggcuccucagaugagauagauacuuaccugaaaguaugaggugucuagaacuacagagcugugaaaacagaagguagucuugcuacaaguuuuaguuuuuacugaaugagagaagggaugauaagcuugguacuagguuucaucagauaugcuuaagcugcaaguaguugaguagaccugucggguaguccuguguggcaggcaggcugugacuugguuucuuugucuugcuguaguuggacuacgacagggggaagcucuccaaaggacccuguuucacagcuggagcccaucagugaugagcccaguccccuugagauaccggaggcugucaccaaugggagcacacagaccccuuccaccacaucaccccuggagcccaccaucagcuguaccaaagaagacucguccguuguugucucagcugaaccuguggaggguuugccuuccgucccugcucuuuguaacagcacugguacuaucuugggggauaccccagugcccgaauugugugacccuggagacuugacugccaacccgagccagccaaccgaagcagugaaaggugauacagcugagaaggcucaggacucugccauggcugaagugguggagaggcugagcccugcucccucaguacucacaggugacgggugugagcagaaacucuuacuuuaccucagcgcagaggggucagaggagacagaagacucuuccagaagcucggcggucucugcugacacgaugcccccuaagccugacaggaccaccaccagcuccugugaaggggcugccgagcaggcugcuggggacagaggcgauggaggccaugugggacccaaagcucaggagccuuccccagccaaggaaaagaugagcagccuccggaaaguggaccgaggacacuaucggagccggagagagcgcuccuccaguggggagcacgugagggacagcaggccccggccggaggaccaucaccauaagaagcggcacugcuacagccgagagcggcccaagcaggaccgacacccuacuaauucauacugcaaugggggccagcacuugggccacggggacagagccagcccugagcgccgcucccugagcagguauagucaccaccacucacggauuaggaguggccuggagcaggacuggagccgguaccaccauuuggaaaaugagcaugcuugggucagggagagauucuaccaggacaagcugcggugggacaagugcagguauuaccacgacagguacacgccccuauacacggcccgggacgcccgagaauggcggccucugcauggucgugagcaugaccgccuuguccagucuggacggccauacaaggacagcuacuggggccgcaagggcugggagcugcaaucccgggggaaggaacggccccacuucaacagcccccgagaggccccuagccuugcugugccccucgagagacaucuccaagagaaggcugcgcugagugugcaggacagcagccacagucucccugagcgcuuucaugaacacaaaagugucaagucgaggaagcggagguaugagacucuagaaaauaaugauggccgucuagaaaagaaaguccacaaaagccuggagaaggacacgcuagaggagccaagggugaagaagcacaaaaagucuaaaaagaaaaagaaguccaaagauaaacaccgggaucgagaaagcaggugagggcugcucgcgggcuggccugcucuguccugccggcaccaagccagcaguaucuuuguuucacucuagagauuucauuaguuuacaucucuacauuuucacacagcuuugaaguuguuggucccucacaguucuuccaggccuaucacacaugucauuauaucuuguaacuguugcaguuucuucucugccuguuugccugcuuagagugagcuuaagacacaccauuuauuucuuuggccuuuugucuccuuuuuaggccaccauuucucauuuugaagucuaaauguuuuuuguaucuuuuugaggccugcgcuggccucaaacuuagauccuccugucucaguguccccagugcuggguuacagacuguggccaaccaccugauugguuuuacauaacuuaggagcuuaacuguuggcgauugucuuaauggaugccugauugguaagcaugagugugauuccuggauuuuuuuuuuagcuaauaacacuuagcaguaaacuagucaaaaacugccagagucuuugugaccagcuacagaccacagcugccuucuguccucugcuugaacacugggcagacauggcuggggaaaguggugguggacuuaaagacugugcuuaaaacuuguuuccauggaaggaaaccacacaugagcaggaggcaucugcccacuauucguaagcaguguuccgggggacagggagcguagauggcaguuucccucggugcuaaccucuggcugcuucuucugcaggcaccagcaggagucugauuuuucaggagcauacucugaugcugaccuccauagacaccggaagaaaaagaagaaaaagaaaaggcauuccaggaagucggaggacuuuauaaaggauguugagaugcguuuaccgaagcucuccagcuacgaggccggcggccauuuccggagaacagagggcagcuuucuccuggcugauggucugccuguggaagacagcggcccuuuccgggagaaaacgaagcauuuaaggauggaaagccggccugacagaugccgucugucggaguauggccaggguaagggaagcaaggacacagcucugagucaaguacuuugggaaaggugauaaacacagaaacauaagaggcacagaagggccaggcagugguggcgcacaccuuuaaucccagcacuugggaggcagaggcagguggauuuccaaguucaaggccagccuggucuacagagugaguuccaggacagucgggcuacacagagaaacccuguuuaaaaaaaaaaaaaaaaacaaaaucaaaacggcacaggaggauaugagaauggacucgaugaccaaaaacaagaccugccugugagcagaggugugcuuuaaucucuggcugggagugucuagcucuguggaaggccuaaguugcagagagcuagcuaggcucagcacaaccuguguacucagaucccuggaacuuggagcgucugugagugucacacaguagaacuugggcuauuaaagcauucugugcccauauauguuuuuaugugcacaucuuuguguguguuguacuaacuucugaaccccuaaaugcacuaguguaccccagcuccuaagucauaaaucaauagugugauugaucucuagagguguagcugcaguguggggcucugguauccuucaggcugcugguuucuggggugguucuugcugaucucuaagugaguaggucuguauacagcagccccugugccuugacuuuccuauguaguccaggcuagccugcacucagaguuuuauguuagcauccugagugcugggauuacaguccagugccagugugcuuggcugcuuucucuccgugaacauucauucucucuggacaggagcauugggcuuguagaaacugcauaggcugugaacaucgguggggcuagugcaaaggcuggcaaccugcagccagucuagccuggaguuaggaauggcucucaacaguucaaagugcagaagacuggcauguguucacagcgagcaccgaggugggagggucagggucagugcacuguggaagcccaggugcuauguguuagcucuggugccacucaguagcaguggacauagccuguccacugagacguuucucaucaccuggcccuugauauaaaaagcuugacaauucugccucggacacccaaagaucauggucacaaauaaaggacaugugugucacuacagagaugugggcaucuuggugaccccgaguggaaccuucugcuccuuggcaguccauucauacacugcagcuggaucugcagcuagacaccgcugcucugggucugacaccagcccuuccuccagcucuuuguaugacucagcucauugcuucagccugaaaggauggucacccacccgagaaugugcagcucugugcuggggcugagaccuggucccucuuguguggcucuugacgguccugugccggugcuuuguggcacugccagcucaugcugcuauccgagugauuuuucagcagcugauaaugagcuguaggaacugauuaucguuaagucugcagaacacacgcauaauaaagauguuccuuacuuugccuucuaggugacuaaacagccuuggccuuacaacaacaaaauuacgguaagcaauuguccccguuuuggucauuuguggaagugcugaguggauauagguggguuuucuggugaaaaccagggguggugaaggggaggguccuggcgugucugugccucuaggacucagucacuagcuagcauccagauguggaaauugugcuaagaaauggaguuaaguaucugagagcagagagaggccaaacaagggucaggguauaucugguuccuaaugcugguguuguguuguguggcccugagacacaggaacucagagcccgaacucugugauggagggcaggucuagucagcaaaggcuuuaaaaugagcugcugcucucgccucagcuaauucgcaggcuuccuccgugucauggagacaaagccucugggccucucuccuccucugcccagugaacguggugucugagggcugagugauuugcagcuuggggcccagcagguggcgcugcccuggcauuccaggguucucuacugcaguucaggaagguagagaggcaauuucaggaacuuucaaaagccuugggaacacauccagagagugugagaccaaccucuguucgucuaaugccugcugcaccucuuaucuuucagauucaacauuuugaacagaagccauccccaacccagcuuaaauuauaaacauagagaauaacuuuguccgaacugcguggugcuucuuuaguacauacuguacagaguuuaccauggacaacuguuucuuuuuucuuuuuuuucuuuucuuuuuucaguuuuuaccuuuucuuaauugcccuuauuccaaacggauacuuucuacacugcugaacauuguaaauuaccguguacauaaaaucacacugacaauaaugcccuggaauagaccaucucaaaugcugcuuaaccacagacucagguugacuacuuguaucucauguaauguuccuccacgcuagacaccuggugcacggccagcugggaaccauggacuucaaaaggacaagcgacagugcgucuauuuaaauuaaagacuuauuuaaagacccaagcucucagcgagaccuucgagggcuuccucugcaaugucugauauagaaacuaauuuguucacauuuuaguuguauucaagauuugaagauguauuuuauagacaaguucuguuuuugaacuuuguggaacuauuccaaucaauuuaccaguuaugaugaguauuugcauuaugaauguauaauccagacauuauuuguaaagccuacaguauguuuuuuuuaccuaacacuuuuuauacugugucucgucucgacaauaugauauugaagucugagucgucagcuugaucccuucaaguuucuaguuacagacaaaaaucauacugugauuuuauuuuuaauauggauaugcuauaaaacugugacacuuauaauucacugguccugcaucaggagacgggaguggggagaagacuguauuuaauacaguguguaucugaauacucuguaugguuuauacaguuuguguuguucagagaugucuaaaguugaucuuuguuuuuuuaagauuaaaaaagcacuugccccacuguauauauacggcauguaagauuuauauaguauauaaauggcagcaaauuaaacaaccgucucaguuuu

SEQ ID NO: 2789 - RNA, 11594 nt, Mus musculus
cagaacgccgcgcaaagcggagagcggguuuuugcgacggcaggcggcgcuugugcugccguuuccgugcugcacgcgguucccucgagugccgcgcucggacagacguagccggccgcgaaggcgcccagacggcaaaccagcgacccaugcugaagugagcacacaggucagcgagaugcuggcgcugcugaccgucggcguggcgcucgccguggccgccggacgagcccaggacagcccgauaccuggcagccgcuucgugugcaccgcguugccccccgaagcggcgcgcgccggcugcccgcugcccgcgaugcccaugcagggaggcgcucugagccccgaggaggagcugcgagccgcugugcugcagcugcgcgagaccgucgugcagcagaaggagacgcugggcgcccagcgagaagccauccgagagcucaccggcaagcuggcccgcugcgaggggcuggcgggcggcaaggcgcgcggcacaggcaaggacaccaugggcgaccugccgcgggacccgggccacgucguggagcagcuuagccgcuccuugcaaacccucaaggaccgcuuggagagccucgagguaccugugcgcgguggcaucuagcggguggugguccccgggaucgugggacugaggaugcgggagaaauggguacgugggcuggccgggcgcccccauccacggggagagcugaguucgggggugcaagucucgcuccuacucuggaccuuacugugauggccucccgucuccuuguccucuucuguccccacguucgaugggaaaggugaaauucucacccccaucuccauuccgucgcgcgcggggacuuacccacuagacucaccgugaacuuaccgagguuuuuaccuaaagaacccagacugccaagccuggagggcaaaacccggugaccccggcagccuguuuccucuuugcaaaccuccacuuucagaagcgggacacgcuccugcuggcuguacccagugcugagacugccaccggaggucagcugccccugggcaucugguguuuucuuugacaaauugcgucggggugugggaggacuggucuugacugaucugcaggauaguggagggggaaagccagcgaccccaggauguaagcaagccccuuauuaaccucaaagacgccucuucacagagucagcuuuuuuuuuuuuuuuuuuuuaaagaugcccuuagcuaugacuuuaggggaacggacuuuaucucgcuaucuucucccguggguaauuuggaacuuugggggagaaaucaucaauuaauuuucaucuuacuucccaccuuguuuaagaaguguggacauuucuguuaacagcguuuaucaaaaauaccuauuagcaaaaaugagguuuaaauuacagguguuaauuauugcuaaauuaucggaguguugcuuuuggcaugauugcuauauacaguauucccagcaucuguggguccaugagucaugauuacugagagcucacacuuuuugaguucuaagugugacucaggcagaguauuuaauuuuaacccuuguaauagagaauggcucgaggcagguccaguuuucuacaguuuauaaucugguacacugggacacagggauucaggcgcuugccaagggcucauggcugaggguggcuggcagccuccgagccagcgugauggcagaggagugagagaaauaggaagugaggguuuggauacauuaaaaacggagcugucugggguuuaguaacguauuauaccugaccuuuuccaggaauauggcagagcccguuugcccuuguaccauuuuggaacuuggggaccguguucauuucuagaugaaagcucgcuggcuuugaguaccauugauuaacuguuugaaaaaaaaaucuuaacuguguuuugggcuuuuuaugacauagaauuguagauguuggccaaauuuuuaggcuuuuugguaagagaagaaaagcagcuuuuucgagaggagaaagugagauucacaaguuucaaauauugcagggaaguaauuuuugucugacuuugaaagccuuucccuaccaaaaaggcggcggcggcggggggcgggggggcaucaguaaaauguucucuuugagccgcuuuggaagcuccuugcugugugguugggucacuggagcugcgugccacaguuucuauucagcuggccugaaucucucucccucccacccuuccaaagcuccagcuccgcacaaaugugucuaacgcugggcugccgagcgacuuccgagaggugcuccagcggaggcucggggagcuggagaggcaguugcuacgcaagguggcggagcuggaagaugagaagucccugcuucauaaugagaccucggcucaccggcagaagacagagagcacgcugaacgcccugcugcagagggugacugagcuggagcgagguaggugcugugcgcccgcccgcccgcccggcgcucugucugagaguggccuccuuuuuaccacuucaggcagaucuaggauuuccauuuauggacauaagugaagcagugguaguggcacaacauggagguguccuuagaugucugugcucacagggauuagcuccuagcccuaccagcauuacccugggggggggggggaacaaaggcacuccagaccagcuuggauaaacagccugaccucugaccuccugccggauguaacuaguucugccucuguucaucuugccaucucaugcuguguuagguaagauucagacagaaucuuucgugagagacagaggaggagaugaaggcuccuaaaggcuucaguuuguagucucaacccccuaacucucugggugacccgugggguuuuagguuuggugguggaggguauagaaucagauucacuaagaugacaaagccaaguucaaugucaugauugacaggagaccauccaauagaaaacugucccaugacccuggucgugaacagaagggucaggugaaagagggcgugagcuaaugggcuauuauuucauucaguccccgguuuccccgaaacacuuuccuguuuucuguuauuucccuugacuuacuuauuugacuuagauucuguuuuguuguuguuguugugggguuuguuuuguuuuuguuuguuuguuuguuuuuuaggugcuugaaacagcaucuuacuauauagccuaaccgggccuucaauuugccauccuccugccucagccuccaaaugcugggauuacaggugugugcugccauuucugacuugacauugauucuugaguuuucaaaaauaguuucuucucugucuuucuucuacugcuaggugacaucgggcgaugcacugggucucagaggcuucgucacaggcagagaaacugccucugauucuuucuugcuugacaagagggagagcagcauccugcccccagcacccccacacaaucacgguggauccuugggaggcaggggccagggaggaagcauagcagugagugacugaaagcggggacuagaaucagaggggacuugguggccuugcgccucccuuggcacagugcucggcuuaccagcaaggagacaagucaguauaauccggagaauggacaucguaucaggcugcaugcugaacaugcuacccauuucacagaugagaaaaugcucauuucccaggcaggcaaguuuccuuuauagauacuugcuaugaagccugagacacuugucacagugacauaaagcugagccucuccauuaucuguccuugaacuccaggccaguggaaaagcaugcuguacuuaguagcuuccccaccuguucuaagccagaagggacaggcagggcucaggccagccaugcugguucugacacccacauucuugccccuuaguucucacugaaagcccacagcucaacaggccacaggcugcugggcuaacaagagccaagccucuacaccagugguucagaggaaacacggagcuccugcaucucacguacacacacacccgcccacccgcccgagcaaguguauauguauaugguauuuugccuguaugcauauguaugccaccacauuuacacccggugcccacggagccuagaaagauguuggauccccugggccuggaguugcagugaucgugagcgcccuaugggugcacagaaaugagcccggguccucuguaagacgguauucuuacuuccucaacgguauucuuaauugcugagccggcuccaggcccagacuucccuuugacuccccagcacaggaaugcuagacuuuuuccuuguguuccacccacucaguucuggaaugagucuuaaaggaaaaugaccaucugguaagccauuuguuucugggcacuugugaguuuaugcucagucugcuuuauguccacuguagaaggguaugcagaugcucagcccccgaagugcacuaggaauuggaacuccaccagguuccguagaagcaucucacugagccccauagaggcucaagcguguggccgguuaggaaggcucuggggaguuccuguccuuggguucgucacucuacaucagauaugagccagacgcuuagcuguagcuucggugucuucuauuagccccacaccagguauccauggcagguacagaugacgcgguagugaugcucucaaucucugcagaucugagaaguuuaguagcgaucccagagaagaaauggguuuuuaacccuaacugggugugaagcucugggugugcuuacucugcacagcacccauguccccaguguacccauuucucuugucuguaagaccuguucauuuguaaaggccucagagucugggccaguaggccaggugcagcuggcugggugcugaaauugucggcuuuggcacugagaaaccagagcuuccuccuucaaaggcccaggcugcccaccccccuccuuaggcuugucuaccaccugcagcuucugauuuauuggucaagccuuuuaauuccuuaauugguucuaacuaaguuuccucugaaccuccaagcuguuuuauucaaauaaagggcaccaguugucaggcuagagccccucccugccucucugcucucccugcucuaauuaaaccuaucuguugucaccgaccuaaugauauuaccgaccccaagucuuauuaaauuggcaagccugcccaccugcgagcauagaagccauuucuccuuauuagauaaugaugccuucauuaagagcucggccauuugccacuugaagacugagcaccaguggcuguguguaguggagagagggacuucugguucuguuggaucaguagcugggugcccuuagauaagucguuucucugaagccucaacacaacaguacaaccuacagaauuggagcggguguugucuggcucuguaucuucagcauaaugaggggcaagcccugguguuuacaguggcuugcuuuuucagguguuugagacagucagauuuccaagucugggcaggugcuccauaggugcuccauagcccacagccuguuuugagagaugccuaccaugggaggucaggaugaaucagggagacuacauaaccgcagaagcaggagcaaauacuagcuagaaaacccagugagaccagaaaagcgacccuggacucagcugcugggcugugcaggagaccucugcagauaaggccugcgcccugggacuuuggaauaucaugauggaguaagguugucuggcccuuuaagagcacuuaguaaguaguuguugagugggcguggaacugaggccccuucacuggcaggaucugauccuuauguacagggaaacugucacuauggccacucacagaaucguguuguucccugcaaacuuugggucacagaacugugcauuaaucugagcuugagucaagaugaugcugaaagucccgggccauguaagaguuuguuuucaaagacuucagaugugaagaacagccugagaugggggagagggggucuuaccauucccaguaaggucuaaaguucuggccagguguuagccugaggggcgcagcaccucugcacgcaucugucucccccacccccaucccacauuccagaaaacaguccggcaaugcagucuucucuugagaaggaaagguaaugucaggagcacaggguuucccaguggggauugagauggacugucacaucacuucugaggaaggcuguagugugcaccugaagccugacuccuuugccugagcagugguaaucaucuaccauggcagguggugcaggcucacgcauccacaauguuuaucaagugcucugcuccugggagacaagcccaggucccuuggguuucaaagccugcccuuaagaaagaagacagagggacagagagcucauggaaagaugggaggaaauaagacuugauugaggaagaacaagaaaauuaaauccagugucucuaaucccuuccucucccuucuagucauugagaccgugagacucaauggugaucagaaaggaccagaguuggguguuuuguuuuugucugauuuauuugugaauucaaagaaaccucuugcagguggugguggcauacauuuaaaaacccaauacuugcuagguguuuuaggguuugauuccugcacaacacccuaagacacuaggcuaaggcaggauugugaguucaaagccggccugggcuacagguuauauagcaaggccuuuacucagaaacagauaggaaugaagaguucucuuaauuuuuuuuguuuuauguguauguauauaugcauaggcauauguauguaugccauguguggaggccagagagagcauuagauccccuggaacuggaggugcaguggcugugaacugucaugugacugauggacauugaaccugggugcuuuggaagagcagcaagcaugcuuagcugcugaguuauuucucucgcucggaggccucguuuccuagccuuaaugauggagauaggcuguauaugggaugcacaccuucaaugccagcacuuagcagacagaggcagaaggauggcuggucugaguaggaauuacaggacagaagcacacaaugagaccaucucaaaaaaaaaaaaaaaaaaagaaaagaaaagaaaagguagagacaaguucucuauggugucuacuguaugucuuacaaaauauuccguuccuucacaccucugggagcauccuggagagcuguacuugccagugccucugucgggauucucacccucgggucuucugugucacaggcuuucuguggucccuuaccggcccuuuggacuuccucuagucacugucuccuagaggaaguccccuccuacugucuuuagacugguuucccaccagaguguaagcuccugggagucaaggacuaucccaggacugcuggauuugggcacuuugaccaggagcuggagugccuggccugccugagugauggguccugguacuuggccaggccacccugcugcaaccaacuccuuuuccuuccacccaggcaacagugcauucaagucaccagaugcauucaaagugucccuuccucuccguacaaacuaccuguauggcaagaucaagaagacauugccugagcuguacgccuuuaccaucugccuguggcugcgguccagugccucgccaggcaucgguacgccauucuccuacgcugugcccgggcaagccaacgagauugugcugauagaguggggcaauaaccccauugagcugcucaucaacgacaaggugagaccugcuggggucucccuggguccaggggagcagacccuggaggacauccgcacuugcuggcuuucggcagcacgcagagcagauccuggccagccacagucuguuucagcuacugacugggagaguggugguugcccuccucagcauggaggaggaggcauuuccucuccagagugcugcccgugggauggggguggcagaggauaucugcagccuauggagaucccagcucugagucuggccaacaacaggcaguugaggauucccaugucacaggagcggagcggaaggaguaggaaggcaggaccccacaugcagaggcaguguuuguggcucucccuaaaugcucuggucgagggcaccugugugagaguguagauuuuaaagggaucggguuuauugcgauacauauggcaaaacugagcuuugaaacguacauucaguuuaggcuggcugugacuaauguauacagacagcuguauaaucacaccacaauaaacauauaaauaaacauauaaaacagccccacugccacacccccaugcacauguagucaacccagcccuucucagccucuggcaacuguucuuucucguccauagccuugccuuccccagagcagaagcuccguuugcauaggcaguaaggaccacuccuugaaagccuaguugugagccucugaucacucagccaccucgugcaaacccuaucuugaaaacaaaugacucaaacuuuucuccuaaagucagauccaacacaauaaaagaaugucccuaguccagcauuugaauggcugccucugcuguagauggcccaggucuagccuccauuugggauaggugaagaagagacccuugccugccugugaucuuuaucaaacugccacuggguggaguuugccuacucugggagcauuguggagaaguuggaaguucuguggaguggagugagccucccaggcuucuagcaggaacagcuuuccugagccaagaauuuauuguucuaaauaacacuguaaucccugagagucuuguuuuccucuccccuuagaccucuuguaaacaucuaauuccugggagggagacuucagguugcuaggagaccaacaguaacaacagcacaaccuugugcucacaggcuucuggccuguaguugaguguaggaucuguaugugcacacuccuguauugugcugacacgcauaugcauauagaggucuccagaccuucgcuugacacaggcaaggcuugguguacacacacacacacacauacacacucacaggucucuuagugcuaccugccagguuuuacacagagccuagcuuaguaagggaguguacacacacacacucacaggucucuuagugcuaccugccagguuuuacacagagccuagcuuaguaagggaguugguagccaggcccagaaccaagaauguccaguguccugaggcuuugcccagucuccugauugacacacacacaaggcaaaugggguuuggugugucacucacaagacagggacgggaaucccagcaggaguccuggacugugggaagaagaguaacccaggugauauuccuucgcuggaggaaucuguggaaucuggaccuggcgaguccucaccugcauguugauacccgcaggucgcacagcugccgcuguuugucagugauggcaaguggcaccacaucugcaucaccuggaccacucgagacggcaugugggaagcguuccaggauggggagaagcugggcacuggggaaaaccuggcacccuggcaccccauuaagccagggggcgugcucauccuggggcaggagcagguggguacucucucacggaugcuaccaaggaggcugcccaacccagcuacccggcauccccaugcccuugcccaaggucucccagacccugccacuguucugacagccaagcucccugguugugugaugagcaagcugugggaauguccuuguaaucacagggucauauaguggcucggguccagcugccuugugggucagcacuauaggaaggcaucuccagugucccuuugaaccccugcauuuggccuuaccugguacacagugguagaacugaaaucucccuggaacuauuggcucgggaucccggaaucuagcaaaggccauguaggaaagauguagugugccggcgggggggggggggggggggggggggcagugggcucaugggaagaaagaugaucugggacacuugcuaucuagguaaggggugacaaacagcaagcacgugggggcuugcaaacucaugcauggccuccuuccucacguccacugcuucaccccugaaagggacugagagucaggcuuuagguggcugucuucccugucugccucaguuucccccguguaaagugggugaggcuucaggaccuguggaauaugugguccccucccucucucuucccuggagagucaggaggccaguucugcuugugaaccuaucccagcgugcccuuuuccacuuuccaggacacggugggaggcagauuugaugccacgcaggccuuuguuggagagcucagccaguucaacauaugggaccgcguccuccgggcgcaggagaucaucaacaucgccaacugcuccacgaacaugcccggcaacaucaucccguggguggacaacaaugucgauguguucggcggggcuuccaaguggccuguggagaccugugaagagcggcuccuggacuuguagcugcccucuccgucccagaggccacgauccaucgggcuguucugaggacuucaaggcaucucuuccccauucaccuaaaaccucuggccugaacagaaaagagccggagcucuaaugcaggcuguguggccgcccuugucuuaggcucauuuguuccuuaccauuuugucgagguuuuuugggggguagugacagaaucccuggaagagucuugagccacuuccugcugggguuucuaguaaagucugugagccucuccaccagucccuguaaaugcuaaugcagcccagcccugccuguuguuuuggauccuuggugucucauguguacuuccugucuguccccuuugauggcugugcggucauccuaucggcguggccuaggucccuuguguguguagcacaucccugcuuuugacugaacacugcacagaagccccugaaauagggccucucccucguugucaugugcacuuuccgucugagggaacugcagcugcuggaaggccagcugcucagacaauccccagcauccccggaacagacaccccccccccccccccccguggagaaggucccccucucagacccacgcucgcucagaggcucguugcugggcuggcuuugaggggcugcucuucucaucuggugccaaaaguucauuugcagcuucuacaacaauccccacaaaagaugaacagccauuagaagccuccccuccuuuugaugcucagcccacugugaagagugagcuuguuuuguaagccacauugguuccugugagcaucugaccgucccccaucgaguauuucccccggaacuggagauucgggcgucauuuggcugcuacuugcuuagugacuccaggcugcaucauauaucauaauuuauuuuaaagagaaagugauucaguggggaaauuuauaaagcuauaaauauuauauauuuuauuuuucauacauguuugaauugcggauccauggauguuccaucuguaggaccaacuugaugugcccauccugacauuguaugccacaagagcucuugugaugauggaauuuugauuaaagugcaccggaagacgcu

SEQ ID NO: 2790 - RNA, 2454 nt, Mus musculus
aguccugccccauuuaaucucagucuccagagcagcuucccauggaacccugagucugauuuuucucgaguaaccacaugguggguucccagagcagagcagggugagccaugguguugcaauucccacacaucucagcuuugaguagggaagaagagacuuaagaagcuaagccaucgggcuggaaagguggcucagcgguuaagagcacuggcugcucuuucaaagguccugaguucaauucccagcaaccacaugguggcgcacaaccaucuguaaugagaucugacucccucuucuggugugucugaagacagcgacaguguacucauauauaauaaauaaauaagucuuuuuuaaaaaaaguuaaacaguuaaagaagcuaagccaucuugucuggucucaaacgaggaugugccuagcucuguagugaccugaugugcaagggugggcugguacccauggggagccuuccgcuucucugagcaggaggagcaggggaagggggaggaagagcuuauguguguguguaaagcugggaggcgaaggcggggcugggagugggaaggcugugaugggaaagaagcugagcccucucaaucuuaucuguggcccgagaagaaauccaaacacaguccuacagcagcucagaaaggagcuuccgaugcugacugacgugcccacagguuccaacuuacccaccucuuucuacagcaggcaaacuagaccggcccucacccaaccucagcuuuccuucccucagcaugcccaaaacauggcuggagucuauccacucuucuacccugcuacugccaaucacugaagagcaagcccuggaugccuucuccugaauucuaccauagcaucuuagcaucuguuccagaaaggcacaaucagugaugggacgacaggauggaaagauagggcacaggcacaugauuccugcagcuugucagacuacacacaugacagcaugcuacacaucacccccuccaugauaagugcauuguaaaacauaaaauaaggagcaaaccugguuaucuuucuccuacuuucaaggucuccaguugccccugccuagucccugauguagugaagccaacagucuucuguaacuacagaggggcccugaccucucucuuccuucaucuggcaccauuugcccaacagcccccacuuucuguucuucaaacacgcagagccuguucccaccuggggccuuugcacuuugccugucugauugccucaacuguucucccuaacauuuguuguuugguugguugguuuuguguuaaacauggcuggcuccaaccuuggcuuaagccgccucauuagcacagugcuaguccaaguauccucuccucuaccagucugagucauagcacuuuucaguuugaauuuccacuguuccuuuacuucauuuucacuguauguucccaccagauccugaguccuaaagagcaagagcuuuugguaauuaaugguaggcaugaaacagaacaccaguuaguucaucaacuaauucaaggccaaguuaggauacaugagccucuaacucccagugacaggaaguggguaaagaacuugucuugcaaaccugauguccuggguuugaucccugggacucacagcaguggaaggagagaacccacuccacacagcuguuuuuggacuucauaugcuaccaugguaugcaucuaaccccucugauuaaaggacaguauaaaaccgagguuggccguacaugcucauaaaucaguacuuuuggagggggaggcagaacugucaggucgucacaguagccuagguuauauaggacccugucuuaaaaacccagacacacauuuaucugcccagugaaugaguguggccugcagucuacagacucaccugguagucaucaucuucaucuucacuuucaucugagucuagagauuucuuuuccuuuuuugggucaccugaagccccaucuccaccuucuucuuguucaucuucuuccuguuucagaaauggacaaccugcagaaucaaaaaugcaaaacagacccccaagaauauaacacccacagccacccucugauuguggaccuucacauuaagccucuggaaggcucaagccuaguaugacaaagguccuaaaaaguggccacucagcaucauagaccagaagucaaagguccugauacagccauaaaagacucucugauccuuuauagccaucuugcucagcucagaaagaaggacaucucacagggucacaaagacccagguguggagcuaaaaacugcaccugccggguugauacccgcuaugaacaguugccaaaguaacuuuccuggucaugccuucuugguuguaugcucccauggucacaccuguccacauauggccuuuuggcaccaaaugcccaagaccacaccuuggcaggcuaccagcaucuacauuucugucuca

SEQ ID NO: 2791 - RNA, 20005 nt, Mus musculus
cuuucgguucuguaucuuacacaagaggcggcgacgcaagugcgccugcgcgggaucuccguagucugugcugagggcaggaacgcugucucuggagccgcggucccucgacucugaggacgucucacuaggggcucgccgcuuagaacgcucagagugaguuucuguucaacccucauaggaaacccggaagccggguggaaauuggaccugagggacuuuguccaagcucagaugcgaaaacggaggaucuaaaggccuggggagaggaagcaaggggcgaccuagggucccaggucucucuguggguguagcucuaaugcagacguuuaaaagucggguaagggggcaggagguguggcucaguugguaaagugcuugccccaccaccgcauaagccgguaguguuaguacagacuuguaaucccacuaacuggcaaguggaggcagaagggucagaagcucaagaccagacugcauuacaugagacccuggagagcgagucaaccuaguagagcuaagccucaaaauaccgucauaccucuuuucccuguuauuaugucuuguuuuuguuguuguuuguuuguuuuguuuuuuuauuaaagggcuucaaaguaagcaggcccagcacagccuaauaaaaauagaaugcgagggugagaggguguagcucugugagagggagcaugugcauauaugugccuuccacaccacucgagugcagauuagggaaaagcuuguaccacaaguccuuccaaguauguucaggaaucaagcucaggucaccgagcucugcaguaagcaccuuuaucugcugagacccucuugagccucuuguuguuguugucgagacuggggaucucuagguagcccugaguagcguggacucacaguuguagaccagacuggcauugaacucauagaaauucuccugccucugucucccuggugcagggccuaaaggcauggcccaucacgacuuacucuuacuuuuuaaagacaaucucaugaagcccaggcuggucuugaaguugacauuauagcugagggugacccugaauuucugacucuuuucuacccagcugagauaguaaguuugacugaucucccacuccccacccugcacagagccaggucuuccuaacucagagccuacccucugaguaaacuugucucucuuuucugacucuuuuuaaaaaagauuuguuuguuuauuuauuuauuuauuuaauguaugugaguacacuauaguuguacagauggcugugagccuucaugugguuguugggaauugaaauuuuuuaggaccucugcucgcucugguaggcccugcuugcaccaguaggcccccucacuccagcccaaagauuuauuuauuauuauauguaaguacacugucgcugacuuuagauguaccagaagagggggucagaucucauuaugggugagccaccaugugguugcugggauuugaacucaggaccuucggagagcacgcugagccaucucgccagcccuuccuuucugacuuuuuauauggcgucugaugcgguuuccuuauuuuucuugauuucaggcugcaggggcucgaggcagccagcgauggaccuccuaagacucucccggcucuuuuccgguccccgccccauaggacugucuguccuucaacaccuggaucuuguuggaucaacccgauggacaggaggcagggagggaccugcacggcugagagcugccuucugcggcuccuccuccccgcugccccugggcagcgggaaccagaaggaaaugagcagccucugcucugacuccaguaagcucagcacuguggcuccccaggaggaggcagaggaagagagcuucgggagccucucuggcaaauucuccucccggaggauauuccacaagucaacggcccagcucuacaaccugcagcucaaggaacaggguggugaggaggaagaacuggagcccagaccguggcggggccggaggaacacucaguacugguacuucuuucagugcaaacgucugaucaaggaaggaaaggucugagagugugcugugauuucaucuugugucccuggcccuuuaagaauucuuagcugggagaacccuaugaccuucaguguuggaugccccuuggauuucugggaacgggauaggaaauguauauaaagccggggguggggacuagcagagugagaaggcaguuagugaagacacugucagacaguggagccaggaggagcugagcugagcugagcugagcugagcugagcugagcugagcugagcugagcugagcugagcagauaggcuagcacaguugcuauggcuuggagcugcuagcauuggggaaacuacugggaagggaauguuuaagcagacuguuggggaacugagggaggaagaggcugggcuggaaacugagcggagggcaggcagggaguuaagagaacugguaaacagguaggcauuuuacaugagaaccuugggguuuuccuucugcuggguuggcauuuuauguggggcagugcagccuucucagcuguugaagcugggguguucauuacucaguccuuggaucucuguuauugcugucugggugcaagugugagugugugugccacggugcacauguggagcccagaggacgacguauagagcuggcuuuuccuuuccaccuucaugcacagcccagggaucgaacucuggucacuugcgcugcaggcgccucucucugcugaaccauauugcuagccccuuaccuaucuuuaacucaguacauggagguaaucccguuagucuucuuguccguaucacauuuccugggcucaugacuuauucuucucuuaacaguuugaccucuaaacuguugccagcucuaacuaauuuucauucuuucaaggcugucuugcuggguagcccuggcugauuggcacucacuuuguagcucaggacagccuaaaacauucacccuuccugucuccccuucuugagugcugggauuaccaguaccccgcuuauuuuauuguuuuauaccuuuuucacaaucuuaacuguguagcccuggcuaaacuggaauucacuauguagcccaggcuggccuggaacucacagagaggccacugacucacaaguacugggauuacagacacauaguaguggaucuagcuuauuuuauuuguuugguuuuuauuauuuuuuugguguaggaucucugucucugcauucuuggcuguccuagaacucauuauauaggccaagcuggcuuugaauucagagaucuaccugccucugcugggauuaaaggcauaaacuacuauacccgguuuauuuguuauuuuuaaaauacuuuuuaaacuuuauuuuugucuuuuuucuuggauaagguaucucuggguagcccuggcuguccuggaauucaccuuguagacuagguuggccucaaacucaaagacccaccugucucugccuucugagugcuaggaugaagugaguuucugccccacucuaucccaccuagcucauaaauaaaggacagagagaccugguauuuuuaaaaauauuuuuauucuuauuuauuuauaugucuaucuguguauguauguaauauguccaugugccugaaguuaggagcauccuuuggaguuagcugccugaugugcaugcugggaauugaacucgggucaucugcaagaauagcacauguccuuaaucacugagccgucucuucagcccgaaaccuggcauuuuuauuaaccagcugcaagccuaaacugccgggcagguucugagacuauuauaacccaacuugucuauuuauaaccagauaaaucccccauuacuugccaccugagucuugcuuuguugcauguguguccccagggccugcuacuggugcucaugguccauuccaccucauggugaccuucaccuucacucuccucuccuuuuccuugugguccguaccuuagacuccucuacucaaugugaagucccaccucccucuuugcugcccagucacagguacucgccuuuuguuauccaaucagagaccuuugggggcauucuucacagcacauuggucaauacaaugcccaagucacacugcaaccugaucuuagagcacagagcucagcaucugaauacacagugcacaggaccaaccccaacacuguuuuuccauagacgugagaucguuacaucccccgaagcuggaguuauacguggcuaugagcagccugacaagggugcuggaaauagaacuugggacuucuggaagcuucugugcucuuaguugaugccaucccuccaacccccuugcuucauuuuguagcuagagucuuauguauccuaggcuggcuuugaaggauagcccggagccuuugacucuucugcuuccaccucccuggugcugggagcacaggugugcacugcucgccucccuggugcugggagcacaggugugcacugcucgccucccuggugcugggagcacaggugugcacugcucgccucccuggugcugggagcacaggugugcacugcucgccucccuggugcugggagcacaggugugcacugcucgccucccuggugcugggagcacaggugugcacugcucgccucccuggugcugggagcacaggugugcacugcucgccucccuggugcugggagcacaggugugcacugcucaccucccuggugcugggagcacaggugugcacugcucaccucccuggugcugggagcacaggugugcacugcucaccucccuggugcugggaguacaggugugcacugcuauaccagguuuaugugcgcuggggauugaacccaggucuucaugaaagcuagacacaaacucaauuaugcuacagccgggcccuucccccucuaauuggacuuauuuuaguguguuacucccuguauuugugugcacauacacacaccaggaugcauauaugacagacaaggacaguuggggcgaauccguucucuccuucuguguggaagccagagauccaacuccaguugguaggcuuguuggcaagcacccuuacccacugagccgucuugucccaccaccaccguuuuauuuuggcuuuucugagacaaggguuuauucuguagccuacauuagucuucagcuugcuaucuauguagcccagguuggccugaaacucgugaugcuccugccucaucuuuccgugugcuggaucuacaggcacacauugugaugcccagcuuauuucuuuuucugcaucuuuuccagccagaacagccguuuugugaguaggcauccuauuuuacacuaccuccccaagugaacagaccuugccuggcucguggaaggacuuaguagccauuacuuaaauggacagaugagaaaaggagagccggguaugguggcacccaucucuacccagcucggaggcaggaagauuggggccagccuggucuacauagucaaaaagaagugucuucuguuaagugauaaagugacugcugcgcaugugcgggaagugucugcugcugcgcaugugcgggccuugagugagcucgucaguacuaccacagaaacgaagacaggaguagacggcgcaaggauggaggggacaggaucggguggggaacuggauguggacaaacacugcuuugggcagaaguuugcaaccagggagaagggagcugucuccccguaucauaucauaagggucccucuaccucgcacucucuucuggggggccuuuuauuuuggguagguuuuuuguuuguuuugaggaaauguuuuaugagucccaggcuguguggccuagaauagcuuugcuccuccuaccaaaggugugccccgcucucccuggcuugcuacaggucucagaagcuguccugagcccccucuccuguugccucuuucccuagcuugcagaggcccuggaucuguuugagaggcagaugcugaaggaagagcgcuugcagccucuggagugcaacuacacggugcugauugggggcugcgggcgcgucggguaccugaagaaggcuuucagacucuucaaugauguaagugugggucagauuaauaggggccaaagcuccggagugcaugcugggugcagguccugagcgggaugucacacaguggggcagaugacgugggcuuguugacauugaguccaaauugaggucaucuuggggcaucaagugaggugacagagacggcuucaugugcucucacuucucugccaccacgcccaguuagucuguguuccucuccacagacacagugcauccuguucuguuuccuaaugaaucaggacaacuguagucucaaguaagagcccagccaucuuguccuguggccagaggcagacccugccaacccuaguccucauauuugguacccuccugcaguucucaucgacugucaccaaagcaaaggaagggucucccuuucuacagucauugguuuauuuuuauuuuaugugcauuggugcuuugugugcauguauuucuaucugaggguguuagauauuggaguuacagacaguugugagcugccuugugggugcugagaauugagcccgggcucccuuuuagagcuaucaggguucuucaccacugagccauuucuccagugccuuguucuguuuuuugagauggccuuacuguguagcuuggacuaaccuggaacucacuauguagaccaggcuggccuugaauucagagauccacuugccugucuccugacagagguauuugccaacauguuugacaaaacuucacuuuuugguugguugguggggguuucucuguguagcacuggcuguccuggaacucacucuguacaacaaguuggccuugaacucagagaucugucugccucugcuucccaagugcugggauuaaaggcgugugccaccacucuuaagugcuaaaacugcacuuuuagaaggacaauuuagguauaugaauuguuuauaugaauaacuuuuuaaaaccaucucauccuugguuucugaggugaguucacuggcucgugaacucucacucaguuagugaacgcuggucccccuuucccagaacaaacccacucugugcucacgcuggauggucagagugagcuggacagaccucaggauaggaagcaccugacacaagugugcuagcucuagaauauucuuucaagugcccgaaaggaugguuuccuguuggcauuucugggaauacaggcuccauuuuucacagcccugucugguccagucaggaguuuggauacuguauacgaggugccacuugggucagccuuagcuccugggcuaguuggaugugguaacaaaacuuuccuggggccuucaaaguggcugcuucuccuagaaacaccuucaguuuucucccaucucaacagaugaagaagagagaccuggagcccucggaugccacauacacagcucuguucaaugucugugcggagucccccuggaaggacucugcccugcagagugcccugaagcuccgacagcagcuccaggccagaaacuuccagcucaaccugaaaacguaucaugcccugcugaagguggccgccaagugugcagaccucaggcugugccuggaugucuucaaggugggggcucccuuuucuccuugccuucaaagucagucgggugggacaagugagagagagagacuuguccgucucccuacaccugggauguucaggaggaaugagacaggucugugcuuuaugcugggguucacacacaaauccaacaggaccuuucugagacucagucacacuguggugggcuguaagcaggagagcaagagggggucacuguacugaguggaaggacgggagguucugagagguacaagugucaauaaggaggucuugcccagugugacacugaagaggcccauggggauuacacuuguccuguauacaugguugaaagauugcucagacauucuagaaggugucuuugcacaaauggggaaaccgagccuccaauacaaauggcugcuggggucagcuuugcacaagaucuucccucuaggaacagagcuaggaugacaggccuagagguaguguguguauagggggcaguuaggugcuuuacuuaggagcugguucuaacuggucccagggcuguauccaggucccuauuccuuagagaugcaugguccugguacugaacuaggugagaaugggccuugccauaguuucugagugagacugccuucuucucuuucccaggaaaucauccaaagggggcaugcagucacagaggagaccuucuguuuucugcuugugggcugcauccaggacaagaagacaggcuuccggcaagccaugcaggucagucuuaccuggugccagggcuagcauuguuuggugucuuagucagaguuucuauuccugcacaaacaucaugaccaagcagcaaguuggggaggaaaggguuuauucagcuuacacuuuccacacugcuguucaucaccaaggaagucaggacuggaacucaagcaggucaggaagcaggagcugaugcagaggccauggagggaugcuccuuacuggcuugcauccccuggcuugcucagcuugcucucuuauagaacccaagacuaccagcccagggauggacccacccacaagaggccuuucccccuugaucacuaauugagaaaaggccuuacagcuggaucucauggaggcaucuccucaagggaggcuccuuugugauaacuccaguuuguugucaaguugacacacaaaauuagccaguacauuuggcuuuuuucaaauuauagguacgcguguaggaggccagaaauggucuccugaagcuggaguuauagccuguugugagucacuugaaguggaugcugggaaaugauacucagguccucuaagagcaguaugcucuccuaaccaccgagcauccucuccaguccacugugccagcuguguuuuuauaucugcccuuccagccgucacauaaucauugcagggcauguccuuuuuuuuuuguuuuguagacauggaaaggcuuguggaaaaacuaccucauuaguggaggcaaagaucguuguaggaauuauuuaaaucccagcccuucuacccgccuuagaccauuuauguucccagaugaaagacacauucacagccuuuguauuuaugauaagccuuaaagaacacagagcugagcagcugccuacccaccaugcuguuagagucuacuuuccuaucgauaaccccaagguauuauuuacuuauuauguuucaucugggcugcucuuagcuccaguugggcagcccucggggcuguguucucuugacccuuaacccaugguggcuucuccuuccuccucuccagcaccuucuucuuccuugugauccuccucugcccccaaguccgggaaaccuaaacccugccuaugugucuucugcccagcuauugggcagaauauauauauauauauauauauauauauauauauauacacacauacauacacacacacacacauuaaauuuacguuuuauuuauaguuuuuauuguguguguguguguguuugaggggguguuugcauuccauagcacaaauguagagaucagaggacaucuugcuagguugguucucuccuuuucccauuaaggauugaacucaggucauuagguuugguggccagugccaguccccccugccccccuuuuugaugacucauuauauugcucagguuaaccugggaucccaccugggacucuaggccagcuucacagggauugcauuuagggcuugcuuccacacccuuagugacauccccagcaguuuucuucuucuucuucuucuucuucuucuucuucuucuucuucuucuucuucuucuucuucuucuucuucuucuucuucuucuucuucuucuucuucuucuucuucuuccuucuccucuuccuccucuucuucuccuccuccuccucuuccuccuccuucucauucucccuccuucuuucucauucuccucuucuuucuccuccuccuucucuucuuccuccuccucccacccccuccuccucuuuuuuucuucugugguccuaugguuuugacccagggcuuugcacaugcuaggcaguugaucuaccccugagccuacuccagcuuucucucgccuuaugaaguuugcuggucugacuauuaauccacauuaugccaagggccagccccugcaggucuuauuucuuauugguucuucuugaggcagcagaggucuuaagagauauuuaggucuuaagacuuggucuuaagagauauauaggguugcuguauaaucauaaaacauuucccugucuuaagucuaagucacuaugcuucaguagcuggccugcauucugugaguuccuccaaggcuagaagcuguucagcaccucaucauaaaacagcaggggcugaaguggaaggacuuacugcugcugcuccuuucucuggugaaucagccagaagccucucuggcuacgcugguuaacucuuugugaaccagagaggaggaaaaggaaaagaaguaagaugcuuuguacaggcaaauaugcacagacacguauacauucaaacauccauacacccacaccaggcccgauuggucugccacaaucaacuccacaaguauucaugcgugcuuucauacauacacauauaccuacacacaaacauauagacaaacagacauauacauuuaggauagaugaguggaugggccagagcuccccaagcaaaccauucaaucaccagcguuauuucuuuucucuggucuuuuauaccuuuagaaaaugaccucagagauaaaaugggaguuacagaaggaugucgauauuaaguucaaagcauuguuucauuauaccauacucauuacaaguucaaagcaacagucauuuacaugguccuugccuuaucauagugcacacuuacaacuuuaauucucccaaauucucccaagucuauuucucuccguagugugauuaagaaagcucacugcugggcuggagagauggcucagcgguuaagagcgccgacugcucuuccuaagguccugaguucaaaucccagcaaccacaugguggcugauaaccaucuguaaugagaucugacucccucuucuggagugucugaagacagcuacaguguacuuacauauaguaaauaaauaaauaaauaaauauuaaaaaagaaagaaagaaagcucacugcauuucuuauuaugcagccuuaguuacuauucugaggagugggcacacuguauucuugagucugacuuuauuacaucuuucuagcaacuaagaccaucucuaaaaacuuucuuccuaaaauuauuugaaucaagucagagauucuauagaaccauuaucuauuugucuauauagcaucacuauaagauaguauguauucauaggacugcagaaaucuguucaaaagggugauauauuuaauaguaacaggaaaagcauacuaauagcagggaccuuuccuuaaaugaguuucuccugggccuuguugacuggaguaaauccaucguagacuuuaauccaaggugggcccaucuaagggagcucgccugcuggguuuuagcuucuccuacgauggcucgugaucaugguacucauuuccucagaaggccuguaggaggcaggaacauggagcccuaacauuucuguuuuccuucagguguggcggcagaugcugagucuggggaucaaaccaaguaggcauggcuacaaccuccuguuggaggcagcucgagacuguggucugggggacccagagguugccuccaggcugcuccugacgucccaggaagagaccaucuugcucccacccccaaagggcaggcauauggcagggaggaaaguccaggccaagacagugcauggugugucacucagacauguggaagcacuggagaggcagcuguuucuggaaccuucucagaaacucgaggggccaccagcccuuccugaggccaggguaacaagcaggacccagccugagguggaaaccacggcagaaccuggccacacaguagcccucaccccacuggccucgaaaccuacccacuuggagcuggaagucagucuccuaagucuuggaacucucucccccgcuguggucucauuugggacaguggccacaccugcugauaggcuggcguugauggggggccuggaaggcuuccugggcaagaugaccgaacacgggcuccagccagacaucaaaacccucacucugcuggcugaggugguggagccugggagcacugcagaauccucgcugcuuuccguccuggacaggcauaggguggaggccgacguaaccuucuucaacacgcugauaaggaaaaagagcaaacugggagaccuggagggagccaagguaagggggcugucuacugggggcuccccuucucuuccugaucguagcuuacuagucagcagacaugucuagaguccuguucuaggccuggccagacaucaaaguuaggaauugagccauaaaccagccagcugcaccacaguccuaccacccagcggaaggguaugaagggcauucacggagaagggucaugcugacaugcugggaggccucaccuguuggaggcagcucgagacuguggucugggggacccagagguugccuccaggcugcuccugacgucccaggaagagaccaucuugcucccacccccaaagggcaggcauauacacuaguacacugaggagggguacauaagaugggcaggcacuucaggaacaggucuguagaguuguucagcagacuuaagaaucaccaugagggcuggggagauggcucagcgguuaagagcacugacugcucuuccagagguccuggguucaaaucccagcaaccacaugguggcucacaaccaucuguaaugacaucugaugcccucuucuggugugucugaagacagcgacaguguucucacauacauuuaaucaaucaaucaaucaaucagaaaagaaggaagaaaagacaggaagaaucacugugaacuggagagaugccucagugguuaagaacacuggauggucuucuagaagacaccucuauggcagcuuaaaaccaucuguaacuucaguuucaggaaucugaaacgcucuuccggcuuccauggccacuaagcauucaagugguacauggacauagacacaggcaggagagcuguacgcggaggaggaggaggaggaggcuggcuggcggguggggugcuugucuagcauaugguucuggauccauuccuagcacugcguaaacugcaucuggugaugcucaccuguaacccaggagacggggaucggaggcuggugggucauccuuggccauaaggccucagucaggguuacuauugcugugcugagucaccaugaccaaaagcaauuugaggagguuuuauuuggcuuaugcucccacauucauuuucugucacugagggaagucagaacaggacaggagccuggaggcaggagcugauguggaugccauggagggugcugcuugcuaucauggcuugcucagccagcuuccuuauagaaccuagcucagagauggcaccauccacaguaaggugggccuucccucaagcacuaauuaagagaaugcccuacagccucaucuuacguagguauuuucuccauugagauuccuaccuaccggauaacaguagcuuguaucagguucacauuaaaguauccagcaagccagauuggaaguucaaugccagccuugaccuuuucuuaaacaaacaaaaaacaaaacaacaacaacaacaaaaaaaaaaaacagggguugguggugaagagaaaaagagguggggaacuggacauggcggugcacuugggagguagagguagguggauuucagauuuccaaguuuacguguugaacuccagaccggcugaggcuuuguagugagacccugguucagcacccaacccugacuuccacccuccccccaaggagagaauuaccaugaggcacccuaguauaccuccaauccucugaccuuccucauccauacucugucuaugugcuucuggucugcucagacaggaggcgcuaccugguuguguggcuuucuccaucccacaaagauaauagccaggcuucuuacaggcuuuuguuuacuuacauaaccaguuuggguuuuuuuuaucuuuuuuuuuuuccugguuuuuucaagacaguguuaucucuguguaacagcccugcagcccuggaacucacuuuguagaucagacuggccucaaacucccagagacccgacugccucugcuucccaaaugcugggcauaaaggcgugcaugccaccucacggcacacagucaguuucugcgugacgcuugcuuugacagaagcaguacucugugcaucugugagggccaagggugacagagaagugacagugcagagcacaccucacucuggacaagcuaagauggcaguccuucccuggggcccucccgggcugagguacccuuucucauacuauacuggucagcgcuucuuccugcccuguaucaugagcuccuaguuucuuggcccauugcagggaugggcggccaaggagcgugagacagagggaaggaagggcagguaagaggaggacacgugagacaaagggccaugagaucaugagaccgggguugccguacagucagcugagggagucaggggccucugaguagagguggcuucccaggccucuagcacacagcagagugauucgucagaauaauaugccagagcuugugggucacagguaauaacuguugcauaucugucguacaacaggcacuguugccaauccuggcaaagaagggaauuguccccaaucuucggacuuucugcaaucuggccauugguugccaucggcccagggaugguaugcagcugcuugcagacaugaaggugaggggcacaggccuaacccugagcccgcugcccacaguccugggagaccugugggcaaaaugaggccuagcagaaucaaaugaguauggggggggcaagugggacaguacccguucugguguagaaugacaaugaccacuguaaaaagugacccugagaacuugaagcugguguugcuucccauggagaguugugaauggggcugagccccaacauccuggaggggauggaccagaagcccuggggacaaaggguacuuuucacagcccuggcucccucuaaugcacacucucucugaccaugagugcuugcugaguggauuucauccagccccagcaguggccacucccuaaggaccgaguaucguguacacguucugucacccaucuguuggcugcucugggcucaccggcgucuggugaugacagugucaacuaguaaacugcagccaggagcgagcggguccuuuccgcccgccugccugccugugccccugagcaccagccuuucucccuaaauagggcaugcuugcuuugcgucuguggagggcuagaaugcuguacggucccacccuuguucuagcagacugcguuguccuuccagccaccagcacaugcugaccauguucaugauguucguguucuagaagucccaggugagcccuaacauccacaucuacagcacccuuaucaacgcagcccucaagaaguuggacuacaccuaucucaucagcauccugaaggacaugaggcagaacagcgucccaguaaacgagguggucguccgccagcuggaguuugcagccgaguacccucccaccuuugaccggguaugugcaccaaguuuacugucagugcugauggcucccucagcugcucucaucucugcuuuugaccuuugagucuugacauucauuucccugcuaaaaguuguccaacaagguuucuuuucuuuuuuucuuuuucucccccucuccuuuuccuccuuuccuuuucccucuugcuucagccccacucacucuggccuccccucgcuccagcccauagguuuuuuguuucucauuauggauggaugguugugagccaccaugugguugcugggacuugaacucaugaccucuggaagagcagugagugcucuuaaccgcuagccaucuugccagcuuccaacaaguuuucuuaaggaaaaccuaagacccugagccacauggacuccccuggagcucucaggugguuugugguguggugugccugguguagauguagggaacugaacucagauucucuggaagggcagaaugcucucuuaaucacuaagccaucccucuagcccacuuuuuguuuuuauuaacagucagguaacucaggcuggccaugaccuacugacucuccugccuacaccucucaagaguuggcauuauaggcgugcacuauuguguccagucuuaaaaagcccuuugcagauccaccuccccucccccacauaucacagucucgugauaccaugguuuacuguuuuuacacuugguucuugccuucccugaaccaucugggcuuagagaggucgccugccuguucaccuguuucccaaugcacacuacucaccauuguguguuugcacguggcacugcaagugauagucugaggaaggaaggcuauuguacaaguuaccccuucaaggacgucaggcuccuauaguguggggcucuguugagucagggcccaugcucugucuccagagcacuaauagcaacuguggccuagauaaccacagaccagaugaggagacagugaaugggaugggagcacgaggcagugcucaggaauggcugccauguguggcacuugcugagaaagaauaagugggucagcagggcaggccaugcugagcaucaggaaggucugaagguccauaggucaccuucuaguugccuuuaaaaaaaaacguauauggguguuuggggauuguuuuuuuaauauuaauguaauguaugugauuacacuaucaaucucuucagacacaggggagaaggccaucggaucccguuacagaugguugugagccaccaugugauugcugggaauugaacucaggaucucuggaagagcagucagugcucucaacugcugagcuaucuccagcuguuuagggggcuuuuugaauagggucucuguguagcccuggcuguucugguacucaacucaauagaccaggcugaccuugaacucgaguuccauccgccugccucugccucccgagugcugggagcgagugccugugccacccaccaguguguauggguaucuuguuuuucuguguucagugugugugcaguacccaaggaggcccgaucccuuccaacuggaguuacagguaguuuucugccaucuuauggguacauggaguggaacccacucaaagcacguagcugccaagcccucucucgagcuccuagaacauuuucaauuccauguugugaacaacuugaugguuucauagucuucgugcauagaaggaaguuagugcagcugaggggcucagaccacuuaaagcuucuaucacucuccacuuuucugacacaggcucucuuucugaaacuggagcucgucaguugacuagacuuugccgucucccgucuuaucucccuaggccagggacuacauagcaggaggcauggguacuagaguuugaacuugugcuugcauaguaagcacagaacuauuucuuuagcacauuuaaucuucuuauuuucuagacauggucucuguguagcccuggcuauuuuggaacuugcauuguagaguggucuggccucuuaagagaucugccuaucucugcuaucuagauguugagaacaagggugugccccauguccagcucaaaacauacuuaaaccuuuuuuuuugggggggggggguguucgagacaggguuucucuauguagcccuggcuguccuggaacucacuuuguagaccaggcuggccucgaacucagaaauccgccugccgaggugcugggauuaaaggugugcgccaccacgcccggcccuuaaaccuuuuucaacucaaacuuuuaguauugugucuuagcaguguuuggcuuauuuuucccauggugcccguuaccuguuucaaacucaccacaccucuccucccugcauugaugcugccuugacccaaggucaaggauagcaacagcucagcaaaacagaggcaguugaggggaugccucaguucuagguguggggcuaaggugacuuccauggcuuaggcacacuauaguguucucaggcuagacggcuguuaggcaaagagugguauggccuauucccaaauaacagauuuuccagaacuuggcccuuuacagcaaugaaucuaaugacaaauuauuugguagucuccuugagggaaggaaggacaguggucagcugcugugacuugggauaauuuugggugauaugcaguagcuuagauuggcugaaaacauuucugaaagcucugcuuucuuagcauauccuguguucauuguacaaagcuauggguuucacagugaggcuucugugccuguaucucacucacacugacaguccugugcaucucuaauuauaguacaaaggaaaaaacaccuacuuggagaagauugauggcuuucgggcuuauuacaagcagugguugaaagccaugccagcagaggaagccccccaccccuggcaggaguuccagaacaagccuguuggggaccaagacaccacugacaaggcuggcggccuuagggacggaugacggagcacgcggcuaugacaagugcccagccuucacacugcugggggagccugggaguccuuucaacuucagaggccaagaauauuccagaggcaccacagcacuuuacaggcaaaugcugggcucagggugcccagaucauagcaggucccacaccaggccaaagcauccugacaacgaucauggucacacagcaucuacaacacagagccaggacuaagcccauccccuggcacucuuaaaagaaagaauguagcgaggaggucuaaagguuuuauuuuuacagaucucagcuggugaacacuaaagucgucaccuguacagcucaugcuucccccccugggucuuuucucugagcaccacucugagaagaguugcuucaggcaguggcccaauaagucuuaaguccaagguccaaagaccaggaugcagaggagucaagggugucagccagagcaaccccggcagccacagugugugcacucgaugaugcgacccugaaacagaagaagaacauuugaacacacugcuacagcccugcacacucccuugcagagcaucucuacuggacacuucuacuugggcgucucagcuccuuugugacguggaacaguuacuaccaggcggaaguuagugucugugugugauugcuguaacaagacacacuugucacugccaagagggcgaaagccagaguuccugaggccacuggguggggauggggguccuggagcaaugcugucuuuaccuccuuuucuggaggccacgagcccauucuaaacaaauaaaguucucugguaacguucuguuaguuuuaacugagugcgucucauauauaggaugacccuaauuuucugguccugccaacagcugcugaaugcuagaaugacagauguacacuugcacaucuggcucuauggggcacuggagauggaaccuagggcuucuagggcuucacgcauucuagggggccaucuaccaccucaggcaacauuccagcccugaaucucaguuaaaccucaaccacaggcugggacaccaagagcuucuugggaagcagcuauugcccacgagccauggcucagcacaucauacagagcuccacccuugauaccgaggacagagcuaccugcugagcugaggccaucugcacucaaugaaaacucugggaauuaagacuugcuucaguguacugagaggacacaaagucaaaggauggacugucug

SEQ ID NO: 2792 - RNA, 16161 nt, Mus musculus
aagugacguaaggcgucagccuucuggcagucgagagaguggccccggacaggcuggugcagcugagcgaggagcgccuccgugacgggacagucuccaggcccgccucuccaccugggugagucccggggaaccguugucgcgucgccgugggagcgaccgcuuguuuggcccgcggggcggacgcgcaggaggcgccgcgugcgggcugacggcuguucccggagcuggggcgcgcggaaggccgggcucgcggcccuguuuuccccucuucccggguucgucgcggagcccggggagccgggguggccccguggugcgaacccaguggccgggcccggguggcagcucggucuuguggcccgcuucgcccucuggggaccgaaccuuugcccaagagagagguaggcggaggguggcucugggcgaggccugcggacgggccgggagccuggcggagggcgguggacgguggacgguggacggaacccgggcucguccuuggaucugaaggacaccaggcuccucgcagcccucccucgugcugcgcgcagguggcucgaccagccugcccuaagggucugucuccuaagugaguuguaucauuauucaucggggcccauugaguaaugcagaacggccuuaccgcuuaccacaugauuccuaaggggccugcuuuugagaaaaacaaugaguaaucuuaucuggcguguuucacugggucucagcuugagccucuaaauuacuuaggacgcuccauggaaagguuuacgcaguuguacuguguugaaaaaaauucuuuuaaugguagcuauuuuguuguuguuguuguuguuguuguuuugguuuggguuuuuaaaagacagcuuugaggcuaaccuugaacuucugaaccuccugucuaaaucuuccgagagcugggauuacacgcccagcgauacacacacacacacacacacacacacacauauauuuuaaaccacagauuugggauuguucaguagagucugaguaauaucgaauucuuacaccuuccuguuuggguuuuaaguuuugaaaccgaaugguacucauguuuguuuuuuugugaagggggagguuguuauggauugaagguagggccuugugcauacuaggaaguacucuacccuuaaauuacaggcaucuccugcuucuguguuuuucuuuuuguuuauuuugguaacuuuuuagguuuuaaacccuucuugggcccuaauuaccaugcacuuuacuuaauuacauuuagagaaacuuaagucuguggacugugacaacuaaaaucuaguggggcuggguuucuagacaggguuucuuucugaggcacuggcugucuuggaauguagaucagguuagcuccaaacucgugucuaccugcuucugccucaccagugcuggaauuaaaggcuuguacuaccaccuucaggcugguuuuuuuuuuuuuuuuuuaaagucugcuuuuagcugagugugguggugcuggucuuuaaucccaacccuuaggcaagucucugugagucugaggccagccuggucuucaaagagcauccaggacagccagggcuuuguugcacagagaaacacuagcuuuaaaaaaaugucuuuuuaacaaagucuaucauauauagaauaguuugccaaguccugagaauaugagauuaugggacauuuuaacuuacuaagcaguucuucucacucucacccugcagugauggucauuguccccugaacagggauggaggagguaacaucccaagaagccgcagagucacccaggggccacuuccagccuuuggagaaccagucugaaugucuuuccccagagcuucgguuucugcaggacacggacauggagcagggauucaguggggguaaggcagagaccacacuuucuucaaggagaaugggaauaguaaggggcccuggccugacaugagagaggccagggucuugaauaagaaggugggccuuaguggaagaacuggaagggcguggcaggugugaguccuuggcuugggcccugugguuaggguagcuagccugucuguaauccgcccaucacccugcucuggccuugagaauaugagcuucacugcagacaccacaaccagaaugacuucuaacaaaggcugcuuuugccaugucucacuagcuuaccuaacgcaggccucggggacucccuggguucucuucagucugccuccucuccuggugaucuagugugauuugcuaccugccauucuuuugcaacuucaguguucgugaauaauccaauuuuggucaagaaagcaaccauuuaauuuccuguuugaacacagugucucuuuacaugcacagauguuacaucauauuaacuaucuauucacauacauauauuaaauagguaaguguuuccuccccuugaaauaggauccugcuaauguauagguagcccuggcuggccuaguacuaugcggcccaugauuugaaugaaucuugucucggccccccagcuacauugggaauguaggcauacagcaucauacuuagcugcugguuuuauuauguaagaacuaugucguaguucuuauagaucagcaccagugccugaaggaacuuguaugucagcaacacagauggaguaccauuauguggaggguacugugugggacauuguuggaggguguaaaggauugugaggaaacaugacuguuuuuguuucuacaagccgcacacaauagcuugcagaaauagugcccaauaauaacaugaaggcagaaugauguuuauaguaaaugguaucuggaaaaaugucagaaguuugcugaagacccuggcccuaucaucaaauccuucaacuuuuuuguguuguuugggucucucugcauagcccugguuguccuggaauuugcuaggccagucuggccuuaaagucaaagagauccaccugcuuccaccuccugagugcuggcauuaaaggcuuacaccaccacacccaguccccuucaacucuucuucagagccuuaauguagagcagguuggcauuggacugcuaugccuuggugacugaacuucugauccuucuauauccaccuaggugcugagauuacaguugugugacaccuugcccacuagauggugcuggggaucaaacccagagcaucaugcaugccaagcaagcacuccaccaacugagcuaugucuucaggcuucuuuuugcucuuguuucugguuuuugagaccacauuuuucacucuguaacccaggcuggccaggaaaugcugucugucugucugucuguuuugcuuugcucaucacaacagguauaaugcuugcccuucuauagaaggaaugucaugccaugaggauuaagugcgauuccuaguaaaguccauauuacaguccucagucuguguaaguaggagcagcucccaaggaggagugggcauaccugagaccugguaaauguugacuuuacuggaacacugacgugaaggaggaugcaacagacauaccuugggcaggagaaguguucugaaaagggagcccuguggaggggcugcucucacucuuggcuccuuucuccucccucagcuccaccuguuccccaggugccugcucuuccccaugagggaagcccaggagaccaggcagcugcgcuccugacagccagguaccaggugagcugagggacccucugcuuuuccucaggguuucucguugcuugaguguggccucucuuucaccccaucuguuaacccuugccuggagucuuuucaguagcaauuugggaacagaucauuuucagagaccuggauuugacagauagaauuuuuccaucuccacuaucaucuuuguccaugagacugugaugggcacucaugggauuuguucucuuaaguucuagucuguucucucuccuccccaacauaaacagcuacuagacguccucugugucauguucauucucuggccauggugcuauaguagcccauuccugagagcagccagaauuauuauuucaggaguuugugacauucgaggauguggcugugcaucuuacacgagaggaguggggaugccuggacccuguucagagggagcucuacagagaagugauguuagagaauuauggaaacguggucucacuggguaaggacccuccuguugaucaacuuaccuguuuggauuucuuucugaguaggugugagguuuuuuagguagucaguagagugugcccaguuaacacagaaccucucagcccuccaucuuuaagguccuuuccuuggggguggggguggagguaaauugaagguuacuuuggguuaucaggaggagaccguuauccuuauccccaguuuguacuucuugcuuuugugggacaucaguuuccuguuaggaaagagaaacuugguugugcuuuggcuaaauucucccuuucuuuucuuuucucuccucucuccccucuuccccuuccucucucuccccucucucucuccccucucucuucucccuccccccccccccuuuaaauagucauaaggaucuucccaaccccuagcuggacucuguucugaucccuuuguguaucugagauauuuuccauuaaagaaauacauuuaaaagacaggcuaaaaucucucuugaugaugagucucacuuuuuugagauucucaaacucuucuccaaacaggcagguuugagagacuucauuuaaaggugggacucacugucugccauuggagugcaucaccuagguggugauccaaguaaccguaacccagcaccagaaggcucaggauguccccugcugucuucagacacaccagaagagcgcaucagcucucauuacagaugguugugcaccaccaugugggugcugggauuugaacucaggaccucuggaagugcagucagugcucuuaaccacugagccaucucuccaacccuaggcuaaauucuuaaauuacgauuccuuauuuuaaggauaccugagauuaggcaaccuauaguguuguugagaaauaccccugaggagggacagggcuguuggcagucuccuugagcuuugucaucuugucugcugcccucacugcaguuuuuuagccugucuuugaucuugcauacacucuuuguguauuuacaucuauaaccuccgcccccuuccccaccuauuuuuuguuuuuuuuuuuuuuguuuguuuuuuuuuuuuuuuuuaauuuuccugauuacaugcuagauuuaagacauuuucuuacaugugggagacaguuuacucauuggcucauugggaagguuuuuaguauguuuuccauuccuggcucuuugaucuuuauaggcauacuucuccgccuucccaccacccggauucauugugugaauuccugcccagcccugagucauacccaggcaagugcuuucucuggagaaacacuugcaguccuuacggcaggaaucaccaagagauggcccagggaucggcuuuccaucgggagugcucaucccagcacggaaacuccuuuuccaagauuguaagauaucauacuugguugauggaacauauguuccuugggaugccaccauuauguaaaguugcugcucccucccuaagugacauuuggugaaucucuaacauggaagccuuccuuaugaucacgugcauuuggaacuccguucauucauaaaccacacuugguggucagcuacuugugugaaaugccacaaagcucacucuuuucaguugccaucuuuuccuguuauuuuagaguagggaucagaugcugugugcucuuucuagcaguaaguauagccugcccacugugaugccucacugugugaccucucacuugugugacccccagacuucucucauguuugguaucauuuuuuucuuccuuuaaaguccugucuucuuguaccugauuuguugugguaccaaaccaauugcuguauuuauauuaccuuuccuauuaaguguucuuaaugcugucuuugauagaggggaaguaggggggacagaaacuaaauaguucagggcaucaaaauggauguauuuuuaaaagcuuuguaaauuguaaaaugaucuauauaauuguaaacuacuguuaauuuuaccuaauacagaauuuccaacaguucacuuguguacuuuuuguaguaaagaaauuuuguaguauuuuaacucaagcuuauaauauucuaccaaguggaacuuuaccucauuuuaucuugucaucuuuucacacacaaaggacacacauacaugcauacccgcauaaacuauaagaaacccuccuacacuacccagcuugcuuuugugacugagccagcacauccuuagcaacuguuuuaacauccuugggaauucauuuuaucuuuguggguccaccauacuucauuugaaauguaagguuaaauuaaguguuuacuaauuuuauuuaguguuugggguuaaacauaagaccuuuauaauucaguccauggcuuagucucuuuuuuccaauucauguauuucccauggcuguauuuguauuuaucacaggcaccaaaagaguagucccuugauuaaauguuugcacuaggcagcaguaaauaaauaaauggcugaguuuacaaaaugcuugaugucuuggagacaacaguaauuuccauagaauaugucuuacugucaugacuccuuucuguucguaccacaugcuaugcauaucucguuuaauccuugcuauaacucaacaguaagcagaggauguuacucuuuaaauaaauagcuuccuuuaaagccuuuaagccuggcacgagggagacaggagcaagcagaucuugagcuugaggccagccuaaucuguauugaguuccaggacagccaaggcuacacagagacacuuuaucucaaaagcaaaaaacaaagcaaagcaaaaaaauuuuaaaaaguuacauucuuuauuaauucaaagggagugugcacaccacagcuugcauguugaggucagaggaugacuuucuagucaguucucucuuugugcugugugggcucuggggguugaauccaggucguuagcuccuuuacuaaguccgcucacuggccacagaggaacuugaggcucugagaaguuaggcuugggaccugccucucugccuguagcacaguagguccaaucauguaugacauuaaaagucuuggguucguuuguuuuuaaaccaggcauucuguaacucguauagacuaaccaggcuuccuccugagugcuggcauuagagguaugggcugggccagguguggugaugcacagaauuaaucccagcacuugggaagaagaggcagauguaucuuucuaagguuaaggcaagccagagcuauacagugagacuuugucucaaaaacaaaggaaaccaaaugaaaaacagguauccuucaucaccaggccugacccucaugacuuuuuuuuucccccuugagacagguucucuauguagcucuggcuguccuggaacucacucuauagaccagucuggccucauauauuuagagauccgcuugccucugccuuccaggugcugagauuaaaggcuugcaccaccacaaaccgaccucauaucacauuuuacacugugaauauuaauuuaucaugccagggauguaaaccccaagccuuauguguggaggcagcuguucuaaugaagcuuagcaguacuuucuucugacacaaaagacccaaguuaaguguccaaaaggugguugacuacuuaaaccucagcugggauucagaaacagugaaugucauccaugaaucuguucauaucuuacugauuuucccaagguccauauuuuccagcccauugcccuuaaaacauauuuuuuagauuauuuuauuuuaugucuguuuugcuugaguguauuuguaccguguucaugguuggugccuguggaggucagaagaggguguugaauacuuuagaacuggaguuauagugaguugugcaccaccaugaguacugggagucaaacugggguccucuccaaaagcaacaaguacucuuagcaucugagccaucucuccagucucugaaugccuuuuuuauaaaauuggguagcuguuauguugacagguauaaaauuagcacucuguaagcuauuuuuaaguauguuguucaaaagaagugcuggcuguauuauuagugcuggcggaucauuauuaguggugauaaugccugagauuaauuuaaaauauuuuguuauaguguucauugguguuuugccuccauguaucugugaggaugucuaauacccuggaacuggaguuaauuuaagguugugagccgccaugugggugcugggaauugaaccccagucuggaagagcaaccagcacucccagccacugagccagggagagguggcgcugacuccuuuccuuauccauauuggaauguugauguguccaggcucacugcugcugugagcucaugaaagcaauggcuuuuauuucaaaccccuuccccccacccuuucuguaauguuccuugagucauagaaggggugauagagguggucucuuuagggcuaagcacucaaaaggaacuuguucucagcucuuugagccguuagucugcguuaaccauuguccuauaugcuucuucauauagaaccuucucuuaccacagcugaaaagcagcacuaauuuuuugguauaaguauauuuaggagccaguuugacaccauauccuuugagcaaaacagaaguaggaccuaucuauaaucuuuccaguuguguacuuuugaccagguuaaucguaucaggccucaaaucuccuguuugggccucaaauccaaucaggaagugcuuccuuauucccauaauggucagacacuauuguagcuugaaggguucguaguugggauaagaccauugauguuuccuccccauauccugcauagcaccuucuggcaugaaugcuagcuagcaaaauggaaguuuccaacuagauuuguuuugcuuuuccagagaggguuucuugauguagcccuggcuaucugggaaggaacucacccuacagaccagucagucaggcaagcugucugucugucuuaucuaccuaccuaccuaccuaccuaucuaucuaucuauuuuuuuuuuaaagauuuauaucuaaguacacuguaguugucuucagacacaccagaagaggaaaucggaucccauuacagaugguugugagccaccaugugguugcuggaauuugaacucaggaccucuggaagagcagucaguguucuuaaccacugagccaucucuccaguccuuaacugcucuuuacacuguuuuuaagacucuguaaacauucauuaugugguaacaugccaggauaaugggaacaagaaauaagcuagauacgugguguauagauagacuuuuggagaugaaggacuggagccaaccauugcauauaugcuccuugauacuuucucugcucggugcauauagaacccuuugguuuuaaaaacaucaaaauucuguuuacuuagcaggcucccuguugcuuuagcauuaaaagaaguugagcugcucaagucugagagcagguuuguccuauuugagaaaagccugggcucuaugaguuucugcccagcauggucuacaaagugauauccugucucaagacagauagauagacagacagacagacagacagacagacacacacacacacacacacacacacacacacacacagacauacacacacacacacaggcggagauguaaguagcccucuuggcauuagaaaguuuguuuuacguguacuuuuacuauacuuacuucacuguagcaugugguaguaguguuuauugcugccuuuauauuaagaauaugugguucuuuaauuguuugagauggguugacccuuuugcuagggcucucuauccacugauuuuuuuauacaagaggcaucccauaaaugcuuguugaguaaaguguaugcuaauucuggugugaagauguggcauacccuuuuuucccauauucacugaagcauauugguucuauuuuucuuuaaagaaagucaaaauauuuguaagguuccuggaacauuaugauaauuaaauaugauaugcagucgucggaucagaguaaauaagcauuuucaucucuucaguaauuuuguuuuuugggacaguauauuuuuauguaguucuggcugcuauguagaucagggcaguccucuuuaacuauauguauguacugaguguuuauaugucacaugagugcaagugcccagggaggccagaagaggauuucagauucccuggagcucgaguuacagccaguaugagcugccauguggauauugggaaccaaacuuacuccugccagagcaguuaaguccuuuuaauuaagccaucuguccaucccuugaaguaauuuguuggggggguuaaaaaccuuaauauugucaccggucgugguggcgcacgccuuugaucccagcacuugggagcuagaggcaggcggauuucugaguuugaggccagccugaucuacagagugaguuccaggacagccagggcuacacagagaaacccugucucgaaaaaaccaaaccaaccaaccaaacaaacaccuuaauuaaaaaaaucuuaauauuaauuagaauuauauuguaaauuguuucaaccauuuuucuuacugugcuaaagaaccagaaauaauucccuguuuugguguucuuuauuaaacuugugugucuuacaggauuuugcuaaauuuauucauuuauuacugauuugcugcuauauuuuaacuuauuauauagcaggggcuugcauuucauuuucagaaugccauuugauacucgucgacaagguuugaugccaacacuguaccauuggcuaccauaguacuaaugauaacuucugugaagacagguauccagccaugcaugaauucaccaaucuguauuuaaauaaaagaugcugcuuccaaguuacaaacucuucccuuagcaaaccuuuuaccagaguacggaucucaacucagacgcccuagucauccucuucauucuccaggucuuccugacaaaugucuuuccagaacuuaucuucuguauaaguuugguuacauuuaguaauggucacguuacuaaaaagaaaagagggcaguguagcaucuggggauaaauugccauauuccauuuccuucucugugagcaggauuuccaauuucgaagccugauggaaucucugagcgggagcaagaucuacaagucuuugaucuggagucuaagaauagagaagucauaagaggugacuguucaggugaguaaggcggacucugucagaggaaucagugcaaaaguaaucuccagggguugagccaagcucuggcugagcucauacucaacacacagagcuuugccauucuggaguggagacagcgucugccugucucuacaguuuaauuucuuucauacaaauugugcuagguccuaauucaaguuacagcacaucugauaaauccugugaugcaccugauaagucuuguagccagagcucagaugugcuucaacauaagaagggucaugccaaagccaagucuuacaacccauuuuuauguuuguuccuuugaaauaucuuacuggcuguugucugucuugcugaaauagccuguuucuaucuccccuugauccauuuccauccuuccuugcuccuguugugccuuuacaucugcuauuuuuuguuuggaaguaaauagaauuugcuuauuuuugaggauaguacauuauuuaguuuuccucuuauuuuuauuuauauuuuuuuaagcacaggguauagauuacauuuguauuuuuuauuuauauuguauuagauggagagaccagagaagaaaacaagcuguugauuccuaagcggaaaauuucagaagaaguacauucauacaaagugagaguaggaaaauucaaacaagauauugcucaaguuccugaaaccagagagguuuauaagucugaggacagauuagaaagacuccaggagauucuaagaaaauuucucuuucuggagagagaguuuagacaaauaacaaucagcaagaagacuuucagcagugagaagaacacugaaccugaaaaaagcuucagucuagacuccacacuugauacagaucagagaguucuuagaauacagaccacugaugacaguaaauaugacaugaacuucaaccagaacccagcaguuggugaacaagaaccaauaaaucuaacagagaauuuucagaguacugacuauaaggaaagcuuaauggaucugucccaccuuaauaagugggagagcaugccuaccaccgacagauccuauaaaugugauacuugugggaaaaccuuccaucaggccucagcucuuacuagacaucagagaauucacacaagagagaaacccuacaaauguaaggaaugugagaaaucuuucagucagagcucaagucuuagucgacacaaaagaauacacaccagagagaaauccuacaaaugugaagcgucugauaaguccugugaugcaccugauaagucuuguagccagagcucagaugugcuucaacauaagaagggucaugccaaagccaagucuuacaaguguggaaccugugaaagagucuucagccgaagugugcaucuuacucagcaucagagaacacauaaggacauguccuguaaauguaccguguguggcagugacuucugccacaccucauacuuaguugaacaucagagacuacaucaucaagagaaguccuaugaauaugaugaaugugggcuggccuauguuaaacaacaaggaauucguuuccaagaaaagcccuacucauguaacgaaugugggaaagacuuuagauugaauucccaucuuauucagcaucaaagaauucacacaggagagaaacugcaugaauguaaugagugugggaaaucuuucagccaaaccucaugccuuauucagcaucacaaaaugcacaggaaagagaaaucauacgaauacaacaauuaugaggaaaguuucagucacaguucugaucuuacucugcaacaagaaguucccauuagagagagagucuuugauugugaugcaugggaagagaacuucagucagagagcacaccucauccaacaugaaaggguccauaccaaagagaaaccuuaugaaugcagugaacuuggggagacauuuagucaaguucaggccucauucaauaugugagaacugagaccagggaaagucacauauguacugaaugcuaugaugucuucagucauagcuuauuccguggucggcaucagagaauugauaaccagagagaaacccgcugaaugugaugaacauugggaagguuuuuuauuuuuucuuauuuuugguguuaaauucuucauugguuccuguaaaucagugcuagaauauauagaauaugauacauucuucagauuauuuucauaccuuagucacaguuggggaauuuguacuggaguaaaauuccacugucaaaugugaaaaagccaucagucaacuaccuuguugguucagugucaaauuugugccaugcauaaagccugugaagacauagguguguaugugaggaaacucaagucauaccccagugcuugaucacaucgaggaaacuauacccagaaauagucuauacccaagaaauuauuuggauauaguaaauguggcagaucugugagcaggaguccaucugucaucagaauguaccagaugugagucugauuguuaugcaaaugcuaagaucaaaacaucugcaccagaugagacugauauaaugcaaacggugaaauuuaaccacucuauuuuccaggccuuauccaguaucaaaguauuagaaaaugcuuacuucucuguguaauuauuacuauuuagucucagucuuuuuuacugcugaauaacugaauccagaagauaauugggaaacgaagucauuuucucacaguauccuuuaauaaguauucuaagaagguacaaguauuuuauuauagaacucauuugagugaauuuauuuuaauuuggccgauacacauuaaaacauuuuucuucuuugaaauggauucuuauucacaguuuaccuagaaugcuguuaaugugccaguguugacauagcuucuggagaguagcucaaugagccuucucuguucuggccagaguacucuccaaaggagacucaggccuauucuuuucugaggacccuacagacuauuguuucuauagccacacccuuggcuuccuguugauuucugcguucucuuaggcauccuuaaaugauguucugguguuagcuucucaccagcugauaaagaguuacuuccacaucagccauccauacguuuggaggauucagucuuccugaguuuguggcaggcacccaaacauuugcaagugauguccaaguuuuuagcugccuuguuugcauccacagcccucuaaugagaugacaaggacaucagggagccaguaagacuccuguuggccuagcuacauucauucagugccuacuuugcauguauguguauguuuagaauucuuuuauaugccuauauugaaggccaacaaaaugcucaggucugcuuuugauagggaaacaaagaacacacaaaucagaauaaggauauacagccuuccaauaaagauauugcuguuagugauguaucuagacaguauuucaagagaguggcagguccguuccugguaaaaccuuaaucauuaggauugcuucuuuaucuguucccuccuccacucccuucaucaagccaggguaguauuuugaagcauaaagcuuugugcauaauuauuugugcauugccauacuuuuguguugggaugcagucuuuguugcccaggcuggucuugaauuccuggguucacacaauuuccugccucccaaauagcugggauuauaggcaugcgcuccugugccuggauuuuauuuuuguauuuuaauagaaucugcaggccauauaaaggaucauggcucuuuugauuuacagaaguggucacagguguugaguccagggucccugcccgaugccacagaguucaugauuuuuuacaugaugugaagcauuuucaucuuaaaauuuguaacaucuugugaauaagaaaaguguuauuucaaauucuaguugucaaucaagcaguugaggcuuucauaguucagaugucauaauguucacuagggauccucaaccaguauauaaaauaugcugcucacuguaaaucuuguggcugaccucuaggguagucccaccacuguauuuuacuucuuugccaucagcaagcguagugucucaucaggacaagaaaaucaacauauaucaaauugaucuaaauguaaaagcaaaugaaaaaugcaugguuuuuugucccugucgaacauguauauucuuacuuauagagaccaauagucacuuccagugacugaggcagaggauuugauucauuccuaaguagcagaaucuguaaaaaccccacguaugcauuuggguuuggaacgugcuuuuguacuucuacuugaauaaagguguguucagugcucguagacucuuuguuuugagccaagucugcaggucccaggcagaaagaagcacugggcaccuugggacucuucaccaugccugccucuagcuccucugcgauacucacaagagugguucgcucucuacugaugccuagcuugccuuuccguaguccucugcagccaguuaggauugaguaguuuuguauuuuagauuuauuuauucuaaauguuuaugaguguuuuggcugcauauguauguacauuaugugcgugccuggaguccauagaagcuagaagaggacaucaaguccccugaaaaaaagauuugagccaccauguggguucuagaaucacuccauucucugcaagagaagacaauguucauaacugcugaaccagcucucuagccccaggauugaauguugguucaguugggaugcuucaguacauaaaaucaaacauuuguaguuucgguagagcuaugagaauguuuuggguagguaaaguaaaaaagaaugccaaaauaguuuuugaaguaacuugucaguccaaguagauauuuaguucuaauaaaaguaugaguuuuuau

SEQ ID NO: 2793 - RNA, 16161 nt, Mus musculus
auaaaaacucauacuuuuauuagaacuaaauaucuacuuggacugacaaguuacuucaaaaacuauuuuggcauucuuuuuuacuuuaccuacccaaaacauucucauagcucuaccgaaacuacaaauguuugauuuuauguacugaagcaucccaacugaaccaacauucaauccuggggcuagagagcugguucagcaguuaugaacauugucuucucuugcagagaauggagugauucuagaacccacaugguggcucaaaucuuuuuuucaggggacuugauguccucuucuagcuucuauggacuccaggcacgcacauaauguacauacauaugcagccaaaacacucauaaacauuuagaauaaauaaaucuaaaauacaaaacuacucaauccuaacuggcugcagaggacuacggaaaggcaagcuaggcaucaguagagagcgaaccacucuugugaguaucgcagaggagcuagaggcaggcauggugaagagucccaaggugcccagugcuucuuucugccugggaccugcagacuuggcucaaaacaaagagucuacgagcacugaacacaccuuuauucaaguagaaguacaaaagcacguuccaaacccaaaugcauacgugggguuuuuacagauucugcuacuuaggaaugaaucaaauccucugccucagucacuggaagugacuauuggucucuauaaguaagaauauacauguucgacagggacaaaaaaccaugcauuuuucauuugcuuuuacauuuagaucaauuugauauauguugauuuucuuguccugaugagacacuacgcuugcugauggcaaagaaguaaaauacaguggugggacuacccuagaggucagccacaagauuuacagugagcagcauauuuuauauacugguugaggaucccuagugaacauuaugacaucugaacuaugaaagccucaacugcuugauugacaacuagaauuugaaauaacacuuuucuuauucacaagauguuacaaauuuuaagaugaaaaugcuucacaucauguaaaaaaucaugaacucuguggcaucgggcagggacccuggacucaacaccugugaccacuucuguaaaucaaaagagccaugauccuuuauauggccugcagauucuauuaaaauacaaaaauaaaauccaggcacaggagcgcaugccuauaaucccagcuauuugggaggcaggaaauugugugaacccaggaauucaagaccagccugggcaacaaagacugcaucccaacacaaaaguauggcaaugcacaaauaauuaugcacaaagcuuuaugcuucaaaauacuacccuggcuugaugaagggaguggaggagggaacagauaaagaagcaauccuaaugauuaagguuuuaccaggaacggaccugccacucucuugaaauacugucuagauacaucacuaacagcaauaucuuuauuggaaggcuguauauccuuauucugauuuguguguucuuuguuucccuaucaaaagcagaccugagcauuuuguuggccuucaauauaggcauauaaaagaauucuaaacauacacauacaugcaaaguaggcacugaaugaauguagcuaggccaacaggagucuuacuggcucccugauguccuugucaucucauuagagggcuguggaugcaaacaaggcagcuaaaaacuuggacaucacuugcaaauguuugggugccugccacaaacucaggaagacugaauccuccaaacguauggauggcugauguggaaguaacucuuuaucagcuggugagaagcuaacaccagaacaucauuuaaggaugccuaagagaacgcagaaaucaacaggaagccaaggguguggcuauagaaacaauagucuguaggguccucagaaaagaauaggccugagucuccuuuggagaguacucuggccagaacagagaaggcucauugagcuacucuccagaagcuaugucaacacuggcacauuaacagcauucuagguaaacugugaauaagaauccauuucaaagaagaaaaauguuuuaauguguaucggccaaauuaaaauaaauucacucaaaugaguucuauaauaaaauacuuguaccuucuuagaauacuuauuaaaggauacugugagaaaaugacuucguuucccaauuaucuucuggauucaguuauucagcaguaaaaaagacugagacuaaauaguaauaauuacacagagaaguaagcauuuucuaauacuuugauacuggauaaggccuggaaaauagagugguuaaauuucaccguuugcauuauaucagucucaucuggugcagauguuuugaucuuagcauuugcauaacaaucagacucacaucugguacauucugaugacagauggacuccugcucacagaucugccacauuuacuauauccaaauaauuucuuggguauagacuauuucuggguauaguuuccucgaugugaucaagcacugggguaugacuugaguuuccucacauacacaccuaugucuucacaggcuuuaugcauggcacaaauuugacacugaaccaacaagguaguugacugauggcuuuuucacauuugacaguggaauuuuacuccaguacaaauuccccaacugugacuaagguaugaaaauaaucugaagaauguaucauauucuauauauucuagcacugauuuacaggaaccaaugaagaauuuaacaccaaaaauaagaaaaaauaaaaaaccuucccaauguucaucacauucagcggguuucucucugguuaucaauucucugaugccgaccacggaauaagcuaugacugaagacaucauagcauucaguacauaugugacuuucccuggucucaguucucacauauugaaugaggccugaacuugacuaaaugucuccccaaguucacugcauucauaagguuucucuuugguauggacccuuucauguuggaugaggugugcucucugacugaaguucucuucccaugcaucacaaucaaagacucucucucuaaugggaacuucuuguugcagaguaagaucagaacugugacugaaacuuuccucauaauuguuguauucguaugauuucucuuuccugugcauuuugugaugcugaauaaggcaugagguuuggcugaaagauuucccacacucauuacauucaugcaguuucucuccugugugaauucuuugaugcugaauaagaugggaauucaaucuaaagucuuucccacauucguuacaugaguagggcuuuucuuggaaacgaauuccuuguuguuuaacauaggccagcccacauucaucauauucauaggacuucucuugaugauguagucucugauguucaacuaaguaugagguguggcagaagucacugccacacacgguacauuuacaggacauguccuuauguguucucugaugcugaguaagaugcacacuucggcugaagacucuuucacagguuccacacuuguaagacuuggcuuuggcaugacccuucuuauguugaagcacaucugagcucuggcuacaagacuuaucaggugcaucacaggacuuaucagacgcuucacauuuguaggauuucucucugguguguauucuuuugugucgacuaagacuugagcucugacugaaagauuucucacauuccuuacauuuguaggguuucucucuugugugaauucucugaugucuaguaagagcugaggccugauggaagguuuucccacaaguaucacauuuauaggaucugucggugguaggcaugcucucccacuuauuaaggugggacagauccauuaagcuuuccuuauagucaguacucugaaaauucucuguuagauuuauugguucuuguucaccaacugcuggguucugguugaaguucaugucauauuuacugucaucaguggucuguauucuaagaacucucugaucuguaucaaguguggagucuagacugaagcuuuuuucagguucaguguucuucucacugcugaaagucuucuugcugauuguuauuugucuaaacucucucuccagaaagagaaauuuucuuagaaucuccuggagucuuucuaaucuguccucagacuuauaaaccucucugguuucaggaacuugagcaauaucuuguuugaauuuuccuacucucacuuuguaugaauguacuucuucugaaauuuuccgcuuaggaaucaacagcuuguuuucuucucuggucucuccaucuaauacaauauaaauaaaaaauacaaauguaaucuauacccugugcuuaaaaaaauauaaauaaaaauaagaggaaaacuaaauaauguacuauccucaaaaauaagcaaauucuauuuacuuccaaacaaaaaauagcagauguaaaggcacaacaggagcaaggaaggauggaaauggaucaaggggagauagaaacaggcuauuucagcaagacagacaacagccaguaagauauuucaaaggaacaaacauaaaaauggguuguaagacuuggcuuuggcaugacccuucuuauguugaagcacaucugagcucuggcuacaagacuuaucaggugcaucacaggauuuaucagaugugcuguaacuugaauuaggaccuagcacaauuuguaugaaagaaauuaaacuguagagacaggcagacgcugucuccacuccagaauggcaaagcucuguguguugaguaugagcucagccagagcuuggcucaaccccuggagauuacuuuugcacugauuccucugacagaguccgccuuacucaccugaacagucaccucuuaugacuucucuauucuuagacuccagaucaaagacuuguagaucuugcucccgcucagagauuccaucaggcuucgaaauuggaaauccugcucacagagaaggaaauggaauauggcaauuuauccccagaugcuacacugcccucuuuucuuuuuaguaacgugaccauuacuaaauguaaccaaacuuauacagaagauaaguucuggaaagacauuugucaggaagaccuggagaaugaagaggaugacuagggcgucugaguugagauccguacucugguaaaagguuugcuaagggaagaguuuguaacuuggaagcagcaucuuuuauuuaaauacagauuggugaauucaugcauggcuggauaccugucuucacagaaguuaucauuaguacuaugguagccaaugguacaguguuggcaucaaaccuugucgacgaguaucaaauggcauucugaaaaugaaaugcaagccccugcuauauaauaaguuaaaauauagcagcaaaucaguaauaaaugaauaaauuuagcaaaauccuguaagacacacaaguuuaauaaagaacaccaaaacagggaauuauuucugguucuuuagcacaguaagaaaaaugguugaaacaauuuacaauauaauucuaauuaauauuaagauuuuuuuaauuaagguguuuguuugguugguugguuugguuuuuucgagacaggguuucucuguguagcccuggcuguccuggaacucacucuguagaucaggcuggccucaaacucagaaauccgccugccucuagcucccaagugcugggaucaaaggcgugcgccaccacgaccggugacaauauuaagguuuuuaacccccccaacaaauuacuucaagggauggacagauggcuuaauuaaaaggacuuaacugcucuggcaggaguaaguuugguucccaauauccacauggcagcucauacuggcuguaacucgagcuccagggaaucugaaauccucuucuggccucccugggcacuugcacucaugugacauauaaacacucaguacauacauauaguuaaagaggacugcccugaucuacauagcagccagaacuacauaaaaauauacugucccaaaaaacaaaauuacugaagagaugaaaaugcuuauuuacucugauccgacgacugcauaucauauuuaauuaucauaauguuccaggaaccuuacaaauauuuugacuuucuuuaaagaaaaauagaaccaauaugcuucagugaauaugggaaaaaaggguaugccacaucuucacaccagaauuagcauacacuuuacucaacaagcauuuaugggaugccucuuguauaaaaaaaucaguggauagagagcccuagcaaaagggucaacccaucucaaacaauuaaagaaccacauauucuuaauauaaaggcagcaauaaacacuacuaccacaugcuacagugaaguaaguauaguaaaaguacacguaaaacaaacuuucuaaugccaagagggcuacuuacaucuccgccuguguguguguguguaugucugugugugugugugugugugugugugugugugugugucugucugucugucugucugucugucuaucuaucugucuugagacaggauaucacuuuguagaccaugcugggcagaaacucauagagcccaggcuuuucucaaauaggacaaaccugcucucagacuugagcagcucaacuucuuuuaaugcuaaagcaacagggagccugcuaaguaaacagaauuuugauguuuuuaaaaccaaaggguucuauaugcaccgagcagagaaaguaucaaggagcauauaugcaaugguuggcuccaguccuucaucuccaaaagucuaucuauacaccacguaucuagcuuauuucuuguucccauuauccuggcauguuaccacauaaugaauguuuacagagucuuaaaaacaguguaaagagcaguuaaggacuggagagauggcucagugguuaagaacacugacugcucuuccagagguccugaguucaaauuccagcaaccacaugguggcucacaaccaucuguaaugggauccgauuuccucuucuggugugucugaagacaacuacaguguacuuagauauaaaucuuuaaaaaaaaaauagauagauagauagguagguagguagguagguagauaagacagacagacagcuugccugacugacuggucuguagggugaguuccuucccagauagccagggcuacaucaagaaacccucucuggaaaagcaaaacaaaucuaguuggaaacuuccauuuugcuagcuagcauucaugccagaaggugcuaugcaggauauggggaggaaacaucaauggucuuaucccaacuacgaacccuucaagcuacaauagugucugaccauuaugggaauaaggaagcacuuccugauuggauuugaggcccaaacaggagauuugaggccugauacgauuaaccuggucaaaaguacacaacuggaaagauuauagauagguccuacuucuguuuugcucaaaggauauggugucaaacuggcuccuaaauauacuuauaccaaaaaauuagugcugcuuuucagcugugguaagagaagguucuauaugaagaagcauauaggacaaugguuaacgcagacuaacggcucaaagagcugagaacaaguuccuuuugagugcuuagcccuaaagagaccaccucuaucaccccuucuaugacucaaggaacauuacagaaaggguggggggaagggguuugaaauaaaagccauugcuuucaugagcucacagcagcagugagccuggacacaucaacauuccaauauggauaaggaaaggagucagcgccaccucucccuggcucaguggcugggagugcugguugcucuuccagacugggguucaauucccagcacccacauggcggcucacaaccuuaaauuaacuccaguuccaggguauuagacauccucacagauacauggaggcaaaacaccaaugaacacuauaacaaaauauuuuaaauuaaucucaggcauuaucaccacuaauaaugauccgccagcacuaauaauacagccagcacuucuuuugaacaacauacuuaaaaauagcuuacagagugcuaauuuuauaccugucaacauaacagcuacccaauuuuauaaaaaaggcauucagagacuggagagauggcucagaugcuaagaguacuuguugcuuuuggagaggaccccaguuugacucccaguacucaugguggugcacaacucacuauaacuccaguucuaaaguauucaacacccucuucugaccuccacaggcaccaaccaugaacacgguacaaauacacucaagcaaaacagacauaaaauaaaauaaucuaaaaaauauguuuuaagggcaaugggcuggaaaauauggaccuugggaaaaucaguaagauaugaacagauucauggaugacauucacuguuucugaaucccagcugagguuuaaguagucaaccaccuuuuggacacuuaacuugggucuuuugugucagaagaaaguacugcuaagcuucauuagaacagcugccuccacacauaaggcuugggguuuacaucccuggcaugauaaauuaauauucacaguguaaaaugugauaugaggucgguuugugguggugcaagccuuuaaucucagcaccuggaaggcagaggcaagcggaucucuaaauauaugaggccagacuggucuauagagugaguuccaggacagccagagcuacauagagaaccugucucaagggggaaaaaaaaagucaugagggucaggccuggugaugaaggauaccuguuuuucauuugguuuccuuuguuuuugagacaaagucucacuguauagcucuggcuugccuuaaccuuagaaagauacaucugccucuucuucccaagugcugggauuaauucugugcaucaccacaccuggcccagcccauaccucuaaugccagcacucaggaggaagccugguuagucuauacgaguuacagaaugccugguuuaaaaacaaacgaacccaagacuuuuaaugucauacaugauuggaccuacugugcuacaggcagagaggcaggucccaagccuaacuucucagagccucaaguuccucuguggccagugagcggacuuaguaaaggagcuaacgaccuggauucaacccccagagcccacacagcacaaagagagaacugacuagaaagucauccucugaccucaacaugcaagcuguggugugcacacucccuuugaauuaauaaagaauguaacuuuuuaaaauuuuuuugcuuugcuuuguuuuuugcuuuugagauaaagugucucuguguagccuuggcuguccuggaacucaauacagauuaggcuggccucaagcucaagaucugcuugcuccugucucccucgugccaggcuuaaaggcuuuaaaggaagcuauuuauuuaaagaguaacauccucugcuuacuguugaguuauagcaaggauuaaacgagauaugcauagcaugugguacgaacagaaaggagucaugacaguaagacauauucuauggaaauuacuguugucuccaagacaucaagcauuuuguaaacucagccauuuauuuauuuacugcugccuagugcaaacauuuaaucaagggacuacucuuuuggugccugugauaaauacaaauacagccaugggaaauacaugaauuggaaaaaagagacuaagccauggacugaauuauaaaggucuuauguuuaaccccaaacacuaaauaaaauuaguaaacacuuaauuuaaccuuacauuucaaaugaaguaugguggacccacaaagauaaaaugaauucccaaggauguuaaaacaguugcuaaggaugugcuggcucagucacaaaagcaagcuggguaguguaggaggguuucuuauaguuuaugcggguaugcauguauguguguccuuugugugugaaaagaugacaagauaaaaugagguaaaguuccacuugguagaauauuauaagcuugaguuaaaauacuacaaaauuucuuuacuacaaaaaguacacaagugaacuguuggaaauucuguauuagguaaaauuaacaguaguuuacaauuauauagaucauuuuacaauuuacaaagcuuuuaaaaauacauccauuuugaugcccugaacuauuuaguuucuguccccccuacuuccccucuaucaaagacagcauuaagaacacuuaauaggaaagguaauauaaauacagcaauugguuugguaccacaacaaaucagguacaagaagacaggacuuuaaaggaagaaaaaaaugauaccaaacaugagagaagucugggggucacacaagugagaggucacacagugaggcaucacagugggcaggcuauacuuacugcuagaaagagcacacagcaucugaucccuacucuaaaauaacaggaaaagauggcaacugaaaagagugagcuuuguggcauuucacacaaguagcugaccaccaagugugguuuaugaaugaacggaguuccaaaugcacgugaucauaaggaaggcuuccauguuagagauucaccaaaugucacuuagggagggagcagcaacuuuacauaaugguggcaucccaaggaacauauguuccaucaaccaaguaugauaucuuacaaucuuggaaaaggaguuuccgugcugggaugagcacucccgauggaaagccgaucccugggccaucucuuggugauuccugccguaaggacugcaaguguuucuccagagaaagcacuugccuggguaugacucagggcugggcaggaauucacacaaugaauccggguggugggaaggcggagaaguaugccuauaaagaucaaagagccaggaauggaaaacauacuaaaaaccuucccaaugagccaaugaguaaacugucucccacauguaagaaaaugucuuaaaucuagcauguaaucaggaaaauuaaaaaaaaaaaaaaaaacaaacaaaaaaaaaaaaaacaaaaaauagguggggaagggggcggagguuauagauguaaauacacaaagaguguaugcaagaucaaagacaggcuaaaaaacugcagugagggcagcagacaagaugacaaagcucaaggagacugccaacagcccugucccuccucagggguauuucucaacaacacuauagguugccuaaucucagguauccuuaaaauaaggaaucguaauuuaagaauuuagccuaggguuggagagauggcucagugguuaagagcacugacugcacuuccagagguccugaguucaaaucccagcacccacaugguggugcacaaccaucuguaaugagagcugaugcgcucuucuggugugucugaagacagcaggggacauccugagccuucuggugcuggguuacgguuacuuggaucaccaccuaggugaugcacuccaauggcagacagugagucccaccuuuaaaugaagucucucaaaccugccuguuuggagaagaguuugagaaucucaaaaaagugagacucaucaucaagagagauuuuagccugucuuuuaaauguauuucuuuaauggaaaauaucucagauacacaaagggaucagaacagaguccagcuagggguugggaagauccuuaugacuauuuaaaggggggggggggagggagaagagagaggggagagagagaggggagagagaggaaggggaagaggggagagaggagagaaaagaaaagaaagggagaauuuagccaaagcacaaccaaguuucucuuuccuaacaggaaacugaugucccacaaaagcaagaaguacaaacuggggauaaggauaacggucuccuccugauaacccaaaguaaccuucaauuuaccuccacccccacccccaaggaaaggaccuuaaagauggagggcugagagguucuguguuaacugggcacacucuacugacuaccuaaaaaaccucacaccuacucagaaagaaauccaaacagguaaguugaucaacaggaggguccuuacccagugagaccacguuuccauaauucucuaacaucacuucucuguagagcucccucugaacaggguccaggcauccccacuccucucguguaagaugcacagccacauccucgaaugucacaaacuccugaaauaauaauucuggcugcucucaggaaugggcuacuauagcaccauggccagagaaugaacaugacacagaggacgucuaguagcuguuuauguuggggaggagagagaacagacuagaacuuaagagaacaaaucccaugagugcccaucacagucucauggacaaagaugauaguggagauggaaaaauucuaucugucaaauccaggucucugaaaaugaucuguucccaaauugcuacugaaaagacuccaggcaaggguuaacagauggggugaaagagaggccacacucaagcaacgagaaacccugaggaaaagcagagggucccucagcucaccugguaccuggcugucaggagcgcagcugccuggucuccugggcuucccucauggggaagagcaggcaccuggggaacagguggagcugagggaggagaaaggagccaagagugagagcagccccuccacagggcucccuuuucagaacacuucuccugcccaagguaugucuguugcauccuccuucacgucaguguuccaguaaagucaacauuuaccaggucucagguaugcccacuccuccuugggagcugcuccuacuuacacagacugaggacuguaauauggacuuuacuaggaaucgcacuuaauccucauggcaugacauuccuucuauagaagggcaagcauuauaccuguugugaugagcaaagcaaaacagacagacagacagacagcauuuccuggccagccuggguuacagagugaaaaauguggucucaaaaaccagaaacaagagcaaaaagaagccugaagacauagcucaguugguggagugcuugcuuggcaugcaugaugcucuggguuugauccccagcaccaucuagugggcaaggugucacacaacuguaaucucagcaccuagguggauauagaaggaucagaaguucagucaccaaggcauagcaguccaaugccaaccugcucuacauuaaggcucugaagaagaguugaaggggacuggguguggugguguaagccuuuaaugccagcacucaggagguggaagcagguggaucucuuugacuuuaaggccagacuggccuagcaaauuccaggacaaccagggcuaugcagagagacccaaacaacacaaaaaaguugaaggauuugaugauagggccagggucuucagcaaacuucugacauuuuuccagauaccauuuacuauaaacaucauucugccuucauguuauuauugggcacuauuucugcaagcuauugugugcggcuuguagaaacaaaaacagucauguuuccucacaauccuuuacacccuccaacaaugucccacacaguacccuccacauaaugguacuccaucuguguugcugacauacaaguuccuucaggcacuggugcugaucuauaagaacuacgacauaguucuuacauaauaaaaccagcagcuaaguaugaugcuguaugccuacauucccaauguagcuggggggccgagacaagauucauucaaaucaugggccgcauaguacuaggccagccagggcuaccuauacauuagcaggauccuauuucaaggggaggaaacacuuaccuauuuaauauauguaugugaauagauaguuaauaugauguaacaucugugcauguaaagagacacuguguucaaacaggaaauuaaaugguugcuuucuugaccaaaauuggauuauucacgaacacugaaguugcaaaagaauggcagguagcaaaucacacuagaucaccaggagaggaggcagacugaagagaacccagggaguccccgaggccugcguuagguaagcuagugagacauggcaaaagcagccuuuguuagaagucauucugguuguggugucugcagugaagcucauauucucaaggccagagcagggugaugggcggauuacagacaggcuagcuacccuaaccacagggcccaagccaaggacucacaccugccacgcccuuccaguucuuccacuaaggcccaccuucuuauucaagacccuggccucucucaugucaggccagggccccuuacuauucccauucuccuugaagaaaguguggucucugccuuacccccacugaaucccugcuccauguccguguccugcagaaaccgaagcucuggggaaagacauucagacugguucuccaaaggcuggaaguggccccugggugacucugcggcuucuugggauguuaccuccuccaucccuguucaggggacaaugaccaucacugcagggugagagugagaagaacugcuuaguaaguuaaaaugucccauaaucucauauucucaggacuuggcaaacuauucuauauaugauagacuuuguuaaaaagacauuuuuuuaaagcuaguguuucucugugcaacaaagcccuggcuguccuggaugcucuuugaagaccaggcuggccucagacucacagagacuugccuaaggguugggauuaaagaccagcaccaccacacucagcuaaaagcagacuuuaaaaaaaaaaaaaaaaaaccagccugaaggugguaguacaagccuuuaauuccagcacuggugaggcagaagcagguagacacgaguuuggagcuaaccugaucuacauuccaagacagccagugccucagaaagaaacccugucuagaaacccagccccacuagauuuuaguugucacaguccacagacuuaaguuucucuaaauguaauuaaguaaagugcaugguaauuagggcccaagaaggguuuaaaaccuaaaaaguuaccaaaauaaacaaaaagaaaaacacagaagcaggagaugccuguaauuuaaggguagaguacuuccuaguaugcacaaggcccuaccuucaauccauaacaaccucccccuucacaaaaaaacaaacaugaguaccauucgguuucaaaacuuaaaacccaaacaggaagguguaagaauucgauauuacucagacucuacugaacaaucccaaaucugugguuuaaaauauauguguguguguguguguguguguguguguaucgcugggcguguaaucccagcucucggaagauuuagacaggagguucagaaguucaagguuagccucaaagcugucuuuuaaaaacccaaaccaaaacaacaacaacaacaacaacaacaaaauagcuaccauuaaaagaauuuuuuucaacacaguacaacugcguaaaccuuuccauggagcguccuaaguaauuuagaggcucaagcugagacccagugaaacacgccagauaagauuacucauuguuuuucucaaaagcaggccccuuaggaaucaugugguaagcgguaaggccguucugcauuacucaaugggccccgaugaauaaugauacaacucacuuaggagacagacccuuagggcaggcuggucgagccaccugcgcgcagcacgagggagggcugcgaggagccugguguccuucagauccaaggacgagcccggguuccguccaccguccaccguccaccgcccuccgccaggcucccggcccguccgcaggccucgcccagagccacccuccgccuaccucucucuugggcaaagguucgguccccagagggcgaagcgggccacaagaccgagcugccacccgggcccggccacuggguucgcaccacggggccaccccggcuccccgggcuccgcgacgaacccgggaagaggggaaaacagggccgcgagcccggccuuccgcgcgccccagcuccgggaacagccgucagcccgcacgcggcgccuccugcgcguccgccccgcgggccaaacaagcggucgcucccacggcgacgcgacaacgguuccccgggacucacccagguggagaggcgggccuggagacugucccgucacggaggcgcuccucgcucagcugcaccagccuguccggggccacucucucgacugccagaaggcugacgccuuacgucacuu

SEQ ID NO: 2794 - RNA, 1766 nt, Mus musculus
cuucuggagccaggcgugguggugcacgccuuuaaucccagcacucgggaggcagaggcaggcggauuucugaguucgaggccagccugguuuacaaagugaguucuaggacagccagggcuacacagagaagcccugucucgaaaaacaaaacaaaaaaaccaaacaaaaaaccccaaaacaaaaacaaaacaaaacaaaacaaaacaaaaaaccaaacaacaaaaccaaaagaaaagaaaagaaaacaaaaaaacaaaacagucuucuggacggaucuucuuccuccaggucuagguucccuguugcccagguacgcugucugucuauucucaggccugugcucuccuacuacugcgaccaauauccugcuuaaguuccucuccugucuucuaucccuuuuauucucccucucuucuucuuugcgcuuuucccucucuuucuucuauuccucugucucucucuugugauacaccuuuucugccuccuugacuaaaucuuguaaaaccauggcauguaauccuucuagucucuguaacuuucucuuaauaucugaugcugauugcccuauaaaagccauagcaaccauggcuuguugacccucagaggucgggucaaaaggaguauagcgccuauaagcuuccaucaaucuuuccagaaaaauagacaggggcucgguagggcccugcaucaccucuuaccuuagccaaauugguggggcaucucgugcucccuuuaaacccgcgaccagagcccagcgguaaacugccaacuucucacuaccuugagccauguuguaguuccaaucuggcugguucagaaggaacccagcauuaaucucauuagguagguugguugagacccuauucacucugggaacauuuuuccaagccuccaggagaaugugcucuuuaacuucagugguaaacagaaccuggaggagcugcugacaaucaucucaaguggguuauuaagaaaacauaagagacucuaucagcccagucaggcuggccagauucucggaaaaggaggcaugguuagcuuugcaauuuuacaaaucagccgaugaaaaaggccaauauuguagggucugcagagauaguggguccaugggcaggucgcccacagcucaccaaggaaaagcagaaguggugucaggagcuccaucugcugggggacucugggcuccaggucccggccgcugguccuccagcugggccaccagcggucccaaggccgggugcagagaccugugcaggaaugggacccaguggggguagaagauagggcagauggggaggagauucuggccacucaggaggccccucaauauuaggauagaucuuggggggaacuguggguugaagaggaggcuccauuucagguggaaucuuugguuuugcucuuguuucaugaagagucagggcucaggagccugaccuacgcuggggaauccaugguuugauccaugauguuggauucuggacaagguccugccagacaguaauauaaggcuguugauccgggugggacccagguccacucugaaaaacaauggcuuuaacuucaaagauaagagucaaauuaaaaguccccucugguggcuauccuacaucaaaagccggccacuaggaggugcaaaaaucuaccaagguccuuucuuaauuucuacugaaagauuaugggcccuugaccuaacuucaguccaguggucuaaggucaaacuuagggggggcuuguuacagucugucccauuguccaaauca

SEQ ID NO: 2795 - RNA, 1766 nt, Mus musculus
ugauuuggacaaugggacagacuguaacaagcccccccuaaguuugaccuuagaccacuggacugaaguuaggucaagggcccauaaucuuucaguagaaauuaagaaaggaccuugguagauuuuugcaccuccuaguggccggcuuuugauguaggauagccaccagaggggacuuuuaauuugacucuuaucuuugaaguuaaagccauuguuuuucagaguggaccugggucccacccggaucaacagccuuauauuacugucuggcaggaccuuguccagaauccaacaucauggaucaaaccauggauuccccagcguaggucaggcuccugagcccugacucuucaugaaacaagagcaaaaccaaagauuccaccugaaauggagccuccucuucaacccacaguuccccccaagaucuauccuaauauugaggggccuccugaguggccagaaucuccuccccaucugcccuaucuucuacccccacugggucccauuccugcacaggucucugcacccggccuugggaccgcugguggcccagcuggaggaccagcggccgggaccuggagcccagagucccccagcagauggagcuccugacaccacuucugcuuuuccuuggugagcugugggcgaccugcccauggacccacuaucucugcagacccuacaauauuggccuuuuucaucggcugauuuguaaaauugcaaagcuaaccaugccuccuuuuccgagaaucuggccagccugacugggcugauagagucucuuauguuuucuuaauaacccacuugagaugauugucagcagcuccuccagguucuguuuaccacugaaguuaaagagcacauucuccuggaggcuuggaaaaauguucccagagugaauagggucucaaccaaccuaccuaaugagauuaaugcuggguuccuucugaaccagccagauuggaacuacaacauggcucaagguagugagaaguuggcaguuuaccgcugggcucuggucgcggguuuaaagggagcacgagaugccccaccaauuuggcuaagguaagaggugaugcagggcccuaccgagccccugucuauuuuucuggaaagauugauggaagcuuauaggcgcuauacuccuuuugacccgaccucugagggucaacaagccaugguugcuauggcuuuuauagggcaaucagcaucagauauuaagagaaaguuacagagacuagaaggauuacaugccaugguuuuacaagauuuagucaaggaggcagaaaagguguaucacaagagagagacagaggaauagaagaaagagagggaaaagcgcaaagaagaagagagggagaauaaaagggauagaagacaggagaggaacuuaagcaggauauuggucgcaguaguaggagagcacaggccugagaauagacagacagcguaccugggcaacagggaaccuagaccuggaggaagaagauccguccagaagacuguuuuguuuuuuuguuuucuuuucuuuucuuuugguuuuguuguuugguuuuuuguuuuguuuuguuuuguuuuguuuuuguuuugggguuuuuuguuugguuuuuuuguuuuguuuuucgagacagggcuucucuguguagcccuggcuguccuagaacucacuuuguaaaccaggcuggccucgaacucagaaauccgccugccucugccucccgagugcugggauuaaaggcgugcaccaccacgccuggcuccagaag

SEQ ID NO: 2796 - RNA, 11857 nt, Mus musculus
ccuccuucucggaccuccgagcuuccuagagaggaaccggacgucagcccuuuccauagggcaccugcuugacagcauccgccacccacuuccgguccgcgcaggccugggcaggugcuaagcgcgcagucaaggccccgggcaggccgggucggggcggggcuggacggagcaagcugcugcucggcggggcagcagcgggccaggggucguaggcuccacgcacagcggugaucucagguaagauccaugcgggucgcggucgggccaggcugggggccuaagguguccaggacccgcaggaagaccuugacccugggacuccgaaaagggacgcuaagcguuuuuagacgcagaugcaagacagggaugggaagaauagccacgcggcgccuucugucugccagaggccuggaagauccacgggggccgcuugccccagggcacuggcggaccgagcuagacaguagcagggacguucgagaaagcuggaugaagcagaacgaugaguguuagagguggaaagaugaggaaucaguuucacaggcggacagagaaauaccauauguaacauaaggacguggccugccgcacccuaguugcgcuaaugagcacagcgccuuacugcuuugggcuuggggccuguuuugucagcccgccugccccggaaguaaacaagacugauucugguuuuuuuuuuuuuuuuuacggucugcaucgcagccucuuuuuccuaggguguuauguuugcuacucaccugucauucuuuccucccuuucucuuuccuccuuccauccucuucugcucucccucuuuuccaguuucaucguacccagguuggcuuggaucucgccauccuccugccuuggccucucaggccacuaacgacaggccuguuacaucuuucuuuuuuucuagacagguuuucacuauguaucucugacugcccuggaacucacaauguagagcagguuggcuucaaacccauagagaucggccugccucuuauucccaauguugaaauuaaaggugugcaccaguacacucaacuuuuucuuucguccuuuuuuuuuugauauauguauauguguguguguguguacguacauguguauaauauauguguguguguguguguguguguauguguacguauauguauauagcugaguauaguggcccacaacuuuuuuuuuuaaauuuguuuauuuacuauauauaaguacacuguagcugucuuuagacacgccagaagaggguaucagaucuaauuacagaugguugugagccaccauguggcugcugggauuugaacucaggaccucuggaagagcagucagugcucuuaccugcugagccaucucuucagcccauauuuuuauuuuuaugugaugaguuuuuuuuuuuuuuuuuuccuuacugcauguaugucuguguacuguaugccuggaguccagaagaugcaauagauuuucuggaacuggaguuacagacuccagucuguaagcacacacauggugaagcaccaugugugugcugggaagugaaccuggguccucugcaaggacagcaagugcucuuuaauugcugagcugucucuccagccucaccuuucuuuuuagaccccaauguuuugggagggagucagcuauagcugccugcauauucuuucugucucuuuuuuuuccuaugggcuuggggccuguuuugacagccugccugcccuggaaguaaacgagacugauuuuacgguuugcauugccgccucuuuuucuucugguguaauauuugcuuccuuucugucauuccuucuucccuuucuccucccuccauccucuuuuccuuuccuguucuuccagcuuccagugucugacauuuuuguacaugcauaugcuaugucuugaguauauaugcccuaacucuccucucacaccccuccaagggacacucaaacaucuccucccauuuucacgaccucuuuuuucuuggucugagggcugauuuuacugguugauccuaugugggucuuguguaaauggcguggcugcagucaguucacaagugccauggcugugccguguccagaagauagcaucucacugaacucuuuuugccaucuucugacuccuggguucuuucuguccccccuugcacuauguuucccgagccuuugcuuugugugggguguugauaacagaugucccauuaagggcugagcucucaacaaucacucauucucagcacuuugaccaguuuugagucucugcauuagcugcaaguagacagaggcuucccuggccaaggcugagagcagcaccaaucuauagguguagacauaaauauuuagaagguggcuugacaucaugucuguuuuagaaauaccgcaguaguagguucucccuuaggcucauaaucucccuggcuaugggcuuuugagcagguuuacaaucccagguaugaauucccuccgugggcaugucuugucugucaggccauuccuuacuggagcacacaagugucacugcugggaaguacccaaaagugauggcuuuucuccuccaguggccugugcagcgccuuccagcacuaugaaaaccaguuaacauggaggaaaugccaggucaacuccagcuugauuuuuuuuuuuuuccuguguccaaauguauugugucuucugcaggguuuuaccaucucguuacgaugggcaaucaagagcagugcaguaaccuguauggcaugguauuuacccugaggacacugucauagucaagccacuaguguauuuguugguuucaaccuuaaaaauuugucuugauuuugucugcucuacugucaccacccugacugaucuaagcccaagccaguugauaggguuuucaugauagaugucagaauucucagacagucacugguguagacccggaaauggaugggcugaccuuccgugcaucuucucuucucagacgggucacccuuguugucauccucagccuugccggagcuugaagaugcugaaagagcgucuggagauggcaggagauccucagcagcagaugggugcuccaguggucaaacuggagaaggagcugccauggggcaggggaggggaggacucgagucccgaggcauuucgguugagguuucggcaguuccgcuaccaagaggcugcugguccccaggaagcccucagggagcuccaagagcucugucgccgguggcugaggccggagcugcacaccaaagagcagauccuggagcugcuggugcuggagcaguuccucaccauccugccccgagaguucuacaccuggauccgggaacacagcccagacagcggcaaggcucugguggccaugguggaggagcugauggggagcacggaggccaaggcggugggugagaagaggguguccaggccuuccucgguuggugugggaaucagagaugaagagguuaagaaaguggugggaauagaugagacaugggaccuccuccauugucccccaguucccagagguccuuuccuggagaguagcugcauuuuagcaagaagauucaggaguugaggagaggcucaguggguaagcacuuccuguacaagcaugaggcuuugggauuaaaucuccaggaccuauagacagggcacauaagguaguaugcacguguggucccagcagugagaccagcggcagagagaggagagcccuggaaacuugccggccagggagccaggcauacucagcaguguggucaccauaagguggaagaugagaaccaacacuggaaguuguccucugacuuccucacaugcucaguggcacauguacucacauguacucacauguacucacaugcacacacaccugcauaaacacacacucucacacccaccauauacacacuuaaguuaaagaaagccaucucuaggaacgaugucucugggcagcaaagccugauacugugguuugggcaucggggaccuggagugcgcugcaaauccagugaaggcagucgugcuugucuccaggcccccuauaagcgcugcaggcucuuggggaagaggcuaaaaaugcgugcuucugccagaggcugcugggagucaggcgcaaccaggcuguuccuuacuuacccuuagggaccuccacuuaggcagaagcaguuuguggcuucagcgguugcagaaaggaguugaggagcagagugggguguaucaaagacauguauuuuuagggcuggggagcuaguucagugggugagacgcaugagaacuagaguuugguuucccaguccccguguaaacaccgggugggggugggugcgugguccaccuguaaucccagcacuccggaagcugaguuggcauccgcugagggagcugccuagacagcugggugaagucagccaguuagaaaugccaggacaggccuugccuaaauauacaaggugcagaccaauagggaacacacuggcuucacacauugugcgcgacaugugcaugcaugugcacccacgcggaugugaacaugcaugcagcaugcauagguagugcauacaugcgcacauacaaaaaaagacaccuuuaaucccagcacuugggaggcagaggcaggcggauuucugaguucgaggccacccuggucuacacagugaguuccaggacagccagagcuacacagagaaacccugucucgaaaaaacaacaaacaaacagacauucuaauuuuuuuuuaaagcuacaaaaugguggcgcacgccuuuaaucucagcgcuuaggaguuuguaaaggcagacugaucucugaguuagaggccagcauggucuacagacugaguuuuggaacagccaggacuacacagacaagauuugucucuuaacaaagaaaaaaaaaucuuuuuaauuucuuaaaaaaugauguguauggguguuuugccuguauguagaucuguguaguauguguauacagugccucuggaguccagagccccuggaacuggaguuauagguaguuauuaacugccaucugggugcugggaauugagccagggaccucugaaagagcaaccagugcucuuaacacugagcuaucucuuuagcccuuaaauaugaaacuggcagcaaaaucccacuuucuguggagcagcuauuucucauuagcuaguucauuuugggguuugcggcuuuuacuuugggcuucuguaacugaaggugcuuuccagcagugaguugcuaaagaacccugggauacuguucacuggacuuggagauguugaggcugguggagggaugguugucccauggcauggacugguacaaaaguugcucagggccuuguaaagggagagcuuaaugggcuggagagauggcucagugguuaagagcucugacugcucuuccagagguccugaguucaaaucccagcaaccacaugguggcucacaaccaucuguaauaggaucuaacgcccucuucuggugugucugaagacugcuaccguguacucauauauauaaaauaaauacaucuuaaaaaaaaaaagagagagagcaagcuuagcuuuuccuucuucucuccucccucccuuucucucccugucuuccuuuuucuauccuuuuuuuggaaaggggaucuacuauuguaguccugcuuggacaguagcucacuaauuaggccaggcugguuuugaacuccgaaagauccugcugccccuacugggugcuaggauuacaggcuuggaccaccacacuggguuuacguggcacugggcuggaacccagggcuccagggcuucaugcaugcuaggcaagcgcucuaccaacugagucccacccccagccuugcuuucuuuucaguuuucauucagcucucuuuuuaauagccuccagcaggucucauucuaauugguauggggauucuccuuagguuccaugccaugcccagggagagcagcuggucacagcccuuggcggagcaucguggcaaucaggcauccaccuggggccgguagaagucaaaccugagugggggauaccccagggggaaggaguucagagccuaggcccaagcaccacagaacagcugagccagggcccuggagaugggacacaggccuuccaggaacaagguaagacucagagaaugaagaugugugaagaugugggucucuuccacccaccauucuuucagaaacucacugcugggcuaaguaguuaugggcaagaugcaaucaauucugaguuuuaugggcuaccuccucugccccaguagaaagcagaugaagguuuuuguuuguuuguuuguuuguuuuuguuuuuauuuuucgagacaggguuucucuguauagcccugguuguccuggaacucacuuuguagaccaggcuggccucgaacucagaaauccuccugucucugccuccugagugcugggauuaaagguaugcgccaccacacccagcuauuuuuuuuuuuuuuucuuucuuacaccuugaccaguuuucugggguaugucuagaaccguguucuccuaucauuucuucuuccuucuccucacauccuucuagagccucuaggcacugugcuggugauagggagauuuaucuauuaaaugggaaaacaaaccacacccaccagagagagagagagagagagagagagagagagcgagaacgagaacugucauuaugagagacucaggagugugccuaagagaacgagaacugucauuaugagagacucaggagugugccuaacucugaggggacagggcugggacagucuuaggcagaacuccuggcugugggucacugugguacugauguauuucucuguggucuguggguccuaagguggugugucugaguggggugccuuugagcugccagacaacugcccugaucccucuguggguuuuguuuccgcccagcauugcccauucuucauguggguccagggcuucccucugugagugccagagaccaagagauggcugcuggauuccuugcagccacgucccaggugagcugacauaccuguuuggagauuuuauuuauuuauuuuggauuugcauguguucagccacugcauaugugggagucagggcagcucugugugauuguuucucugcuucugccuuuauguguguucuggggaauagagccuggauugucaggcuuuaccuacagccuaaagguggggcuugaggagggagugcaggugacauuuggaugcugagguggugggggcuagcagaaccauagucucauggucugagcaugucagucaccugcguuaaagcuguugggagauggcaguugugcucccagcucauccaggguccaguuccuucugucuuugcuuugccugagccucucuuugaugcuacugguagauuaucccaccuugcuuugaaaauguauuuaguguaugugaggugggguauuccacagugcucucgcagaggucagaggacaguuggcuggaguuaguucucuccuuauaccauuuuguuucuagggauugcacuggggucaucuggcuuagcagcaaguaguuuaguccuuuaacugagccauuucaccaacccuaggauucuuacuuuuuucuuuuaauuuauuuuuauuuuuuauguguaugaauguuuugucugcauguauguauguauguguaccacauguuugccuggugcacucaauuauccagacaauggcauuggauccccuggaacuggaguuauaggcaguuauuagcugcccuguguguguguguguguguguguguguguguguguguguguguguguguggugggagcugaacauggguccucuacaagaguggugagugcucuuaguggcugagccaucucuagcucccagggcucuuucuugacagcaaucuccuguuguuucagggucuggggccauuuaaagacaugacuuuggguuuuccugaggaggaauggaggcauguagccccagcucagauugacugcuuuggagaauacguggacucacaggauugugggguccuuccagguaagacuuugcuggccaaggugagggagaggaguuugguagcugcagcuuaagagucuugcccuagccguggugcugcugacagaacagggugggcauguggagucuuggagaagcuggcuugguuuguacauggccuaaccacaggaaguaggauggagcaagcaaacacaaggcggugacuggcggugacaggcagguuguugaugccaaggcaguggcugugugcccauggcugaagggcauggagggcugcagagaaaggaaggagcagaagaggaguguggaucugggcaucccugcaugcaggcccgaaggagcagcuuugcuuugggacagggugggaguguggcugugcuggaugggagaaugcagugugccugcacgugugugccugcacguguguggacaacuguagguagagugagugagggcugacugaugaugucagaggguuaguaaggagaugaucuggauagaaaucaccaaguugcauuuguguauguguguugucugugcacacacauauauggcugcacacaucugugcucacgcccagaggaaagaagaggguaucaggcauuucccuuugucacuuggccucauuccuuugaggcaggagcucucugacaguccuagugaucuuucugucuccaccacccacagugcugguguuaaagucaugcgugagaccacacuaggcuugaucugugcaugccgggaucugaacucaggucuggugguugcacaagugcucuuaaccacugagccaucucuccagcccuacugaguuagauuuugaaggaaguaaaagucugaauuagcaggacauucagugggaugguaugaaaaucugucaugccguucagcaucaggacagggagguggugagaguaaagaaaggucagcguucagggcucauggaagucaaagguguugagguuguuaaccaaaggaaaagaagaggcgccauugaugggacauacuaagaagcuggguaugauuauauaggccucauucaggauugcaugagucugagggcagccugguuuacagagugagacucuauuccuaaaagccaagaucccaccaccaccaccaagauaaagggaugcauuuguaggcaaaguccuaggacaacaaguuccuuagguggccagugauagaaagagaggagcugguuuucagacaugcucugcuagcaggaccacagugucccagugggagagugcaccuuuagaggggggggggguggcauuaaaggagccauagauagcauacuagugaaguguaggucguaucauaaccauaggcagccugaaggucuugagaggagagauagcagccgauaggucuuucagauccccagaaagaagucacuuucuguuuuaugaagguuuuggggauguggugguaaguuuauauugugccuccuagccuaaccuaguucacauggucccugacaugcaggaagcccuggguaaggguuaauaagaggacuuugguucuaccugccuccaugccuguggaaggaguuaggcuugcucacaucugcaagugggagagaauuaggggcuauaaggucagacagugcucuagaguggugguccucaacuuguggguuugaaguugagaaucagauauccuucauaucagauauuuauuuacauuacgauuuguaacagcaaaauuacaguucugaaggaucaaugaaauaaguuuguggcuaggggucaccauacauuaggaacuggguuaaagggcacagcaguaggaagguugagaaccacugucccagagcuggcagagaaacagguacagacugggguggugccugguuucugggcaugaagagcagcaauuggaggugugaugggacaucaccacaguguuaaccugcuuugucacacaggugcugggagcaaggagaaggaggcuaagccccagcaggaagaccugaagagagcauuuguuggguugacuuccgauggcuuuggagaagccgacauccagauuccuggaccagggggcaccugugagcaggagccugggagcucugggaccagucugccugggcuuccugcuccucagcaugggguaccccugccugacacccucaacacccacaauucuuucuggaagccuuuccagugcccugaguguggaaaaggcuuuagucggagcuccaaccuuguuaggcaccagcggacccaugaagaagaaaaauccuuuggcuguguggagugugggaaagguuucacccugagggaauaccucaccaagcaucagaggacccaccugggcaagaggcccuauguguguggcgagugcuggaagaccuucagccagaggcaucaccuggaggugcaccagcguagccacacuggggagaagcccuacaagugcucagacugcuggaagggcuucagccggaggcagcaucugcuggugcaucgcaggacgcacacaggggagaagcccuacaccugcgaguguggcaagaguuucagccggaacgccaaccuggcagugcaccggcgugcccauacuggggagaagcccuauggcugccaggugugcggcaagcgcuucagcaagggggagcgacuggugcgacaccagaggauccacacuggugagaagcccuaucacugcccagccugcggccgcagcuucaaccagagguccauccucaaccgucaucagaagacccagcaucgccaggagccuccggugcagugagccuacuaagggaacagcucugccauaggagcgacuuguguugcaccgaguggucugggcagugcccagugagggacagcagaacgugcucaaguaggaggagggcagagccuggaguauguaggggaagcuggcagaaggcccacaguuucccucaccucuuacagggaaacacuauccugagcuucagguuuucuuauccuuccucccacaguggggaugugaacccaccuccugagcaaguuuagaggaaaaggcagaauuuuauugcaaauaggcagcuugaagcuuguuuucuucuuucuuuccccucccucccccucccucccccucccuccccccucccucccucccucucucccuucuuccuucccucucucucccuuuuccguuuuuucucuuuuuuuuugagcuaaggucucauauuaucuaagcuuguuucagacuaccuguguagcuaaagaugaucuugaacgccugauucuccuguuuccaccgucccagugcugugauugcaggaaugugccaccaugccugguuuauguuauguuggagaugaaauccaggguuugugcaugcuaggugagguacucuacugacugagggauguucccagccuugaagcucuucuugucugugagaucauuagcccaggcaacccucccuccagcugucuuucauuuacaaauauuuauuaaacaucuacugugcuccuggcucucagaaugccuugggaauggaaccaaugauaccguggagugugugagcaaagcuggaacagagcuuguaaguaucccaaagcacguguuguugcaagugccacaccagaacuucugcacacuccguccugggccagccuguccugugugggcccucacauacucuccaccucaggaggggacuucucucauaaagccucguuuaugucacuuucuuggcagccuuauugucauggacuggaacauucuacucucaucuguaaagccuucccaucucauuauuccuugcacuaaccacagccacuaggaaauuaauauuuugcuacugaucacugaauaaacgugaaaauauuuuaagacaauuag

SEQ ID NO: 2797 - RNA, 2376 nt, Mus musculus
ugcuaggagcucuguaagcuuaaggcagacgaaccagugaaucaaacagggacugucccugggcuuagggcugggaagacagcuuagugguuaagagaguuucuguuccagcaguaacgacgcugcaacaggauccuucugcacacguuuauugggagagcuugauugcagaggcgaagagaccccgagcccagaacuggugcugcuuauauaggccuaggagaggcgugucucacacccggauugguuaugcacuaagccucauuugcauguuccucaucugauuggcuacucucuuuguaccucacagagccucauuaucauaccuuauuugcaugucucacaucugauugguuauacucccaaagccucauuaucaugcccgagccaggcagugucuuugcaaaaaacuuuacugcauauguacacauugguuuuuuguccaaacuuaugcaugguggccagcaguagucagugccacugugcaaaggcacauguggcuucccacagguuaggugguggcagcucacaccagguuguaacugcaccuccaggggaucugacacacucuucuaggcuucugucuucuggccccuuuggucaccuucacucaccuauacacaaaccucuuauaaauaugaacaugagcaaaaaguguugcaggcuggagaguucggccauuaugacuggacauuguucuugcagaagaccugaguuugauucccugcucccacaccgaaugacuuaaaacuucuguaacuccagcucuaggggaucagacacgcucuucuuuccucugcacacaaaugcauacccagggagagacaugcguacauguaaauaacauuuuaaagaaaucccugagcuuguaggagucacaucuuagugaaugaacuugaucuucagauuccucuaagucugagggguuuucauuuguuuguuguauuuuuaagauagggucuuacuauguagcccagacuugccucuaucucagagaucuacccaccuuugcuccccaagugcugggauuaagguugggguuuaagcccugucagcuucuugcccugaguuauauuuaccacccaucuuacaauacugauuuuggacucuugucaucugagacauucagggaccugaauaccagccauucuaguuucauuucuguuucugugcucaaaugacuugaccaggaaaaaaaaaaaaaaaaaaaaaaaaaaaaaaaaaaaaaccuuaagggaaaaaggauuuauuuuagcucauagcuccaggucacagucaguuacucuggggcagucacaggaggagcugcucacaggcaguuugggucccagcuccauggugaguggcucacaaugaccucuaacuacagcagaccugaugccuacucuuuauuaagauuuguaaaaauuguguguguguuuguguauacaugugugcucaugcauccuaucagguacucacaaaggccaugugugugagggcuaggaaaauuaagauaccuguguaaaaugcuguuuauuacagcauuaaaaacagauuucuuuaaaaaugauaaucuggggcuaagaauguggcccagcagggaaaauguuugcugugcaggcuuggagauugggguucagaccccuagcacccuacauaagagcccauugggcauggcugcucugccucuuaucccaguuugugggaggugggaacuuagguugggucuccagagcaaucuggcuagccagauuaagauagcuagcucuggguuuaucaagagguccuccuugguauguaaugugaauagagagaggaagacauccaauaucaaccuugggucuccacaugcacacaggugaaagaacacccagacaccacaaacauaugcaaauuaaccuacugguaggaaaggauuuugcugcuguuaaauuauuugaauuuuauuuuuacgcgcguguguguguguguguguguguguguguguguguguauguguaugugugugcucgcgcacauaaauguuuaccaggauguaagaguaguggucagaggacaguuuucaggaaucagagugaguucaauacccagaacuuauugaucauuaggcuugguggcaagcaccucuaccugcugagcuguuuuucuggcccuugcuguucaaacaugugugaacuauaaauggcauggauauuccuugugccauggcuuugaacgugggcugcuggggaagugucuugucaaggugugcuguuacaauuucaagcuguguuuuuuuucccucaggguaccuccugauaucuuuuuacugagacuuguuuuuccaguuuguuuuguaaaugagauaaguaggggcgaggaagauggcuaagucauuaaaguauuugcugugca

SEQ ID NO: 2798 - RNA, 431 nt, Mus musculus
gaugguuuacaucucgaauggccagguguuggacagcaggaaucauuccccauggagagugucuuuccuaacagacuucuucugggggaauagcagaauuugugguuuucuuuuucaaaacucugcuucagcaagaugugaagaaaagaagaggcuacaagagcuccucugauuccagauacgaugauggaagcaggccaccaggaaacccuccaagaagaauggauagggucagucaccuucguggccccagcccuccuccaauggcugguggaugagaaagguaaaugucugcucugagaagcagacaacuagaaauacacacguguagaaggaagccaucaaguggugaagaguggcucaugcaggagaaguugguguauguccaaagaaggauugcucuguguccucacagaugaaugaggucaugc

SEQ ID NO: 2799 - RNA, 1541 nt, Mus musculus
aggacuuguagaaugaaucucucuuuccauuuuauuuacgugugugugugugugugugugauuuuauuagauuuauuagaaugacuuacaggcuuuggucuagcuaauccaacaauggcuggcugugaacagaaaguccaagagucuagucuacaaggcugggugucucagcuggucccagaguggacuccaaugacaguaaaggaauagacuugcuagcaaggaaaggacaaaggucaaaaacuuccuccuucuacauccuucucuuggcuuccagcaggaggaguggcccagauuacauaggcaccuuccugcuucaacauccagauuaaagaugcgucuuuucccugcuccaaagaccuggauuaaagccguguuuuccuaccucaaagaucuggaucagaaguggucuuccuacuucaaauuaagcaaaauauccaaaaauaaaauaaaauguguucuugucuugaaguagaaagauuguaaaagcuggaagcuggggaguaacaccauccucuggacauggacagcugucaugcucucaaacucacaggagcuacgcaagaucaagucaaccaaaguucccccaaagauaugggaguuguccuccaggucccaccccuuccugagaacuguuggcaguugguagcugcaagggaaggaagagccauucugcugcugugcuguggccacugaggaguuuccuguguuucaguggauggcucuacacugauacacacgagggcagcacugagggcuuagaguccuauuaaacaccaccaagucaugaagggaugucuugagcacuuggccuggcaugauggauuauuccacuaaaauaugagucagaauaaaccacuccuugaguuauuuuugucagguauuuuugccacagaaaccaggacaaauacccuagcuguuaguaaaauaugacagaauuuuuccuucaaggaaaaaaaaauaugauucuggugaaaccaaacagguaggaagugguugaauguuuguccugcaaaugcuucauuguaguggaggagcaggcagacauauacagggucucuggacuuccccuaaacucugcugcaaccagaaaacacaaagucgucuuuagcaaucaaaaucgaacagauggugcaaggccucaugaagccacauaccagggccccaaguggacauggaugacagcucggaacgcaaaguaacuaaucagaagaagaaaauaauagaauacaaaagaccacgcugcugggaacaaaugaauaagauucaaaacuucuuaugcuagguaaugacuagaaauacgaaauaaauacaagaauuuaaacgucauucuaugggcuggagagagagcaguuaagaguacugacugcucuuccagagguccugaguucaauucccagcaacuacaugguggcuuauaaccaucuguaaugggauccaaugaccucuucugguguggcugaagagugcaacaguguacucacauauauagaauaaauagaucuuuuaaaaaauaaaauaaaagucauucuauagcuaac

SEQ ID NO: 2800 - RNA, 12365 nt, Mus musculus
cgguccugaagccgccacgggcucugagugccuugacccgagcccgcgacagccggaccugcgcacagcagaugcggaacucgggcgccgcggcucggcuuccggggagcgccguuuccagacgcaccggcagggucgcugcagacgguggccagucuuaguucuccgaggcggugcgagaaggccggagaucggacgcuccucucuuagcuuucucuccgccaggucgacuccgagcagcaacacagacucugagcuucgcgccucaggggaagauuagagggcguagcggccuucgaaggcucggccaagaaccuuccgcccccucgccgccucggugagaacaaccgcgggucaucgcgcuggagguggggucggggggagggggcguuggguacacggggcgggggaagggucauuuggugagucucacuacuacuuccgggagacgccucggagaggaggacgugcuagggggcgggguuccgaggggagagacacuuaccucuuauccgauuggcuuauugcuugcugguugagcuuugcuaguugcugauuggccggccccaaagccaaauccaggucgcaggggaagcguuacuugaggcuagauugaggugagauuggucggguuccugaguccaguucguuuacuggaguagggacuucaucuuaacccuagucgggggccucgauuaacaggauaaggaaaagaaccaguagcgggauggugggggcgguugacaacgaagugaaggcuuagaacuaaacuaacuuccucaccuaacccuagcuacacccagaugggaacgugauacgguacgaaggccuuugagaaaggaggaggcgcaauccucggagcggugacaguguaggaggagagaccuucugggagguuuuuuuuuuuuuuuuguuaucuaauuguaugagucucuaauuaccuagaugaugguauaacagaaccuucuggagaauuuagcucuggcuuugcagaggagucgggagacuacuggguguuccgggacuucaaagaggcaguuugcugaauaauacaacuuuuguuuuuauucagaugagcagcucucaaaagaggcacaaacaucagaagcauggauacagucucaucuguuagaagaauguucaaaggaaaauaagguauucauuuugccuuacuuaugcuuaguuaauccaagaauauugccuuggaggagaagaucucugguuuuuuaauauuuuaaagaacuugacuuuuuuugucauuagauuuccacuuauuaaacaucuguuucaaaaaucaaguuucuaagcugggcgugguggugcacgccuuuaaucccagcacuugggaggcagaagcaggcggauuucugaguucgaggccagccuggucuacagaguguguuccaggacagccagggauauacagagaaacccugucucgaaacaccccccccacccaaaaaaaaaaaaccaaguuucugcugugaccaccaaaaaugcacuuugcuaauaguuacugauugcagugcaaauggaaauccuuuacuuuuugauauuauuaauuaaauuaacaucugagugaaucuugcuccccccaaggggucucauaugugugugugugugugugugugugugcgcgcacacacacacacauucuugaauguucuagaauucacucuguagaccaggcugcucuggagcacacagagauuagucugccucucuccugagugcuaggaaugaagacauguguuacuacaccuaguuuagugguugguuuuguguguuaacuugacacaagccagagucaucacagagaaaagagccucaguugaggaaaugccuccaugagauccagcuguaaggcauuuucucaguuaguggcccagccacuaucuguaaguggugcuucccugggcagguagccuugaguucuauaagaaaacaggcagagcaagccaguaaucagcaccccuccauggccucuguaucagcuccucccuccaaguucuugcccuguuugaguuccuguccugacuucuuccagugaugggaguguaaauaaacccuuuccuccccaacuugguuuuugguugugguguuucaucggaggaauagaaacccuaagacaacuaacuagcauugcauuuuaaaauuaggaggguuguuuguuuuuguuuguuugcauuuuuuauuugguuuuugguuuugcagacaagguuucacuguagaccagacuggucuuggacucaggauucuccugcgucugcuuccugaaugcuggaauuaaaggugugcgcuaccacccgccugccuaguuuauuuauuuauuuuauuuuauucauuuauuuauuuauuuuuggcuuuucaggacaggguuucucuguguaucccuggcuguccuggaacucacucuguagacuaggcuggccucgaacucagaaaucugccucucaaguacugggauuaaagacgugugccaccuccgccuggcuuuauuuauuuauuuauuuuaaaugcauccacuagucaaaugcaugugucaagucuuacaauaaagaacucaacauauaaacaacaacaaaacaacuuuuaggagcuaguaggucuaggccuuugcuuuaaaaguuaucaccaagucagacacaauucaacacauauaucucauaucugaguauuaaauugaucaucuucuuaaaauuuaucuuugucucucgaaauugugucuaaaagcauucaucauguuaaaauuuuaggcuugaauaauacauguucuugauguacagagggcucccucgugcauccugggacaguuaggaguacagcccacugucuuugugauguacagagggcuccauugugcaucccaggauaguuaggaguacagucuaccgucuuuguagaugaugauguccuguacuccuuccagaaaagauggugaauagaaaaugaccaccacugucucacugcaauuuauugagaugaaaauaauuuuugccuacugugucuacugaagacucaaaguugaugucucugagacugaaaaccaacaggaaacaacacacugugcauggcucugaggauugagaaaacacacaagagcucuggcugucuguaucaggccauccuucaguguggaaugguuagccucgggaguuucugguugugggggcuacauuugagugcuauccucgaagcagacuuucugccuuggugaggagacgaggagagggaacacugcuucuuagaaucuuagaauaucaguucaguaagucucuaaaggcaguggugaaucacagaugaagagauuguuaguggccuacaucgugaguucugggccagccaggauuacauaguaagagcuuaccucaauaaaccaacagccaaaucaaaacaaaaaaaguaggaagcauguuagcucaugacugaugcauugacuuugugcauguucuuuaaacaggaaacuagaagucucaggauggauccgucuagaucuagaucaggugggaguggagaagagagcucauuucaagaaaaugagagaagauggcagcaagaacgucuccacagagaagaagccuauuaucaguuuauuaaugagcucagugaugaagauuaucggcuaaugagagaccauaaucuuuuaggcaccccugguaagaaaugggcaaagggggaaauuuuucuaucauugaaaggagggauuuaaaguaaagagagugccucccuuugaguacuguuuugugagucugagaauuaugcaguauaacaaaaucacugcccucuguguuugauaaauacaugagaauacugaauauauagacacacacacacaggccaaacuuauaaagccaguguacauaagcauuaaguguuacacgcauaauucucacccuccacugccaacccucacuuggauugaaaccuaggguuuugugcauguuagggaaguguucugccacuaaacuagacucuagcucucuauuucucuuacauaauauuuguacaaagaaacuguuauuugaaacuuaauucuuaacuuauuugaaguguuaacauucagcuagauugugaccaaccaaaaguccaauguagucuauacauuuccuuucagauuuacuuuauaggaaacgagcugaaauaugccugucuguguguuuguauauuuguauguugguggcucacauaauaaaauauugugguagaauucaagcaccaagauuugaacauuucccuaaaauuacucccuaauuuucuuuuaaacuuaaacucgaugugaguacaucucauccuuuuguuguuguuuucaaauuaguuuuauuuuuugcuguuugucucugguggggggggggggguuguguccaugagguuaagguccaaggaggccagcagaggcuguagggucccaggcccucaggucuccuggagcugacauugagccccucagucugggugcuggaaacugcugagccaucacuccagcccuaacuuacagguucuuacuuagagguucugguaaccaaaauuauucaaguuuagaucucaauuuuaaugaaauauuaauaaaugacaugugacuaaauugauguguauuuguaucaaauauuuuauuuaauuuuuuuaguuuuuuaaauuuauuuauuuuauguaugugaguacaccauugcucucuucagacacaccagaagagggcaucagaucccauuacagaugguugugagccaccaugugguugcugggaauugaacucaggaccucuggaagagcaguuggugcuccuaaccgcugagccaucucuccagcccuguaucaaauauuauuaacuucaauuuuuuccaaagauuuauuuauuuauuauaugugaguacacuguagcugucuucagacacuccagaagagggagucagaucucauuacggaugguugugagccaccaugggguugcuguuaacuuagauuuauaaaccaugaaaauaauaaagaucauccucuguaaguuaagauuuuuuaaauuacauuuuauuuaguguguguguaugugugugugagagagugugugugugugugagagagagagagugugagggugugugugagugugugugugaguguguguguguuugugugugagugugugugugugacugacaaugaguacuuagaugcuacagaacaaccauagguaucuuuucucuccuacuaugugguucuuggaauucagguugucaggcuuaguaguaagugccuuuaccugcugagccaucucacugaccccaguugcuaaaguuuuuauuucacagguucucauaaagcuugguaauuuauuuauuuauuuuuuaaaugagugcucuuuuguuguuucaggagaaauaacaucagaggagcugcagcagcgcuuagagagagcaaaggaacagcuggcaucucagccuggcucugacagcgcggcaagugauggagguaguguggccugcacugcugcaggaggccuguucacuguuuccauguguucuucauuagauaacaagugugcuaagaacagucugcuuagggguuagagagcagagaaaaaguugagaaguguuucuuauacauaguuucucuucaucaaguuuauguguacagaauaguagaagcccaacuuugggacgccucuuucuguucuaccuccucucccagagacauucaucuuuaauuagguuguuaccagucugcugacugaagggucuuuugcucuaccugcauagaaacugugagugguucccagcuucucggggagacaacuaaugugauuuuaacauuaaauucagaaagugagauuucuuaagagaucaccuuccugaagccuuucugccccuaguauucaccgucucugcauacauuuuaccugugugcuaucguacacccucuuguuggcucucucccuucacccacccaucagcucuuuccagucucuugcucuuggguccuucaagguaaacacacacaacuaaagagaggaggacccguuucucugguucaauggauuguucccuuuaaguuuaugacaaaggcuuacauuccguguuuacaacccagccguacucaaguaaagccugagugagaccccuggguuauaaaauaaaagcaggacagaguaagagaaauaaugggagacuuggauuaucccucaguuauggacacuugcugccuguuacuuuagaugugaagacaagucauuagacuugccaucccuuugauugcccuaggguagaacauaaccauuuucaguuuguguuuuaguucuuccugucugucuucauaagagaguuugggugucucaauucccuuucuguccauggagcacuuugaauuuagcauugguguucuccuuccaaggucugcuagaauucuguaccgagucccucuaguccugggauggggcgggggagguugguugguuguuuuguuuauaaauuuuuuuuuuaauuuuuaguugagagauuuuuuguuuguuuguuuuuuguuuuuugagacaggguuucucuguauagccccggcuguccuggaacucacucuguagaccaggcuggccuggaacucagaaauccaagugcugggauuaaauuacuucuagcucacugcuaguuacauaucaguguaaauuauuuauuuuaucuuauguuuuuuucaugcccauuaauuguuaauauuauguuuagccucuacgagguuuguauuuucccagcuuuauuuuguaauacauaacaugggauguuguuucaaucuucuguauucacuaaggcuugcuguguguccuacuaugugcucuauuuuguacagaguacagugagcuacuaaggaauauguauucuuuuaagguuugguggaauuucccauagauaucuguuagguccguuugauuuaugauguuauuuaauaccagugucuguuuauauuuugucuggaugaccugcuuguacauaggagcacauuauuaaagccucccauuauugcuguguuggguuaaucuguagcuuuacauuuuuuaaaagguuuauuuacuuauuuauuuuauguauaugaguacaccaugcucucuuaagacacaccagaagagggcaucagaucccauuacagauggcugugagccaccaugugguugcuaggaauuaaacucaggaccucuggaagagcagucggugcuuuuaaccacugagccaucucuuucuuuuauaugcuuggccacaucucuguuugauguauguguuuagaauuguaauaccugcuugguagauuaaagaggguggugugaccuucuuuuuuuuuuuuuuuuuuuuuuuuuugagacaggguuucucuguguagccccagcuguccuggaacucacucuacugggcuggccucgacuucagaaauccaccugccucugcuucccaaguguugggauuaaaagugugcaccuccacuacccagcaauuuugucaaaugcuaaaauaguuacauaucugcuuguuucuaucuuguaugugcccagaguacuuuuccaucuuuuuacccuauggagaugucuauucucaugguuaggcauguuucucagaggcagcaaaaagguggauccuguuuucuaaucuucauagagugaacugagauccauuuguugaaagauaaauauuaauuuuuguccuuacggugaauuuuuagugguaaauaccuuuugauauccugguaucauuuaucgccuguggaauguguuuauccuucucuucagucugaaauauucuuucuacuauccucucuagagcuggcuugguggucacaaauuauuuuaaucuguuuuuaucaugggacauuuuuauuuuucguuuauugaacaguuuugcuggguauaauauucuggcuguaugacuuuucagaacuuggguaaugucuuucugagacuuaauccagggacuugacuacugugauaggccugccugugacuugggccuucucucuucacagcuucaacacccuuuccucagccuucucuuuuccugcuuuaacuggaauguguugugucacuccuuuuuuugcccuuguuguuuaagggugucucucaagauuuggggaauacugcugggcuuggugguacacgccuuuaaucccagcacuugggaggcagaggcagguggaucucugaguuugaggccagccuggucuacagagugaauuccaggauagccaaggcuacacagagaaacccugucucgaaagaaaaaaaauugggaauuuuucuccugugauuuuauuggaaagguuuucuaugcuuuugacuuggaauucauuucuucucccccacccccacccucacugucuguaauuuauaguuucaauuucuaugaugguuuccaaagauccuacaagucugcucaugcuuuuuuuuuuuauuuuucguuucuaguuuucuuugagugggugguccaauuccucuacccugccuucaaguccugauauuaccguagucuuguccaaaugaucuacucugauugugaggcuucccaccgagcuuuuauuuaacuaccucuucauugccagcuucauuucagauuagauuuuguuuacucuucugucucuuuuuuagauucuauucuccuuuguuucauuuagcugugugauugugucuucuggggcuucuguuuauuccugcugcuaccaguucauucaaguauuuaucauuguccucuugaaauucuuuuuguuuuguuuuguuuuuuuucaagacauuaucucuuuaaaaucuuugaacucuuugauuguguuuaauucuuuagacauuugugccugaaaaugguucuccuuggaaccauugcacugaugggcuucccaggaguuuugugugguuuuggguuuuguugugguuguuuuguuuuguuuuuguuuuuuuuagcagacauugucuauauauauaucgcuuauuuuugcaaugaccccugagcaucuggaauuagguuguuagaugugucuuguuguguguuuucaguacccaaggccagaaucacaaguuggucugagugcccaagggaguucugaggggguagagcagaagggaagagguuccucacuacauccccuguggaccagccacagggauggagauagcugguggggguucugaaaguaggggagggguggagccagguugacaaagguugccuuaccaaguuggggcugcagagugagacagauggccacagggagaauugcuuuauggggccccacaagucugggcugcaccuuguggagggaguccugauaaaguuccugucuagaaaguagauugugugugugugugugugugugugugugugugugugugaagacaauuuguguacaaggcaguucuuccaccacagaagaacuggguccugggaauccaacucaugaugguuaggcuuggcaguguguguccugucauaggcccagcaauuuaauuuuuguugugugcuuuuaauaaacuuuuagaaaguuugauuuuuuuuuauucauuaaaauaaugcagagccugaguuuaacucagcacaacugucuuccuugaauguuuuaauaaagaucugaagucuugcuauagaacuugaccuuaaauuguuuugauucacguuccagacucagaaagccuuagagcacauucagaugaggacucucugcugcgauggcugaauaccuuucggcgcacugggaaugugacucgaagcggacagaaugggaaccaaagcuggagggccgugagucgaacaaacccgaacaguggcgaguucggguuuagccuggaaauccacauaaacccugacaacagagguucugaaaugcauggagaggacucgacggacaucccucugucagguguuaacagagagcauaggcagcaaagaccaucgaguccuguggcuaggcgaaccagaagccagaccuccaugagcuccagugguccuaggggcaggcguggugcgaggaggcaggguucugugcaagggucauuugcaacucugggaagguuaaggaauggaauuggaguagcccuugguguucccagaguuagugccccucgcacuaauguuauuaauucccacaccaaccagucagaugguaguacucucaggcaagguggacggcagcgguuuggagcagcacauauuugggaaaacggggcuagaaguaauguuacagugaggaacacaaaccaaagauuagagccaauaagauuacguccugcuuucaguagucgaagccggucccccauucagagacagaaugguacuguucaucauaauucccaaaggcaggguagaccaguacagcaaacggguagaaacaggucuguuaggcacagagguguaacgcgggucuuuuuagaacaagguagagaacacagaggcacugauuacaccccgcuguccaacucaagacuugugucaagaauaacaguagaagagggagagucuagcagguccucagcugccacccagcgucauccagcaaucacacuggaccugcaagucaggaggauucggccuggagaaacuagagauagggauagcauugcaaauagaacccgaucuagggcggggcuggcagaaaguacgguugagagcaccagugggggcuuccacagaacuaucucucacuuagagcgcucagguguccgaaccuacgugagcaccaucacaguuccucuucgcaggauuucugagaaugacguggucgagccauccuccguggcucuucggucaauuuuaaggcagaucaugacuggguuuggagagcugaguucucuaauggagguggagccugcgucagagaaucaaagcaauggccaacguuuaccagagguguaccuagaacugaguaauggagaugcagccgaugacaguggucagcauggaagagcguccucacaggccagucaggcccaggacggugcugaaaugcuagcugugagggagcccgccccgccccaggcucgccccaguggcaguagaaguagaaggcaguuaggaagggcggacagcguaguugaggcuggaacauuacccauucugcgccuugcucacuucuucuuacugaaugaaggcgaugaugauccaauucgugguuuaaccaaagagcagauugacaaucuuucuaccaggaguuaugaacaagacgggguugacagugaguuagguaagguguguagcgugugcaucagugacuacguggcugggaacaagcuccggcagcugccuugucugcacgaguuucacauucacuguauugaucgcuggcugucggagaacugcaccugccccgucugucggcggccugucuuagaauucggagccacaagcagugggugagagguggggucugcucagcgcuguguugcuggagcuucauagucaaacgcuuuucuugaguuacuugugaucagguaaccaaggcaaaaaaaaaacaaaaaacaaaaaaaccuaucagauuauaguuugcacuauuuuuugugugcuuuuuuuuaaaacuuguuacagaguuuguuuauauaaaaaaauuuaaaaugcagauguuaaauuauccaaaaguaaagaauaguuaauauugcuagaaccaaauaaccuuuaaaauguuuuuauuuugguaauuuugucaugcuaagcacuuuuguauguuagggaucuugagucuuucuccuaauacugcaguagggauggcugggauuuuccaguuugagcucagugcuuuguuuagacacuacugucuggucuuuguagacuguuagggugaaugucugcuagauagacuuaaguuacuugaaaugauaauuuaacuuguggcacacucuauguguguaugcagguauguaacugugggaacauauccaggcuaaaaacucuaagcuugagacuuaagcuucggggcuuagacugcauaugguacaguguaaacagugacaagaucaucuccacgaggaagugaauuaagauacaguuuuaagauagagauuguuuacugaagcgugucugacaaucugacuuaauagagagcgagcgacauacaauaaugaaccuaguauuucuuuauucauggaauguggaaauuuuaugacagguaguuuuaaguucgucuuuuuugugauuuuuuuuuuuuagaaguacaaauacuucuugggguuagguaggguuuacagcaugcuugauuuuucaaaguuaguuuuaaaaucuaaaauacuuuaaagucuauaaaguagugaaaugcauagaaaauauguaaauuuggaugcccaaaagcuccaaauaaaagccuuuaaaagaacauagaguuuauauaaacacaaaguaugcauuaaagucuauuucuaccaguaaacacuaaag

SEQ ID NO: 2801 - RNA, 2780 nt, Mus musculus
ccagcaguagccuuaccugacuuacuugucuggaaguccuagagggagcaagauguucuccuguuuccaggguuccagaggcuccggccacaaaaaagccaagagcgguuuccuuguucgcuuuuggagacguuugauucgcccucugacacacuucaggcaugcuucccacagugagcccaagguaacacaggccagccuuagcaagaaaguuguuguuacucuccgugcucccccgaggucccugccugggugugugcuccugugagacacugaggagcauucuugaugcuuacugaucacuccaugguaauggguugcugaugucucagaguuuccucaaguagacccuucugccuuccuaggucuguucucaaaaugaacaggagccagacucucugcccaagcgcccccaguucaacuaugacagccaagaauacgugguacaaaugauccacuacauuccagcugcuauucagaaacgugaccacaucuguaucaccauauuucuuggcgucuaccgaacauaugccagcacuugggaggugcuggaccugcugaugagaacgugaguggcugcauccaacauaggaguuaggagaguucugcucuucucagggacucugugcucccauagaacaauggcgauugcacccuggcaguguuggucuugggucuaaaccugcaaaguggcauggccucauucaggguugggagacucuaguuugugucuuucacuggccccagggagugugaaacaccaccauuuuugauuuggaaagagcucuuuacccauuuguauaaaagguucuaggccccaucugaccuauaugggauuaauggaaccaaacaaggguccugggguggggaggcccaggaagccgggaaccaaccaaaagcccuggcagggaacauguagguucuacccuuugugugaagaucuuugaagacccguugacuucagcacagaaaucagaacugugcagggagaccccagcaucuguguuuccucucugcagucuucagacucaaguagcucacucuagaucuauuaguagguuggggacacaagucuuuagggugacacccucauggaaugccacagguaugcauccuuccggccugacuguauaaaggaccagcaaacuaagaggugaguaggcuucaggugaaagagagguaagagcccaugggugcaaugcggugguggguggagucagacggagauaagagcccaucuguagaguuggaauaagcuggagguaagggucaacuugugugcuaagaugagguugggaaagagggagguaagggcccaucuguggaguuugggguggggggagguaaagacuuaucuuuagagugguguagugggcaagugggagguaguggccuaucuguacagggagugggguagggcaauugcuguggacuaagcacuugucaggugcccuccuuuggggauucccauuagagggaugguagcugagauuucaccugcagguggagaaaauuggaggucuccaaugggcuccuuggcucugaggagcagagggaaggauugaagcugaagggcccugggagaauccaucccuacuacaguccaguuaccccaucuguccugcaagggacagaaagugucuggaguccucugcacacaucuacacacuccuggccacuauacucaucugcagacaggcuggcaggcauuaccucaucugauggggcccaaggcuccucuugagaagcaaggccaggcuucugacucaacuucccuccaaccuucucuucccccagagccauauucagguuucuguucggcugguuuaagaaauacccccaggauuuuuaugaguccccagaccuggcuguugugaggcaguucauugacuaugugaagcgcaaugugccuuccucagauguagauagagccagggagcugcucuccgugcuggaagaucaggaggcaauagagcuacagauugagcaaggugaggaggucuggggugggggccuggcaagguaggaggggguuucggugauggauuccagcaggguauucuccagagcuuuggccugaggccagggcuggacagcagucagggaagaugucccacugugaggagaggacuggggaucuucugucaugaaaaggccuuguguggccaucaaggcaucuuggggaagaucaccccauccuaggcugucuccacuaaaaucaugucuucuucuacuuuuaaauuuugccacagcuccagagcccucagagcaggaugccucugggaggcaggagacucuggcuccgaggccagcuucugagacagagccacagggagacaagcaaccccgagaggauccugagcuugugaaaggagcaguucuggaucccuuugaaccaaaagccacaauagagcugccuccgucuuuacaucaagcugugcccacaucagaugguacacucucaccuguagauguuacugcagaugaggcgacagguguggcugcagauguuucaccugccaggcaguuauuugugucuuacacugugcaguuagguacaccagauuucgucaucccucugccugagguugacauauaguuaggagaauggucugcagaguucuacccagcugagguuccccaccuaagcuuaucucauguuuuuagagacaauaucuuauagcuuuguuggauucuuuguuuuucauauuguuguuuucauuuuuguguuuuuaauuauguuugaauauuaauaaaaauaauuauuuguucuucuuaaa

SEQ ID NO: 2802 - RNA, 1410 nt, Mus musculus
gauuucuuucuuucuuuuuuuuuuuuuuaaaccaaaaaaaaaaaauuuuuuuuuuuuucauuuaaaaaaguuuuaggucacauaaaacaaggcaacauuuacuccuucuucucgucuucuggcacugggucugugggcggcuccuccacuguggcgcuguugcucucugagcccguguuacugucacuggucccuuccaccuccaugcugucaacccccuccugcccacucuccuuguccucaggaguagacgugccuucuucaccauucugcuggcucucugcugugucuucaaggugugucuccucugucuccaucgggaugcucuccucauccuucuucuccucggcuuuguucgccacuugcucuuccucaggggcgaugcugcucugaccgcgcucagccugcucugcugccuccuucucccucuccuccugccucuugcgggccuguuccuccgccugugcgaucucagcugcaaucuucuccaugucuacuuccaccuucagaccacauaaccuuuuaaguucauuguuaaaggaguccgugcuuuccaggaauuuccucuucuuuuccuggugucguuccucuaucugaaggagcucggcuucuaguuuccgcugaugaaccauuaaagacugaaccugucgcuugaggaccugcauucuagcuguugugacaaccgaccgcacaucagguaccacacucucacugaggaucucacugaugagacggugguuucucuggaaacgggcagugccugugugcuucauugaaaagccauuaucauagucgucuggauccucagcaggcugaaugcucauguaagguucuccuuucuccaugcgagacugucucugucgacuuucuuccucuaaugcagcuuccgcacgacuuuuugcauuaauauaggcaagguacacaggggaauuaugguaggccuucauagacucauuguacucuaucuuuucugcuucguauucguuuaaguauucuugcuucucuucaucagugagaucucgccacaugccaccaauaaucuugccaaucucccacaacuuuaggucaggguuggaagccuuuacuugguccuagaccuuucugcuguaccucauguagggcaucagcggcuuaucugguggcuuuggaggcuuuggaaucguaaugccagaggacgccgugacccggcuguuggugcccggguucccucccagccuguaguuguuguaggcgagaugacuguauggauuguaucccacaaacccuggugugcugggcauuuguguugcaggagcuggggugggagguggggcauaagauggucucuuugacauuuuggaagauuaaguucucaguuccuuaagaaugaaucugagacaccgcgggccgcuucgcuucccuuugucagcu

SEQ ID NO: 2803 - RNA, 877 nt, Mus musculus
uucccuggaugcaaggucucagaacgcagcaguucugaauccaucugucugcaauauccccagccaccaaagcuagaucccuucccuuuuaggucuccugcucaaagggucguguucaguacaaggauuccaacaaaucccggccucuaccgugagcuccgguuuugacagugaggcgaccagcucugaggauacacaccacuguuaauuccugcaguccacaagccaauucccgcucaacggaauuuuucuuuugccauggcuuguuuuauuuuaggcaccuuccacaauaagaaguaggauccuaugguugccuuucugccuuuguuaucacuucugccugacugugcuaggcauguggcccguggcuggucccaagggaagcacagugugugugcgcuuugucacagcuccgugagggcagguguuaacaauuaccccuguucuacagagucuucaaaacgagauuugcuagaagccacagaagcaaggagcgcaucuuguaaggaagucauggcaacaggaagugucugaggcugcggggagcaggugggguccugacggugugaggccugaguccucagccagcaccacaucgccugugugucaggagaagauucccagugagguugguacaugccccgacuguagaaacagacuguguggugaagagggacgugccucaagcuauggugcuuacccaagagcccagauguggggucacccugcugccucagcuaucagaaccuuaaggguucccagugaagaugaaagaaagacaaauaauaaagaccauuugauccaagugcugaagauuuuuuacagauaugccacuucaggucucugcucaaggauaaacuauuucaaaacucucuac

SEQ ID NO: 2804 - RNA, 3485 nt, Mus musculus
gguggcauccaagaacaaggccauguuuaucuucugggcccuucuccccacgcccuauccugaguuccaccauguaccuaccaggaaaucuuugaauaguaagguagguccaggccccaaguguguugcucauugaauuugaguaaaucuguucacagcagaaaggggcuguguuuggaugcugagcugugggcaugacugcccccuaagggaguucacagggaagugacugcaauuaccuugauucauacucaauuaguuaauuaggaaccuugcccuggcucuacccauuuccucagugaugucaccccucaggacccuuuuaaauuuuuuaguuguuuauauuugagaccggguuuuacguaguccaaacuggccuugaacucaaacccucuaugugaccaagaauaaccuuaaacuucugacccuccugccucuacccgcuaagcgcuaggauagcaugccagugugccaccacacucaguguacaggaugcugaagaucaaaaucaggguucucauuaggacuguuugacaaagacacaaaaagggaucucuuucccauuguccuagaaacauccagccaauugaaacuuuugcucuuucgguggcucagauucaugcucuaggcuggugcuccagacuggaggcugccuccaggacacggcaaauacaauuugagcaaaggccuccccugggcugcaccgggaggaacccgcgcagcugggcgggcagagcgcgucaggcagccuugaggagcgcacgcccgcgggugacaguccccugcucgggcgcugcucccacccuuccaggaaggggcggggaaaaggaggcgccagaggcagccaccgcgcucccggagcucuuuaaaauccaagagccugggcagcaccgcuggccgcgccacaucccggcgcuguuguguccgcgcguauccaggcggcucucgugcaacgcggucucgggacgcgcccaugcggccgcucaccaugucugggcacuuucugcuggcccccaucccggaguccuccucugacuaccuccugcccaaggacaucaagcuggccgugcugggagcggguugugugggcaagagcgguaagugggacaaaggcgcgcaaagccgcccagggacagcggagggucuucacccgcagggaugccgggaugccgggaugccgggaugcaggaagaccccugccuguugcuucagagguccauuucugagcucuggacgggguuggugccuguugagugucgcucuaguccgguccaucacauuccgcggggaaaggcacuccgcgguggcggggcuuugucccgggaaccuggggggacgcgugcuguuccuuugagggcccaguuuggaacagcuugacccacuucuucagcugauuuuccuacuuuauuuuuucagcaaugauugugcgcuucuugaccaagagauucaucggcgacuacgaacccaacacaggcaagaauguuuccgugcuuccuggcucuuguacuuguaucucuuugcccuccccaccccucucucuuuauuuugcucauggggccgugggaacuuagaugcaaauuccucuucguuguacaggcaaacuguauucgagacucgucuauguggagggggaccagcuaucccuacagauccaggacacuccgggaggcauucagguaaggacugucaggaggguauguggugcaggcugagguguuuggcuccaggaucucagugagaugucucagcaugcccaauauguaggugugggcacacaaggugugcugaggguugggauguuggaugcccuccuagguggcaagaaaugguugauuagaacuaguuuccucuuaaaugcuaauuauaauuaguuaauuauuuuaaagauugcuguguagcccuggcugguuuguaguucagguuugcuuggacuccuuauaaucuuugaugccucagccucccaaguguugggauuacaggcugagccacccccucccagcaguagcccugacugaccacuggugcccgagcugccuaggcgggcgggcauugacacuuucagagcacauccugggacaaucuaaaaaccacagccuuggaacuaaggguccaguucaguaguaaggauuccuggguuccagcaccacacugaaaaaagcauggaguaggugggauucuggagggagugggguuugcguccuggcuagggcugucccccucucccccccccaaaaaaagcuagggaauguuuucucaagccaguaauugcaaucagauaaccuuuuggcuaucacuguggaaugcaacuuaacuaauugcucagcccuucuagggaggaaaagguugaguggagagcccagagaauggaauuuguuucugcaacauucucaagaaguugacugcuaaaaauauuuuuuuaugggcuugggaauagauauuuauguugggcuguuuccaggguuuuguuuguuaugaauuaguucccugaaaacgaagccguucuggucuguaauuauucuuaagugguuagaguucacuggagacugccuguggaaaaaguagguuaccagucuacauccaggccagcucagaaaauaauccagguugagcacuugucugaggcuuucugcagaaagccucuuguagaagcuagggagagccagacagcaauacucagugaucucucuguccaguguuccuacaggggcuacuccggugucauguuugagcuucuuugaccagauuccauuuuguuuuuucccaggcccaagacagccucagucaaaugguggauucucugaccaaaagugugcacugggcagagggcuuucugcugguuuauuccauaacagacuaugagagcuaccaauccauccggccccuuuaccagcacauccggaagguccacccugauggaaaagcccccaucuucaucgugggaaacaaaggagaccuuuugcaugcccggcaggugcagacacacgaaggccuucagcuagcuaaugagcugggcagucucuuccuugaaauuucuacuagugagaacuacgaagacgucugugauguguuccaacaucucugcaaagaagugaucaaggugcacagacucgguggggaacggaggagggcauccgucauuccccggccucgaucccccaacaugcaggaccugaagaggcgcuucaggcaggcccuguccuccaaagcgaaagcguccuccgcccuggggugauccagcucagauagacuggcggguugcuauuauuacuacuagacauuugugcagccacaaagacuggcccuuucccccuuuaaaacauauucagaguuuauuuuuauaaugacuuuauuggcuuucaaguguauguauauuucugaaaauucaaacaauggauuuuuuuuaaauguguuuuuuuuuuuuuguuuuuuuguuuuuacuguaacuguuagccacucuuccauuaaaggcaaaauggcaauacuau

SEQ ID NO: 2805 - RNA, 12255 nt, Mus musculus
cuacggaagccgacgcggugcuccggcggaguccagguacggaccugcuaguucuuccugcucgccuaccccggcccagguaacgcugaggugagggcuuggcgacggggcugaggugggaaugcauguccugggaacauucugugcagagagcccuccguggacgugggguggcggcagcaccagccuucggagucgagaccaguugccgagcugccaauaaucacuugcucgccagccuagccaguuucgcuguuugugugcgcgcgcacgcuccuuccacggauuuggggggcaaggugggggcguaggacaacuggcauccugguggcauggcguccuggugggcgugucugcugcggaccccuugugagcguuuugggauuuuuuuuuccuuuaauuuuugauguuuuugcaacagggucucacuauuuaucucuggcuguccugaaacgcacucgguagaccagucugaccucaaaccuauagaaauccuccugccucuaccuccgaagugcugggauuaaaggcgugcaccgcucgccgugucaggacuuuugaaauuccuuccggaauugaaggugagagaauucagucauaggaugaagccaacgucauuuucgcaaaauauggauucuacuagaacccauccuuuccuucgggagugaauauaagcccucaauaugucaaugugagcuugugauuaugaaguguaacgauucagaaaaaaaguaaagaaauaagugguagaaauaagcucccgucaggccauaucccgucaggaauaaagccuuaucccucggaggcagaggcagaggcaggcugaucugugaauuggaggccagccuggucuccauagugagauccugucucagagagaaggaaagaaaaaagaaaucaguaucauuagguugaagagcugcucaguaggcaaggcagaguucagugucuggaaccuaaagguggaaggagaaaacucaguccacaagguuguccuuugaccuccacacuggcaccauggcaugggugcccagacacaucagacagacaggcagacagacacacaagcacccuuacccacugagccaucuggcuggcccugaaucuuugcuuaguauuagauaguguaggcugugagcauagucaacacguuuccgaguuaacugauacaguuucauaauuuuuaguguugugaaggcugcacugaugaauaguguuaguguguuuaggcucacuuuagaaauuauuggaacucccguacuaaucacaagccauaauuuauuauuuauuauuacuguuguuguugauauuguauuaggaaacucaaguuuggaacucaaguagcaauuuuaaaaauaaaacauuguaauacauuacagcuuagagauacucuaauuggguucauacugaagaauguuagcagaaaaguauugaaagguuuuuuuguuuguuuguuuuuuguuuuuguuuuuuuucgagucaggguuucucuguguagcccuccuguccuggaacucuguagaccaaacugcccuugaacucagaaauccaccugccucugccucccgagugcugggauuaaaggugugcgccaccacugccugccuguauuaaaaguuuuaagagcagaagacggugggaaccauaaaacguugcaguugauauucugcuggggccuugaauuaucaaaacaugugugagcuguacuuggcacucauugccguuugagacagugagaaccuuggagauuuugguuugaccaaaacuagagaaauaaguagauuaguguuacagaagucuucagaauuuuacauuuguaaaacccuuacuugugguucuuuuacacacaggcugugaagcuaaugguauguauguguguagguacauaguaauaugugugcccaguuugcuuucuauugcuucgagaacuaccauagcaaaaaagcagacuacuuggagaggaaaggguugauugggcuagcugguccaaaucauaguucaccacugagggaagucagggcaggaaccuggaggcagaaaccaaaacaagaccacagaggaacacugcucacuggcuggcuccccguggccucucagccugcuuuuucacaccacccaggaaggguagugcccacagcggguuggaucuccuacuacaguagucauuacucaggagaacgcuccacugacuugccaggugacucuagcuugugugagguugacaaagcaccagccaggauaaugcacagagccaguguggccguucaguucaguaggaugacacauggacacugcaggcuggauucaucgcagggacaugaccacugagcuacuacuucuuccgggcaucaauuccuguuucuuuguuuucuuuacacauuaauuacaaaaaucacuugaacaaagcaaagaaugggaagaugagcuaacugacacccauguucagauucggcaaaugucgccauaaucgcacuuuguaacucccauuuccagccgagccauuucagaaggacacgugucaugauccuaaauacgucagggcuugucucccgagaguuuuauucucacacugagcaagcuguugguacuuuuugcaaguucccaauaacuaaucugcguuccuguuucccaggguaucucucggaggauuuuuuucaaacauuacacuuuguaauuucccuagcuuuuuauucaaagccagcccaucuccccuuuucauccucaccaagcuaguguguugucucagagucuggguuugugagaucccuucccuguggcauccuccaggucauugcucucuggguccagccuuauucuggaagcuggguggagaagcgagccaguuuggauuaccucagggcgaggcuguguuguggaaagcucugcguauuugcagcagcuucggaucaggaggcaugcccggggugucaugcuuuuccucugguggcagugccacucugaccguuggccaugacggugacagccagcguccuccucagcaaaguguucauacguauuuaaucugggcacagugugugggugaccuuguggcaucagccuuguaccuaaagguguuugacuauugacuaaaugagccauuuuccuuuguuccaaaauggugguggugguuauuauugcuauuauuauuaccauaaucaucaucuccaugcuaggaaggagagcucuuccucauccacagagaugggcacaguuuucccuuaaaagacagaguaaacgcucagcucuuucuguuuaauuaccaauuuaccaguuuuccauggagcugggguguggcggugacacacaguggcaguuaucauccuaauagauguuugcauauauauucagcguguggaagggaauuacagccauuuuccuuaauguuuaaauuauacaacuggcuggacuaagccccuucaugcugccaaacuguaaaugaaguaugaccagcaagcaaaacaaaauacucucggggagaccuggagaccagguaucugauagaggaggcacugucagucagggcuggccuagaaucaugagacagaagauugggcacccuggugguugcugguggcuugcuguccacuuuggaccugugacuagaagaugaaaccagucucaacacaugcuguuugucucacucucuucuauagaaagauuuuccaagauuguugcucugaggauuaaaccaagggccuuguacauuaggcagauucucuaccacugacccaaauccugaggccccaaauaaggaauucugaauaguaaauaauaauuaugaauuuguggguuuuuuuuuuuucaucugagauaggccucacucuguagaccaggcuggccgggaaaucacagaguucccuccacaccccugccuuuucagagugcugggauuaaagguguggacaagaagcacagggagaaaugagagaaacacuuuuuauuguuuuguugugguaaggaagcauuuuguuaaaaguccaagaaucacucaguuguuuuauuucuuauauuuuacaagugcuuaccccaugcguguauuaucugugcaccacaugcgugcaguccccucagaggcuaggaucuaaugcaugucagaucccuuggaacuauguggauaccaugugggugcugggaaucuaguccuuuggaagagcagaggacucuuaaccucugggccaucucugcagccccugacauggcauuucuacugcauccucacaaacccccagaugaacuuagcuuuuggagcuggcacuauaggaucuaggagaaaauagaugucaugaauguggaagaaaaagagauugaaguagccacgccagccaacugcucagucugaucuccagcugcuagggacggugccaaccaaggauccaugucucugugucaccuuccuacgcguggaucugguggccugggugcuguaaggcuccucagacucaccuguggcacccucagcugcaucccagcagaccaucggcaucagcgauugcguuguaauaaaccuucuccauuacuuugucaggauggcuguucuucugaugagguugaugcuacaaacuacaaagcuugaccauaacuuaauuggaagauguuugcaaagacacgcugugaagccagauccagcacagcugucccugucugcguccaccccaaagcuguuguaccugacuucugcaaaagguuuuaguacugcuggagacccacagggugagaggaaacagaaaagaagggaugcuuucucuaacaccggccggaagauuagugagcggauuauccgcguccuggaugagaagggcauggaccuggggaugaugcaucgagcagaugugaucagacucaugaacaagcaggaccugaggcuggugcagaggaacaccagcucagagccaccggaguaccagcuuaugaccggagagcagauccaccaggagcggcuaaagcuccgggaacaggaaaaggccaaacccaaaacugguaggugcucugcuguguuugcgacuugaucucagccuguggguugcgaacccucugagggacggauggcccuuucacaggauggugugucagauaguuacaguaugauucauaacaguagcagaauuacaguuacgaaguagcgacaaaauaacugggggguggggggagcaccaccacaugaggaccuguguuaaaaaagggucgcagcguuaggaagggugagagccauugcuucugcaugaccccuggggcaguggagagauguccaccagaucuaacccccauuccuguugcucugcuuuuuaagcaucuuguaaaucacagauuugucucuugccucuguacauggccagucaccuucccaggcacgugucacggaagccacgcagaggccaagaacuggguacuaagauggguuggcuuuugguggcucccaguuguggaaggccuucacggugugaccagggccggggcuagccucacgguacgaggccgugugcugugaggaaagagaaccuguuuuauaacaccacaggaaugcuggccacaaaacaggcuuucgaaggaaacuaaccagggauaaggaugucaaaccguggcacagccagaaaacguugagcagacuggagaaccuggagagcccgaagggcuaaugucugggagcuuuuacuccguucugauggagacccggggccagcugggaagcaagggggcgcuaagaacauuucacccuaaaggccuauaagaaaagguaguuaacuaacagcacccaaaaucaguuagccagcugccauucagagguaaagucugaacauuacgcaccccgcuccagauguuccugugugcucucauggacuucagccaauguuaacgugacagauguucagaaacgguaugcagauugcuuuuuuuuuuaagcacguuguuuucuugaucuacccauguuuauaggauagcuauggguaaauuauuauaauuaucauaacuaauaggaguagaucuaaucuguuaaccuauguccauggcaugggccucuucccaguuguucauuauuuaugaacaacucuggguucuaugaaccuaaacggaccaggcugccagcagcagcgucaggugaggcucccuguguucucaguacugucacacugucaacagugacagugaggagucccuggucguuuuaaugucacccuucuccagucuggggcacuucugugaguugucuacuugugccccauuguuucagauuuauagcucuauuuuuucuuuuuuuguuuuucgagacaggguuucucuguauagcccuggcuguccuggagcucacuuuguagaccaggcuggccuagaacucagaauuccgccugccucugccucccaagugcugggauuaaaggcgugggcuaccacgcccggcuauuauagcucugucuaacacagggucugggggaugguuaugggucgcagugccugugcacaagugugaguuugaagccccagaaccaaggaagagccaggcucagcagccagugugggugcugcaagccugguccuuuggggagcugugggguguggagguugaaggugagaaccaauacucaggguuguccugacuccacccccacccaagccugcacucacaagcacacccacaaccuuagcaagucuuaaauauuauuuagcaaguuaaaagaaaacaagccuuuaugccugucuccccaauuuaaaaagaaaacagcugacggucaguuccugggggugaaagugagcggagggccgcaguggccucucuggcuucagaucugugggcagaaagcugagguuucaaaggagaguaggaaacagaccaacgagcacucaacuucauuguccccaaccaggaccaacuaugacgaaagagcucguuuucucuucaaauauuggacagcacgauuuagacaccaagaguaaacagauccagcaguggauagagaagaaauaccacguucaagucacgauaaagaggaggaaagaugcggagcagucagaggaggaaacggugagugagagcgagcgccugcagggccgccgacucgccgacacaaaaagaaaacugcagagaaacuggaaagccuaccacgcacaacgccuuggcuuccuagugucaaacugggucuaguauguuuuucauuagauucuccacacgcgaacuguucuggggcuagagauuguucagugguuagagcacugaccacucuuauaaaggacccagguucaggucccagcacgcacacggcagcucacaacugucuauaacuccagucucaggggagggaaucugacaucuucuggacccugcgggcacugcucaugaggugcacauacauaagcacaggcagaacacccacacacauuuccuuuaaaaacgcgauagaaaagcuguacguuauucuaagaccugccggguggcuagcaguuaaaacagcgaaggcagauaguucacagggcucccuugcauacaccugcagagccuuccuagucagaagcccaguuugcaugccgcugguguuuagaccuagcucacucaucaccaccaaaggcagcacugguccaguggguuccagccucaguuguuugcaucacauacuugcagggcacagcucaaccggcccaggcuuuugggaguccaggugggaucugccucccucccucccucccucccucccucccucccucccucccucccucccucccucccucccucccucccuucagaacaagaaaggcacuuugccaagacccaguguuugauucuggggaugcuuggguguguaggcccucagugcugugacagaguggagaccaaguguuaggugagcauggaguucaguguugcugucagacacacgggaagauguaggagcagcccagccugucacagcagcucugaguccugucgugggcaugcucagaugccaccgcagcaucagacccugguucacacuaauggugcacuguuguccucuguaggaggagauauuuaaccagauucuccagacuaugccugacauagcaaccuucucaagcagaccaaaagccaucagaggagggacugcuuccauguguguuuuucgucacuugagcaagaaagaagaaaaggcguacagagaaucccaggagagccagagaagagacacuuugagcaaagacgacgacggaaacagcaaagagucggauguugugugucagugacuuuaauaggaaaagugcaggccaggagccucugcuggccgcccugaagucuucccgccuagcagacagugaguaaggcggcuggcgggggcagcugggccucugggcugcugcuggacucugcgcuggcguuaggcaaggaguagucgggcucuuguuuccucuuaggagggaaguacccacugaggcgagaggccaagcugcgucucucccgaggggcucuuaccuucaggagugaggaagacagacaacugaguugcccauuacacaacggggauccacuccaacagaugagccccugaugggagucacacccucagcaggcacagacacgcaggaugggguaugcggauggacagacgccaagcaggccucacagccgagugcuggccccagcagcugccacuuacuuugagcuucauccucuucuugucgggaucgugcacgacacugugccucaugagacucugcugcagugcaagggaaagaaggacgcuugaccugggccugcagacguggcucagugcuuacagcauucgcugcucgaggaggacacggguuugguucccagcacccguacuccaguuccaguaaaaacucuuggugucugcuaaccuuaagaugcagugguccagugugcaauaauaaacuaccagcugccuuucuguuguguagugaaucugaccuucaccugacucccuaaccagagccaacuccuuggcagagcgagcgacugucagccugcugacacgcaugggauuuacuucuucccgguccuccugagaagggaaagccggcuaugcuugaacauccaggcucaugcugggguaacugaaucuaccucagcugcgucccuaagugccagggggaaaucugaccucugcccugcuggcuaugcugacagugcugaccacgggaccuuugcugugggcuggucuggguuauguucagugacuuuguaauccacaguaagagcucuuuagaaaccagcuaggcuuaggcaaacuguucaguucccuacuaggaaccauguucccacgcgauccaugaaucaugccaagauuccagagucuagaggcugugcauuugugcuacccaccuccucucccagacccuaggcgacggucagaagcuccuaaucaccucagaacauccucuaaguaggaauacaggccccgggcucucccacucagcauggcuagaaucccccaggagugguucucaaccugcuacucaugacuccucuggggucauauaccagaucgccugaauaucauuauuuacaauccauaccaguagcaaaauuauaguuaugaaguagcaacuaaauaauauuaugguuggggguccccacaacaugaggaacuguuauugggucccaguauuaggaagguugagaaccacugcucuagagguccuaaauaggccuguuuagccucccaaccccagggcuccugcauuuccaaguucugcaggcuggacaugaacacaccagccuggagcgggagacacucacuuucauugcgaaugucuugccacagccagcgugcucacacacaaaugggcgcuuuuccucguggaaggagagaauguggcucugcagguugaacacgguuguguagguucuuccgcagccuugccgcggacagcgguacacaucccuuuccggggcgugagucuucaugugcugcuuaagguaaucucugcgcuugaacauccucugacauacauugcagguuauguccucugggaggagaaacacacacguguaaccagcgucccaugaguaacccgucugguccuaugacuacacacaaucuggggacuucacaugggaaaugucagcuugucucacugcuaugcugguuucaaauuccucaaguucacucauggcucccaacauccugaguccucgccugucaaggagcaggcguccucggugugauaacugagcacgaggaaguaugcccucauagcaucuaccuuuacccucugacacaguagcaucugcuaaguccugcagggccucacgaacacccgggcacagccgcaccagcucugaggccugcagggcucccucgacugucacagcccaggaagccagcacuacccugaacucgaugcagagcccccuuccuuuacagcgcaaguggguaucucacucucucagaguacaccaugcacuccccagagcucagagcacacacaccaugggcuccccgggguucagagcacaccgggcucuccccagggccgaugcgcuuccacagcuccugccuaccuuaccuuuaugggcuucucucauguguuucaggagcucuguccacguuuuucccaugaaagaacaucccuuuugacacagguagccuguucaaaacaaaaacaaaacaaguuacccacagccuguugaaugcccagggcaaucccuaaugacagccaagaaagcccgugccaagugcacuccccucucugaagugugcugcucugcugggugcaaugcagcgggcuccaguggccccugcucugaaagcucccaucagccagacuuuugcacacuugaguggcacauaaccagguagcguaggaacaguauagcaccaguggacguggcaaagaggauagcggcaaaacacacagcacagugucucuuggcauaagaggcaaacacucaaauaacacaacaggcgcuugcuugucacagaacuuugucuacucagcgugacuacagaauagacccagccuacccugccgguggcauguuccucgcggccggcacaguccccaucuacguacccucgugaacuuucccaugccguuucagccugcugggcgaggcaaagugcuucccgcaucccucguggguacaccuaggacaauagcaggcaaagcaucagccaggcccuuuccauggacaauucuaagauucccucuucucccacaccaaagcccaugucuucccacaccacaccugucauccaaaacaaagaguaaguacagucccgaauauggacauaguggcuuggccagcuugggagcaaaacaagccauccugagaaaaagucacaucuuuuguuuguguuaucaaacuaaaaguucucugaauucuggaaauguggcuacagaagcgacaucaagaggcugucugacucgguuugcacuggaccagacacagagcuguugucuggggucugcccaauaugcugcauacggucagaugagaacacagcacagaggcuggggaccagcaccagaaacacacgagaauguacagcagucggugcagagcuccaggcacuggcagcacaaacaggccacagggcugcugguaagaccucggucacuguagcugcaccagugcaaagagcagccuaugggagccaggggcaaggccccaucacccggacugugcagggagacacugcccuaggagggaggcaggcagguaaccuggcaccccugcccaccuccucuuugucccucuugaguacucaggaaucccucaaaacaagcagggccucauuacuccuguucuauaguaagaaaaaaaaaagcccucaugacacagagccuuccucgggauccugaucuuagcguucuacucugaaucccagagcgcuggcaaagcaccaaccugaagagcggcucgcuggugugcuggcacugauggguucucagcugcuggugcuucuuaaaggccuucuugcaacccucauaacugcacuguuuaaaaaaaauaaaugcacgguuuaguacaggcaggggaucaucaguugcugaaguccuuuaaaaggcaggagagauugcucaaugguuagggacacuugcuucucuggucccagguuuggacugcagcacccacguggugccucacaaccaucugacuccaguuccacaggaccucacacccucuucugaccuccacaggcaccgagcacgcauaugguauauagauacauaugcaggcaaaacgcuugcacauaaaaccuuuuuuaacuaaacaauaaagucucucuggaucugagugucucggggaauauaaacuuucac

SEQ ID NO: 2806 - RNA, 34654 nt, Mus musculus
accgcguuucuaaguauuuuauugauuuuuuugagaaauucugggaaaugaccacaaaagagcaguacaucaaaaaacuaggaguuuuuaaacaaucucaaaaucucaaauucuaaaacugccuguuuugaaacgaacuuccaaguaagguaggauaaagacaccacggauaugcgggggccaugccgagucagcuugcucucaccgcgacaccuucaggauaagguaguuaagauuuguuuuaguaaaguuuucuucucccguuaacaacaacaacaacagcaacaagaacaaccacacaguaccaacagccuccuuaaaacaaaggacccacugagaaagucacucucaggugccagccggccaaccucccugucuuccuugcuucacucaguggcaggugcagugcugggcugggcuagcccugcggcugucucaucgccugcugggccgugggucgcacuugucccgggagguccgggagguccgcuuccguggaggagagcagccugcggagccccgggacgagugaaggcugcgcuuguacgagugacuucgguacuucuucccacuugcuuccuucuggucuuggcuuuugccaggcuccuuacugcccucuuuuuguucauggucuugcucuuuaugggagggcaguguguucuuaauuguguuaauuaggaaucuuuuauuuguaccagcaagaggacacuucauccuguggaugugaaaagggaagaagacaucagaaaugcgagaguuaaacucccucccuccccagcugacccacuaugcagaucaguacaaaacaauucaggucccacagacccggcuccugaguuuguuuugcuucccuugccauguagugcugaggcagggggacugccaugauucugagaccagcaugggguacauaacaauucaaguaccagguuagucaagacuauacaagacgacucuggaaaggugaugcaguggccccaugccugaacauuaauuacagcgcuaccucauuagacucuacacucaucagcaccacagccacaccacagcccagccauggcagauuuggggaaagcucaccacagccuaagugccuagcuaccagcaagcagggaagcaacugcaggcgaagugaaucagugcgcuuacagcugagguuccuucuagcagaugagcagaggcacacagagcagggacagcugaccacucagggacauaggacaauguugcggcaaagagcacgacaggccccggagagcgcugagucccaguuaucuuuauagcugacacacagaugcuugguuauggagcagcugcgugccguccccacaccagcgauggcagaccaucuucugcuccacauccacccucugcacuccgaaggcuacaagccuggagauucugagucuagaauggauggaagggcuggggcagaggcaggcccuccacgcaguuaucuccaugcuauuuaucucgaagcuacaguugauuacaaccaugcuguuguuuaaugccgccacagcuaccguaaucacccuugguagugcauuuccaaucuggcaaucagaugccucagaacguggccaucugagaaauggaccuccuucaugacuuacacacucccaaggcuuaccgugugcccagcacugcaccuaaaaguacugugaaacacuggguauaugugugccugugucacaauguauacauaaaagcauuuacuauguucaaaaccucugucugcgggacauuauauuaggccugugcagcgaaggcaaaacaggcucucaguggagaauacugaggggaacagaagcaggcgggcauacagaggcuuguggcgauggacugaaggccccgagcugcagcacaugggccacugguccagacccagaccgcucagcagcacacucagggccccgguuccccuucauuagagacaggagaagaacgcaaggccagugagcacuguguugcagaguguuaucaggcaaugagggaagaaugguggcuuggcacaggagcugaccacaaggcaauguuccagacccacagcagagagucaaccugggguggggcgggggucucagggaacuucucugggccccaucguuuugaagcauaaaguggaagucuggauuucugugguccugaaauaucacaaagggcuuaucugugacaaaugcacacuccucccagccuccucacucaacugagaucacuccuguuugucuauccaccagagcguaaaaagccaaaggccagaaaaacaagucuccuuaacccuuccucaggccuggcaagcagcgaguccauauggaucagaaagccacaucuugauagagaaugagaggcgaucuccuuuccaaugaccgacaggccugccagggagcaggcuagaaauggaaaagcuggagaccacagcagaggugaggcaggucuuuccucucugccugcagugggacccgaccccuucaggaaagcacccugcaggcacccacaggcugcugcuccguggucccucuccugccgcuucuuccccucaggcauuggagcagaaagauaacugggcugcagagaagcuacggggacugugggcagagcaaaacuggcuuugcagaccaggaaggcaggcaagcuccaaugugugucuauacauuccuuuaugcccacuaacauaagccacaugggccaggaguucacucgcaauggcucccaacaagaaccucagaagugcguuugcugagacauacccaaggcagugcgcccaggcaccaaauggucccuuucuuuagaaaauaaaaauggcgucccacucauacguccucugguuagacagccucugcucaagguucuauggucuuucuuaugggacacuccaaauuaaacaaucucacucacauucuauauuacagauuuaaaaccauuacuuauaaagucuucuaugcacuuagaaaaacaaagcaugguuuauguuagagcaacugcucucugcuccuuuaaggucugugcagaggucguucuccaggccauaccccauaccaggcugcugagugcuuugggcugucugccuccagccuuggugcaaggccacuuuacaucugccuagcaaggaguuccaacucuuuucagugaagcaggaucagugucuuuucaaacaugacugcacccuuagaaucacuuggaugugugguuagagugccaacgcccaaauuccacuccaaaaucacaauagugggacauacgccgucaguaguguuuucugaaugacagaaguuaaaaucugacagaugauuccacauguguagauaaagcuggaaacacaccaaaugaaccuggcucagcagguaaaaugcuuguuaugugagagugacagccucacuggggaacuuuaacccuagcacgugggaggcagaggcagagaggcagagaggcagaggcaggcaggucucugugaguucaaggccagccuggaugacagagugaguuccaggacagccagggcuacacagagaaacccugucucgaaaccaaaaacaagcaaacaaaacacugacaaccuggaucccagaacucauaaagguggaagcagagaaccgacuguacagaguugaccucugaccucauguguauuauaugcucacacaguaacaaaaauaauuuaaaacagcgagaccauuaucacgacuaaaaacccaccaugaauuuccuuaauaucuucaacuaucucuaguuguuucacauauuuuaagaacauugauuuuguuuuuaauuaugugcaugcacaucuguguguguggaggaguguggugcucccaggagccaggauaggaguuggcuuccuuggagcuggauaccggcugcugcucugagccacucgcuguggugcuggcaagcaaccguggcuccucugcaagagccaggugcacucuuagccacugaguuguucccucacucccucaugucuuaaaagaaaggugugugugucugucugucuguuuuuuucucucucugugugugucugucugucuguuuuucucucucucucucucucugugucuguccucucucucucuguugcuucuuuauugcagccuuuugugaagauucgccaaugugaaugcugugucuguggcucuguagaagagagcuugccuagcacugugugaggccacucacacacaggcuuuauccccagcacuauaaacaauaaucacuaauaugguuggguuugucacaaaccaacauucagcacaaagugccuuuucccccaacuugacacagcuagagcuguuucaaagggaacugcaacugagaaacaccuccacaggaccggccugcuggcaagucuggaggacauuuuccugacugaugugggaggacucagcuuacguggguugggccaccccgggugaugguccuggggucuguaagauagagggcuaagucaggaggagcaggcuaguaggcagcacccuccacggccucugcaucaguuccugccuguagguuccugcccugccugagcuccggcccucauuccccucagggauaagacuguggcugagagaagugaaaggaaacaaacucuccuccccaggccacuucugugagugaugcuuuacugcaacaguggagaccucagacccucagacgugcaccacccccuuucaccgacagacucagcagccacugacggccuuuacacagucacagucaaagaccggagcuuauaaauguuucuguugucccggggaaucaaacacagaacuuugugugcgcuaggcaagugcuuagcuacguucccagccuuccucugucaauacagguuuugcuauggcauaauuuguauaaaauguacgcaaguuucucucuuuuuaaaagauuuauuucauauguggaguguuugcuugcauaagaguaugugcacauacgcaugccuacagagaccagaagagugugccagccccagcaacggcauuucaggugguugugagccacaccauaugggcgcugcaaacccagguuuggaaaaacagccagcgcuccuaaccacugauccaccucucuagucuccaaguuuauuuauuaaagugacuaguuuucuggucuucaaucaauacaggaaaucagauucuaucagagucaagauacggaacacucuccgaguccuucucuagccccuagguuccaacaacuggugaugucuguuaugucccaaugccaaauaaguggaaccauacgcagccauguuuugugucuggagucuucaugaugcugcugagauguauacauucuguuuggggcuuuuacaaacaaagcugcaauaaacgccauugagcgaagcucucccuagauuucuguuuugaauucucuuugguaaucugcuugaagauucuguguggugagcguauauuuacgagaaacugccaacugcuuucaaagcaguuguaugacuuacauuucugguuauuccacacuucagcuucacucggucgguuggcaaucuuuucacauuuucacucugugagugcacucacggcaaaagucauugcacuguugaugcuaauuuuucaaucuaaucugaggaucugcuugcuggcuaguccuuuaguuacaucaguaaacuuuuucuuaagcaggauuguuugccuuauacaguuuggggcuaaggcuauggcucaguggcagaguacuugcuuagaacugcaugaggcccuggguucaaccuccagucucguagaaaaccgaaccaaacuaucggcccaugauucucuguucuaucacacuucugucauacguuagcuagguuaaugcuuuugaggggggagaugcugggaauuaaaucuaggacucuguaucagcuuguuugcucugccuugaagacaucuuuuaauguccauggggucgaucuggaaguggcuauuuugcucaggcuggucuggaauuuacuaucuugccugcuuuggucuccuaugcgccgagcuuacagguaugagccaccaccacgccuggugaggagcagcucuuuccuaaguguuauucuguagguauuugcagugcugagauguauuugaaccucuccaugcccauuuugugauggggguuuggguuccuggcacucuucagagggaccagggguuuggaaugugguauuucucacagccugucuuaucuggguuccuacugagggugaaacacagugagcaaaaguagguugggagccacggguuuauuuggcuuacacuuuuaucacuggaagaagucaggacaggaacuccaacagggcuggaaccuggaggcaggagcugaugcagaggccauggagggaugcugcuuacuggcuuguuccccauggcuugcucagucuguuuccuuauagaacccagggccacaaugggcugugcuuucccccaucaaucacuaauuaagaaaaugccccacaggcuugccuacagcccgauuuuauagaggcauuuccccaaauugagacucccuccucaaguaugaugcuagcucgugucaagcugacauaaaaccagccggcauacaaccuuaaggguuucaguauguuuuaggugauccaaucauuauaauuucauuuuuuuuggaucaaauuauucuaucuuugacuucauauuggcuccagagacuuccuagccugcuguuagucuuugacagauuuugguuuucuggcacgacaagcuuuuccagaucauacuguuuguucccaugaaguaagagcuugacuugaccuaaagggagggcucacucaucuuugcucucagcuucuggaaaguaaucuacaucauacgugacagaaaugucuuuguugaggguggagcuggcaccuucuaguccuagaggagggcuggccacacaagagagaacaacuauguugagguaaggugagagcuuuaggucaugugauacgggccaaccuggaaacuuaaaaaaaaaaaaaaaucaaccauguaaucaaucagucaaccauguaaacaaucggucaaccauguaaucaaucagucggccacaccuacacaauggggccagagugaaaacgcugcacaugaagacccgagggcccucccuugccuggcaacccuccaguccucucucucaugucgggaggcagcguguucugacuccucaagggagaggcaaagaagcuucagguuuuggacccucccagaucccgugcuucuaggcucuuauccugccuuauuuuaaucucuaucucuucccuguaacccccuauaaccaugaguauuacagagucuagcaauguugcaaguucuagcgaaccacugaagccugaaggcaccuugggaaucuugguauuagaaaugacggcuaucuugccagaccgucucuaacccugcagucuggcuuauucugagcaccgcuucaggugugcaagcgacggucccucaaaggcccccaaucuccuuucauugagagauaguacuuuccuaugggcugguccuggaccagugaaucaagccuuacugcugaaggcugggcagucaguauuucugugucuuagaacuuaaaagaaaaaaaaaguguuaucugaaaaaaaaugcagcacagcuucccagggacacuccaauucaaauuuaggauggcagugaggucuuggugagguuuuuaccucugacuguuaucucuuauacuuggcguccuggcacuccguguggacuguccuauacucucagccuacucuaugaugauugggcagggaauguggcagugccugucacuuccacugacggacucagaagcaugggcagccgugggguuaaucucagcaucaacaccacaaugagggagacaaguuauuuugcuuuuugcuauuuuugggggaggaggggcuccuagaaauagagucaaauuuuagauuacuugaaauacuuuuuuucugugugcccaugagccaagagaccccacgcaauugguuuaguugggucuauuugccuuauuuugcuuggcuuuuagaaguuagaaauauuuucuuuauuuugauuuaauuuagcuuuauaauguaagaaaaugcucugcaugguuuaaaauccaaauuuacaaaacaaaggaccggaaguaggucaguugacagaguacuugccuggccuggguuagcuagcccccucaucacacaucccuguaaaguuagcacuugggagguagaggcagcaggaucaggauuuuaagugguagagagacagcucagggguugagaggacacacugcucuuguagaagagacccugguuugacucacagcauccaugucaggcugcuuacaacaggcuauuacuguagcuccaggggacucaaugcccucuucugccuggaggauaccagagagcgcacgcauacacacacacauacacacauacacacauacacacacacacacacaauuuuaaaaaauucaaaaucauucuuggcuguacagggagcgugaggacaaccuaugauacaagauacccccgucucaaaagagaaccaagggcuggagagaggguucagugguuaagagcacuggcugcuucugcagaggacuggaguucuguucccagcucccacacaacugccugggauccagugcacagacauacaagcaggccaaacacucacacauggaaaauaaguaagaaauacaggcauauuuaaaguagauauggaguggggaggaguacgugaaaugcugccuccuggacaugacauggcugucacacucaugaccuggaagcagcuagucacccucaggggagcaagccagccggaacccuagccuaggugggggaggggaucuccagacaccacgcuuuacugcccggcuccuggaagcuggcagcacuggagggagagaagcagucuuuggugagguguuagguuucccaugcuccaguggaugcccacacccacacacauaugggcagcacuuacuagagacuugguggguuauuaaaaaaaaagauaagccgggcaugguggugcacaccuuuaaucccagcacuugggaggcagaggcaggcggauuucugagugcaaggccagccuggucuacaaagugaguuccaggacagccagggcuacacagagaaacccugucucaaaaaacaaacaaacaaacaaaaaaacgaaagguaauuugggagggguugcagcaggugggacacagugggagcucaaagggaaagacuggaggcagauaugaucauauuucauuguacacauguauggaaaccucaaaaagaaauaauuuuacaaaggggagagaagaaacaaggccuaaaacaagauacacuggaagcccaagugccugcucuucccccacugccacagugcugccuuggggcucccugggguccucuguggcgaacugcucgucauaggaaggcuccagugucagcacagucacggagucgcuacugccgccuaucugcugugacuacacgcaugcccgauggagucaggucgcgaggcugcauuuuccucugcucaugguguuaugucacauuuauuuuguguguauguggaggucagaggacaaccugaggaagucaguuuucuccuuccaccaugugggucccugggauugaagucagguugucagucaagaaucaccuuuccccacugccugaucuaauccacucguauuauuaaguuugaacaaacucuagcuuguauagaaacuccgagguaaacguugguucaaguggcuaaaccgaugaucacaggcauaacgcugcuauuugggcagacauaucuccaaaucuuagggccuggugaaccaaauaaauuauaaacuccaccccacacugucuacauaugcccacugccaccgugccugcuggagcuccucagaacucagcuuuccgcaacacuccuaucuuacaccagccucugggugauucccacagcuccggagguuugagaaccucuacucacauccugucaucuccagcccagaaucacaggcuggcaucaccccuguggcgacccucccguuguuuguuuguuuguuaagguuugaggaguuuacgcaggaacuuaccagcccaucggccccauugucuccgcucugguuuucccacgcuuugccuccuuuagcaauuccucuauggcuuuccuguugggagagagaauaugucugagaagcagacaugcacaaauuucuggaaaucaucauugcauaaccagaaccuugcugggauagcuuucuuuaaaauggcuauuaguuuccaacacaaaacuuaaacaggcccuuccuuuccagccacccacuuggacccugcagccgccgcaauauugaugccuaagaagaaucggauugccaucuaugaacccuuuuuuaaggaaggcauaauggucaccaaaaagaauguccaaacaccuugagcuggcagacaagaaugugcccaaccuucauguaaugaaggccauguagucucucaagucuagagacuaugugaaggagcaguuugcuuggagacauuucugcugguaccuuacgaaugagggcauccaauaucucugagauuaauugcaccuacccccagaaaucgugccugccacccugcgccaaagccgucccaagacuggcaggccuuggcccaaaggucuagagggugaguggccugcaagauucacaagaggggaggccgacagagacaccuacagaaggagugcugugcccccuggaacuuacaagaaagcugaggcugggggcuggcucagcaacugaauuccaauuuagaggcagcuuugguugcagacauggucagccaccucagugaaguuggagauuauguuguauugaauaaacuuuaaagaaaaaaaaaacuuaaacagaaacugugucucccuccuuccguguguguguauguguguguguguguguguguguguguguguguguuacugaagaacaagccuagagccuuacagccuuacauguuagguaagcacucuaaagcacucuaccacagaacuauguccccagcucagaaaaagaaguguuuucccuaggcccucuuggcauacguaacagaugugcagcuugguuuucaugugagacuucuaacaacuggacugccuugucuggccucaauaggaaaagaugagccuaguccuaaugcaacuugauaggcugagggcugauauccauuagaggccucuccuucucugcggagaaagggagaggguauaagggagggacagggagaaggaugaagggagugggagaggagggcgaggaaaaacucugauugggauguaaacuaaauaaauuaauuaaaggaaguguuuuacgagggaggagacaaacuagaaauugcaauauaaauuauuaaguuauauaucuuuaauauaagaaaucuguuucaucuuaauuugaaaaacaaccaaaauacaggaauugccagaugugugugugugcguuuauaauguuuacaacaggaaagaaauggcagugcugaggccacagcucaaaaaugagcgccugccugccuaagaugcaugaggugcaagggccagguuugguccccagagcgcucacuuugccccucucccuccucccucucccucacacacauacagucuagccaggugugggagauuguugugaguuuggagacaacccagcucugucucagaaaacccaaaauaacaacagagaccaagaaacuaaacaagccugaaaaugucaguuaacccaaacaaugauaaauauuucugcccaacauuaaugaggguuuccucuuuucuccacucauggcuaggcgugguggugcacaccuuuaaucucaggacucagaagucaagcagaucugaguucaagucuagucuggucuacaaagguucuaccuuaaccauuuuaaaacaaauccuagacaccauccugcacucauuuuaaccaugucugcuaagacgguggcugagccuucuguagagaggcugcaugccugucagaaccaccuagcaccaaagucaacgaaauuggcuuugagauaacuggggcccuguguuucuuuugagcauuuauuugcauguguguauacuagcaugcacgggaagaucggagacaacucucaugagcugcuucucuccuucaugugaguucuggggagcccagucagaucaagguugguagacuuccucacagcccccccccccauuucuugagugaaaugauauucauuuaugcagcaguaaguauuuaaggcaacuaaccaaaggagaaaaugaaagguaaauaauaaagaacaaaggaaaaagagaauucacaaggacuaaagucacaauagcuguaccucaaaucaguggcucggaaccgagucaggugaccugcagacaccagagcugagggacaagaacacaagggacacagugcuuggugccuucccaagucuuuaagaaguuaccuuugaucaacuaacuaugaaguacaggauaugucacaugguggauggaaaaacagguucagauaacagacauguucuaacaagcagggguuggugacaaaacguaggcuucuuagggaacuggcaggaaccugcaccauucaccgaugcucucugacaggcccuggccauuaccauuccucaagucuguaacucagucaagcacgugugagaaccuucugggcagaaugcucgagaagcugagcgaccauagcagccugacccccuucccacggggcagggaagaccuggaaaggaagcacacaguuggcuugaucuuccaaaacggccggaagcccagagaaaauucugccuggaaagugggagggaagcugggugugauggaacaccuggaauccccacacuagagucucagacgagaggaucccuguaauuccaagggccacacagagagguccggucucaaacaaaaacacaugagcagacgacuggaauuccacaggacaccugcaaaaugccacccacagcuucuaaggagccagcggugaugaguaguuuaguggcacggucuuguggaucuguaaacaagacacaguacuggcucuucaugauuuacugucuaaggacacagaugaagaaauucaggauaucugaauuuaauuucagaaaaccauucgauugugugggagcaccugccaacauccaaggaagaaagucuacauugcagagguuuggaaaacagguaaaacucaacuggaacacuggggcaguuauauauaagauuaaggucugggugugaugaccugugucugaggcccuagcauucaggagcuugagagaggaagguucggugcacggagugugaggccagccugggacacacaauggcacucugccuaaagccaugacaaaggaugaguggaguucugggaaugagcuuugagcugacggagguggugcacuccuguaaccucagaaggugacaggaggaccaguuuacggucgaucucagcuauaaggauguauguaagacccccagcucauaaccgucucaaaugacaagaggaggaggcauggaauaaguuguacuaaauguagccauuggcugguaaauaccacagcaacagaaaggaaaagacacagucaaguuggaaagugucuuauccccaugcccuccacagccuuucacagcagcaaaguuauaacucgaccugggcucaucagugaggaaauggauggaccugugcacaggagcucugcucagccuuaagaacagaaggaaauacugucuguauaccgucccugagacagcacagacacgacgcugacuagggaaaugggaaggugcuaaagcacaaauauuccgucagcuuacuuauacuggaagccaaaacaguuuaagcuaagaagcgacagcagaaugucgcuaaccgggucuguuggagggaaggaaggaggggaguuuggggagaugguacccaggggaagaguucaaaugagucaaugggcggaguagcgacuuuaacagcuagcacuguuaauccuugaagaucucaguguucuuaucacagaaagaaaaagcaugugaagcaaugugcaagcuaacucucuugacuacaccacugcaguaucuacgcagaauaguagacaagcgauggcauggaaguagaagcuaacaagcagcagagcacaucccugggugacgacaugggccagagaccaagaacggccacaggcccuggccaagcaauugacugcaguauaguggcagaaaccacaccacaccacugauccaagugaugagaggaauuacagucagaugcaaaaugaggccaaguagaguucuuccuuccaugcuagaggguuuugauccucuagggcuguccaaaagacucagcaaggaugcacaacuagaaaacagccuuuuccuagggagcaagagacccaucagagagagcaggacccuacuuugguuuggagucaccauacacaagcagaauccucauucauccuugcaggcccuccucagaccccagcuccuagagaugcugcuauugaaacggaagcaucagugucgguuagcccaucagcgcagaagccuaacugacagcagcacugugacugcggaaccagcuguccugaugcucuuagaguccuggaagguggcacagauggugacagcagguguuaaagcacagcuggucagggcugaugaaacaucacaggaaagggaagggacuugggucccauugucccuccaaaggguggaggugccacaccccaacuuccaccaacuccaucuccuauagguuccuccaccucucaaagcaccaggcugagagucaacccuuuaacagacggaccuuuaggaggcauuuaagaugaaccuuaguguauacugagucauguguaccuccaaaaccacgaacuacaaggacaagagaaggaaguugggcacuacugggcaauccucuucucuccuuucuuuuuuucugagauugggucucauuauguagguucagcuauucuggaacucacuauguagacuagccuggccuugaauuuacagagauccaccugccucugccuccugagugcugggaucaaaggcacacgccauuccauggggccagaaauguuuucauaauacaaagcucuucucauucaaggaugcaggucaaaacacaucaugguguuucuuauguuaugagccacaccaaguacagggccccgaugauagcaacacuacauuggaucugugaggcuacccacuuuguuccaggcacuuuuccuauggauacugacauaauacaaaauaaugaccauaguaccuaugcacguaccauguaccuaugccuaacccucacagcuucucugugccgacccauagagaaggaagcaaacccaggaggcuucaaaacacgccuacugucacaauacaaguagguaauggugcuugugauauaaccagcaggcugacucuaggaccugggaucuugacccugucaucacaguucuacuacaagguguggaaaaccuccagaacuuagucuacagagggagccacguaaagggaugugugugcguguguguguguguguguguguguguguguguacaauuuaaacaucuaaagugaaacaccauggggacaagggaccugggcuucuguguucucagucccugcagcuacucacguuaggugacggcugagagggaguuauuaccacagaggugacuucuccagucaacaguuugugugggcugauucuuacuaccucagcguuuaaaaggaaacacuacucaguuuauaggccaccugcuugaugugcauauguacaaacacugaccucauuuucaaagcagaagcaugcuuacaaauacuuaccucuaaaucaugauacagagaauaggcauuaguguuggcuuccuauuguaauaucugaguaaacaugccauauauaugcguguuuauauaaagaaauaucagccaggcaugguggugcacgccuuuaaucccagcacuugggaggcagaggcagguggauuucugaguuugaggccagccuggucuacaaagugaguuccaggacauccggggcuauccagagaaacccugucucgaaaaacaaaaaacaaaaaacaacaacaacaaaaagaaauaccucuuacugaaaacugugaggugguagcaugggguugcuuaggaaauaauaaacucaaaauagaaaaguccauggauuauauaacccaucuacugauaggccaacugguaaguugaaaaaauauauguauaugcccuauugaaauauuagcugggagaaacauauccaaauagagaaauaaggucaaaauaauuauugagccuuuuuacucaacgaaaaguauuugcuuacucuucaagaagacugauaaaacaaaauugugccgacaaaaaaaaaaguguguguguggggaggauuuauagccuagaaaaaugaguguggaggggagccaauaucuagcgcucccugcccucaaaugcgaacagcuaauauggcagcugccugaacugagcagaggcuaggaaauggcuaaugacuggaaagcagagacaaaauaaaagucugacuuuaccaagcagcagcucaauuccaacaagaaaaggguacagaaauuguacuuaagaaaauaccacaaggaaaauucucucugaguuuccuaccacagcucuuguaaacucuggcagaaguuuggcguauuccuuugauaaacauaacagacucaagaaaacuaccucacagaaagcugggucuguguaagucacucucccaauccuucaagagcuuuguucuccacagaggccugcagacuguccuaagugcgcugcagagcucuuggcucuuggcguugaggauggcaggcgguagaaggucuggucagcuugccggggcuguuuuccucagugugucaaggcuguggcauacgcuggaaaacaggcuguccaccccacagagcucagccacugauucaucgggugaccauaaauuauacccagagcuaaaagcccaguuauggaaaacaaugaagauaagagagcaauccagagccacaggcuccuuaaaaagugcuuucauguuuuaacacauguagaaacuagucccuugagucugcuguuuuuaaggaaaauaauauaccuaucacuaacugagcugugugguuuuuaacucagauauaaaauaucugaacaucuaacauuuuaaguuugggcuggaaagaugacgcaucaguuaagagcacuggcuacucuugcagaggaccuaggcuugguucccagcacccaaagggggcagcucgcgcccaccugugguuauagucaccaggggucuaacacccucuuaugggcuccacaggcaccaggcacacaugugauacacucacacauccaucugcuggcaaacacucguaacacaauaaagaaacaaacaaacugaucuuuaaacacaagucuagcaguacaccaugagaagaggaagcuggcacacuacagaggucuagagcgaucuagaauaucuagaagaagaucuagaagaggaagcuggcacuacagagguuuagagcggucuagagcgauggugaagagccucaggaacugagcacgggggcugcaccagagccagggcucauggauugccaggccaccgggcacuuccaucuuccacacucuaggugucaaacacugcuuugagggauauguuaaucuccucuacaaaggcagcagagauuaacaaagcagaacacauauacaaauguuuuccacaccaagaauuaagcccaaacuucuacucugccaauaauuuacuaaaacaagucagcaaauucuugacuccuuaagcucugcugugucaaguuucaguuguuauuccagguauuaacucauauagaauggacuuaaguagagcaaggcaacuccaaauccccuuucacaacuaagaaaacguccuacuuaacacauaccaggguuuggagagagaacuccuuuuccguaacauaguagguuaauagaauccagaagcuggaaacauacacauaaacagacacacacgaccuaacuuggagccgaguggcccuccaaagaugagaacuucacagaacugaaguagcccacugcacaaguggucaggacugaaaaguaaagggauauaaacauuuaccuucaagcugaggguugcugugaggcucugaugcaaugcaaauauguuaucuacacuuaguucaauggcaaagcuaguaugguggcucacaccuauagacccaaggcugagccugaaggauagcugcaagucugaggccagccugguugaugcagugagcuccaggccagucaggucuacacagugagagccuuucuuuaaauaaaaacauaaacaacagacaggauucagagauaaauaaaagaaaggaaccggcucaaguggagaagcucaaggcagaagaguccaguagagauuacaccagcuuucauggcucuaucccaucacacagcagcugcuaaccagaagaaaccaccagggcaaggcacucaguguugggacaucagaagccagcaguacgacaaccaagacccagcacacacuaaaguaguacucuauaauacauagauggcgauuuaaaagguuaaacuauuucaacacaaucuucuagcccuucauuaaagccacacuuuaaauagcugugcauccuagaacaucuccucuauacucaaacacgaaccguccuucaggcagagcagcagcugcaguugaaugggauggagccaugcuagcaaggaguccaggaugggauuaaaaccagaacaggugcacagcggagaccacggggggaacuucuucuucuucuucuucuucuuuuuuuuuuuuuuugugauuuuccauaugauuuuuuuuccucuuuuuuuauuagguauuuuccucguuuacauuuccaaugcuaucccaaaagucccccauacccacccccccaauccccucaugggggcacuuguaagugaaagagcacacuggcuguuccaacaguggaguguggccccccaagucgcacacuuuugugcacacuccuuuucauggcagugcuuggaacugcucauccuguuauacaccaccuggaacacaacucacagaaacaggccaucgaucaacuuucuguguucgucccuacauacacuguguuucaagaaggccccaaaucuaaguauuuauaguuuucuguuuaauauaauuuauagugagaaagccccagaugaagcaaacugcucagauaaagacccauuaaauacacugucacacguuuucauaacugcaaggugaaagguacaugccaccaucagagcugaguuagcgugacugccauacaaggccaaggagauuaugguuuagagagguuaacuuguccaagauuaaauaaguuccugacuggggugauauuuaaucccaaauuuguaucacucaccccaccaagcaagaauggcugccaagcacgcuagggagaagccucaaaagcaccucacugugacagcgcagcgcacugucaucaccgcuaaggacaucaacacugacucaguguuguuucacacccacuaaggacacccugaaaaacacaagcugcacagcaaacuuuccaucugaaaaacgcacacugagaagaacuagccaauuacuggccuuaacgcgcucucgaugcucugagacgaggaaccacacaguuucuauuagucuugaacugggaauauacugagauuaccuaagaggagaugguaucuauaacacugacuagacaaugagucccaguugggcugcuagauagcuucaacauaacuaugaaaucugcuaaauggagacauuccuaccaggcuuuuagagcuucuaugggggguuaaauguaauuauacauauaguaaugcaacauuaaggcccugaguauauaaaaggugcuguuuugagauuuuaaauaacuacuuuguagguauaauuucaauggaguauugauggcuguacauguguuaagaaaagcacacacauauuucugauacccaccacauacacagugauuauagcaugucacuucauggacucccagaagaacccuugaucuggcugucccccccccccccccuuaguggugaacagcuaaugcuuuggggcagugcugcugauaugccuagguuaacaguaaggggcaaagcucugaccuugugucuguacaacuuucuuauuuuuacucauucaugaagauaaucccagcauuuuugaggcuguucaagagguguuuuggagaaauauaagugaaaaaguuaaaaugaauucauuuaaagauggugcccauaaagcuuaauaagauugaaaaugugcauuuucacaaacugaguguuacuauuaaagccauacaaggguucugaggcagccucuaagccaccggccucugcauggcuaagacucgcuagcugucugacuucagucagcucccuuaacuuguacagaccucgguuuccuuucuuagaggugggaagccaucaacucugaaaggaggguuaaacugguuucccuacuugagucgguuucccucugcagucagagcuacguggugggaggccaucugcuuuucgcuagaaauaagccgaguuggcuuucucaagucuuggcuugcugggaagcacacagcucagagaaggcuggcccacugggacaggccaacaggaagggaaccuucugcuuugccugccucaagucugggcagcagacagggacacacccuuaggcugacaauucuaaagacaagacauuuucaaucaagguuucuaaucaucagcuucuaaagccccccaccccccaccccauuucacuauccauuuacggacaaaguauaaucuucacauggagacagaaauaaaauuguggcaucaagccugagagcuuagaucacaggaucugacacagaacguaaauccaacucauuuacucugacaaagaagaugauggcccugcuccaugccucaucuuuggaaugcagugcuaauugaaacuuaugucuccaauuucauagauuaaucacuuuugaagaaaaauccugcuaaguguucuuagcaccaagauuuaugcuuaaguacgcggaacaguguaagcgagcagcccaggaucugagaccacuuuaaaucuccucaaugauggugacccuugaacucugcguuccaauuacaacuuauucugggaucccaguugguuagaaacuaacacuuaugcaaugcugcucccagaagacacagguuauuaaaugaaaacggcagugcaaggcaugggauaccucccuacgaguuauuggugaggcaggccccaaaggucucuaaaacaacacaggcuauuaccauuguccuuggcugcccuccauaauaacuacaugcuaagacccuauuuggcuacaggacuaggaaaaacagucucaaccaagcaagaaauuuccuuccugcuggcuagcauuccaugucagaaggugcuaucuaugcaggcuguugggggagaaaagacaucaguagcuuuacccagcacuagauacugccugccauaaugccaaccugccuaggcaagauggaccuguuagugcaaucguguaguacuguuagagggucauucucauuuucugauuggacuugagggccauuccacagcaagaauuucaugucugguacuuuaaucuugguuaaacacccauaacuggagagaucauaggcacaaggguagaacuugcuauuuuuaguucacugaauuguaacauugucaaauugcuuucuagauauuuauguuuauagcaacauaucugggaugcucucaaccuaucagaaaaguuucuuuuuugcagcaggcagcaguccaugcagagacacauuaacugaucaaaacgcugagacugagcguucagccccaacugggauaucucugucaugagcaccccuggcuccggagagcucagggaauaucuugaaaggagacagagagaugucagagcuggaggacagggaggcgugccgugagacgcugcuucuggacaccacacggcuauucacucauggacucgcaguggcugugguuauccacgcagaaucaagccagucaggaugacggcacagcugagagcaggcacucuccaggccucgcuguuaauguggagccacuggcacuugccagcuacuggggaaggaucucucauguuccaguggacggcccccacagucaugcauggucaguacagauagacuggagagacuuaguggguuaucaaaaaauauaucacauggaguugggagcagagcguguuaggguaauauggagggguggagggcacauauuucauuauauucaugaaugacagucucaagaauaaagaaaacuuauaauuaaggcagaaaugaacaucuauucacuaaauguccaugaggaugcaagggagggauuuuucgagacaggauuucucuguguagcccuugcuguccuggaacucacacuguagaccaggcuggccuugaacucagaaaucugccugccucugccucccaagugcuggguuaaaggcgugcaccaccacugcccagcccuauucgucuuauuguaagcaaacguguccaguugguaagacaaaugcccaucacaaauaccccagaggauucuugguuuuauuuuucauaaggcucaagacuauaucuaauggauggaauuucugaaacuguauuauaaugcaagggcaaacuaacauuugaguaguccuacaaaguuugucaucuuguuuuauuuuauuguaauauuacugucugugagacuccaacucugagaccagauuguguguguucaaagcagaagacgcaacucacaaguccaagugugcccucaucucagcucucgcuaacgugagcuacucauuuacccauccuccugugcucaggcuggauucaccuaccuggcucugcccaucagaucugcccgaauccuauuacacggcuacuucccugacacucuuugucuaaccauggccacccuuuaccucagugaacuccuggaaaggccagucucuuauuguccauacgacagacuauggagcuauagacauguggcuacaaacugacccaauaguuauuccaaccuuugaaauccaaguucagcucuuugagauauuuaauaaggaaaaaaaaaaaaaaaagaguuccucuuaccaagcauucacuguaggccaggcaguguuuuaaggcacuaacagacacaucagugaacauucagauaaaaaucucuacacugaguuuuaugcuacagugaacuggauugugugcaaguguguguguguguguguguggggggcuuggauaaaaggaagcagccaauaaauauguaaauuaucuguauauaguuaucuaacuaucuguauacauauauacacacacauguauuuaaguuugaaggcaguaaguacuauaggggcagagggacuugcagggaggagcuuggggaaacagcuugcaauuaagaguuagaagaaauggggccgggcaugguggcgcacgccuuuagucccagcacuugugaggcagaggcaggcagauuucugaguucaaggccagccuggucuacaaagugaguuccaggacagccagggcuauacagagaaauccagucucaaaaaaaaaaaguuauuagaaaugauaccuagcauucugagugccuccuguacaccgcgaugagucaucaacaaacauacucuugucuuccugaugaguaugcgacaucaugucguuaggaacuaucagucuuuuagguuguuuccuccccauggagagcuggcaaucaucacacacacugucauccauucacugcacaccaggcacucuucgccuccacaguuuauaguuaaagagacgauaaacaaguccaucccaacucacugcaugaugagaucugugaaggaacaaacuaaggaaaggccaucaaaguaagguuuucuugaggauguaagaugcuguuugagaggucacugcaguaggcagccucuaaaguggcccugugguuucaguugccaacguuuagaguaauccuggaguaaccacuucugcacugcggccuagacauacugauucacauuuaccagugggaugggugaggugucacuucugagauuugggaauacacaggacagccuuaguguagcagugcccccuuuugacuguaguuguacugggagaaacaagcagccaagguuaccaggcagucccugaugucagccccggacaaguccuccuccaugcaagccccagaacugcagucugcagucuucucggagaccuugacucugaagcacuuggcuaagccccaccagcauuccugauccacaaaaugcagaaguguuuguuucccgucccuaggucuugggguaacuagcuacauggaaaugggcgaucaacaccacagucaaggguggugucccugagcaaacugccuugcagugcagaccauaugaaaggguaagggaagagaaucuuaggcaagaaugggacaagggucaaagcccugagacaggaaacaagucaggugucuaugaaagaugauugccuauuuaggggaucuguugcugugaaacaccgcaugaaacaccaugacuaaaagcaacuugggagaaaagggucauucagucauaguuucauauaacagugaaucauagaacacagcaggagccuggaggcaggaggcaaugcacaaaccacggaggacugcugcuuacuggauuggcuugcuccuuagaacuugcucaggcugcuuucuucucucuuccucuuccucuuccucuuccucucucucucucucucucucucucucucucucucucucucucucucucccuuucucucucuccuuaauguuuuguuuuugagacagagucucacuguguagcucuggcugucuuggaacucacuauguagaccugacuggcuugaaaucacagauugauucgauugccucugccuccuaagugcuaggaucaaagguaaacuccaccaucaucaaacuagccagcuuucuuauagcacccagaaccaccaggccaggagucgcaccacccacaaauagaugggcccucccacaccacuaauuaagaaaaugcccuacagccugaucuuauggaggcauuuucucaauugugagucucuccugcaagaugacuacaacuugcaucaaguugacauaaaacuagccaggccagugaccgaugguagacaguuacaaugacaguauggaaagaugggacuuaagccaacccugauauucccauagauaacaagacacagccuguggaugccauuaguguaaccaccauuaccuggauugacugacuaccaauacaauagaugacaucugagaguguguaucuuguaaguacugugcuguuuuaauucauuuauccuuuauaauaauccuaccaaaugaguguuauuauucacccaguuuauagauaagaaaaccagagguucagaaaagccugggaagugguagggccacaaggccuucucaccucaguucucaaucuuggcccuuauagaauacugaaaaaggacucacagagaagacucuccucuugaaaagggaaagaaauccaaccucacguagcuaagcaaccuggcugccucuuccucagauguucuaagcagauugauuuucucacaggcucuucacacauauucuucucucugucucucucagggucuuucugcacagcacagacuagacuugaacucagauuccugccugccucggcuucccaagagagcugggguuaaaggugugcgccaccaugcccagcuggaacuuuuuugaugcagguauaaaauauuacuuacaacaagcaggaauuacugacugaggccuacauauggucuacuuuacgcuguuuuaugcucaccggccuagauugagcccuggcuuccaaccaacacugcagacagcuggcgcugcaccaggcgcucgucugcugcaggccuugccauucccgccucauuuccaaguguggggaagacugugaauguuccagcagucucaauuucuucaagagagaagaaauccaauccacuucuuucugauuguuaugcauagucuauuaauagggaugcuauuucagaauggcuuuucuuauaagcuugaacagucugggagcccaccagaccucuuuacagugcucccuggggcuaaagucacagagcuacugaguuuuuguuuguuacacgauuuucacucaagaagauaaacaaaucaaccagcguguucgacauaccuaacaauaauguguaauuauaauaaucacaguaacugcuaaugucgauugguaacgugcauuuauugccucucugugccauuagaacuaagcugcaugcaggccagcuuguuucccgcuauaucccugugcucaauaguuauuuaagaaacuagcaaaauauucuuuuauauuuugaaggcaaggucuugcuuugugacccaggcuggccucaaauucuccauucuccugccucagcuucucauggacugggauagcuuuguauaccaccaggccuggcugguuuccguugaagagaccaaccuagugucaacggccggcagcagucagcucacuucccugacccucucucuuucuaccucuaguuuuuacaccuggaagcccuggaguugcauccuuuuuaaaagaugccaauuauucugacauguuuggcaaggagauagauuuaaagcaguugaaucauuuaacucuuauuaguaggacaggcccugggagagguaaaucuugccuuacugguuuuugguugugagggaguggcugaaaagccucugacuaagugaacauggauauaggcuccugagaaguuuguguucucucugcaucuuuaccauacagaaucuaaguuccuuuucuagaaguuucuuguauccggugcucaagucucuaguccuacauuuaucuauguugcuagucuaccauaccugcucuauuaaauggucugaacucacugcugacucuacuguucucuccacacagauacgggaugcacaccagcuuguggcaugcacugacucaggacucauuguugcucccccccccccccacccccaggugguagucaaguccaaaccuauacaugcuagggcaaggacuguacugcagagcuacauguggagcuguucccauggugugagcguggucucacugagguguacaggcugggcuuggauguuuugcuguaguccuggcuauccgugaccuugagacccuccuacaugaguacuacuaggcaugagagagagaccaggcccagcuaacagcuccuuuacauuaggaaagaggaaagccauacaucucugaacacuggucuucuuucacaaccuacuaacgaguauuucccgaguuccuggaaagcagaacacaccugccuuguucgcuguccucagugccuagguucccaucccaagagcaggugggagugcacaaacagugacugccucaauccugucuuaucuguuaauuuuuaaagauuuguuaauguauuuguauauaacgagagccagaagauggcauaagaugccauuauagguggcugugaauugcugggaauugaacucaggaccucuggaagagcaaucggugcucuuagcugcugagccaccucuccagcccuuaucuguuacauuuuauguucuauacuuaccuaugcaacaccacacauuaaaacaaagucuuuuuccuauguacaccuuauuugccccauccaaaccacagcaggcuuguuagaauggacucauuagacucucucaucacuauuucucaggauggugcucucaggccuuacuugcuguguagauagugugagguccagugaaggcuagcuguaauaagcacuccauccuugaaauaaacagacccaaacagcaacuguaucacaugucuuauaaaaucuaagcagcaaaagaaaauacaguauuaagaauuugaucagaaaaaaaaauaagaaaaaaaaaaacaguaaaaagagccgggcguguuggugcacgccuuuaaucccagcacucgggaggcagaggcagguggauuucugaguucgaggccagccuggucuacagagugaguuccaggacagccagggcuacagaaaaacccugucucgaaaaaccaaaaaaaaaaaaaaaaaaaaaaaaaaaaaaaaaaaaaaaaagaaaaaagaauuugaucagaaaaggccagaucuggaguuauuacagaucuuugaaaguaggcugguggaacuagaggcaucucuuggggacucuauuugaaggaugauccaaagaucauuggaaucuguaaacgaaguuaaccagaaauaugacuuuugucuaaagaccuggaagacuauaaucuuuuaaaaauauauauuuuauuagcugagugugguggcacaccuuuaaucccagcacucgggaggcagaggcaaauggaucucugugagucugaggccagccugcucuacacaguaaguucuagcacagcuagggcuauguagagacccugucuuaaaccucauccucaaaauaguucuuuucaacuaaaaauuuuuccaucucuauuuugauuuacucuuuuccuucccccuggacacugugaucuuaauaaauaaacugaaaagaagaguaaucaaucacggaccaaagaauccaauacgcuuuccuaucuccugaagugcaagaugcucugggucacaacuaaauggaucacuuuuuauguagacacuuuuccuucucuacagagauacugcacaaaccuguauuaugccaauuaauuagggcacuuagaugcuacugcuauacguaauuuagaacuaguuuguaaagugcuuugaaaauggcaagugcuaagccagauacucagaauuauuagauauuaaaagccguuggcauauaggcauaguauuuaaugauuagcucuuucgagggcacaggauuuuacggccgaacagaacuucugaucuugaaucauuaacacuguagugguuugagcucaaugucauuaaggagcaagcgagguagugagaaauuuuuucaguuuauauaaauaaauaugauucaaguacaagucugucucccccauucucccuguccuuucuuucacagccuuggcccagaacucacuauauacauuagguugucuucaaauucagaguucuaccagccucugccugcagguauuaagaggacgcaccaacaccccgaggucucucucagcccucuagcuccuacagacagcacaguuccuuccacacauguggcacuccugauuacccuauuuuuccccugaguccaucugccuucuacauuuuuaugugagccuguuuauggccacccuaaacggauuuacaguucacugucuuccuuaacuggacucuuacaccuuccaauuuuccuacuuguaauggccguguauauuuuaucuuuggaaaacucaaaccaagccauuccccagcagaguccuguccuuaggcccggaugaaaucggcccacagccagcggccucugugcuaauuccaagggccuuuucucccuccgucucggggcugaguuacucagcaucacuuucccuggcucccacagcuucacuugcagcagacuucacugucucgucaguuauucuuuguccuugcuugcucacugagguugccugaggcuuggcucccagcuccuuccuuaucacuuucuguuguaacucuguggacuuccaucuuuaugaucaggacucaccaaguuuacuuuuggcuccucacaacacaacaguugacuuguaagcuccuuguauuaggaacuggcccccauccuagaugagagauagaaacaucugguucuguauccuccacaucccguuccuagggcuucacccuucucccuauugucgucuaucaacauuuugggccacuucuggucacaucccacacuguaauugaaauaacacaucacuccagcccuuuuccucaacgaaucaggagaacgggcccgucuccuuaucugcuauacuaaaucaugcaaaucuuucaguucuccuacauuuagcuucuacuucaggaccaguuucuguugucguucccccccccccccccaagcacgcauuugcucuccacucugcauagccaccuccuucuuguccugcaaucucuggaagaccuucccugguuucugugcucaaagcagauacuucucaaguucucuaucuggccucguauuuguuucuuucacagaacuaugauuuaaaaaauuccuacugucgagccaggcagugguaguucacgccuuuaauccccaggcaugggauuccaggacagccagggcuacacagaaacccuuuuucaaaaaacaaaaacaaguuccugcaguuaucuguuuucaaggccugguaccauccaggcacucaaugaguauaaaaguaucuuuguaaaaagcgggccaaguauaggaaauacaggcucugacagggcagaagaggucaaauauagcuuaaagguucuuuuuuuuuuuuuuuggcuuuucgagacagaguuucucuauguagccuuggccuuccuaacuuacucucaagaccaggcuggccucaaacuuagagaucccugucuccagaguacugggauuaaaggcgugugccaagaguccuguaucuucaguauaucggugguguuuuucugaggcaagcucuuguuaagacagucagucuggccuucaacuugcaauucuguuugcaucuuuuuaaugcuaagguuacaggcagacaccaucaucccuggcagacaaugaaguucugacugaagacaagcauuacuaaagaucccaaagcaacaaagcucuagagcgugaggugacucugcucaagggccggcagauauuucggguggauuaagucucacuuggguaggaugcuuacaagacaggauuaaggagagaaaccaggugacucuuggaugugauaugcuuuguuaauauuucaaguuucccaaaaugucauuucuucuguacagaauucugcucuuccuaauccugacuuucuaucaaauauuaucucuucuauguaacccugggcucuauuuaauauaccuaccuaaagacugcaauuguuaccugguaauuccaguuuucccaaugauuaaaguuagagcuggcgagacagcucaguugcugaagcacuuguuacaaaauguaaggaucugauuuuaaucuccugaacuuaaaaguugaguagauuuguuaagcucgcagccaagcccagugcucaggagacagauauaggugggucccuaggguagucuagccuaacugacaaaagcccuuaacccagcuugugagaaacuagggcaaaggcaagcuuaccauguguguucuaagucagccagggcuaguuaguggaacugccucaaaccaaccaaccaaaaguaaguugcuggcuccugaugaaccauccuuauggaacuucuggccuccauaugcauacaugcauaugcacacaaacaugccugcacaaaaccuaauaaaaauugguuuacucauguugcaccuauacauuucauuaguguucuggaauucaagcaguaaacugacaucuacccuacuaaugcuacaaaguagagccugauaccaauuaaaauucugaagagcacuucauauuaucuucacccuuaagguagucuacuaaucguaucaaaagaugcauuuucauuaguuaaaaaaaaaaaaaaaccuggugagaugguuuaguggguacaggugcuugcugccaagcccagcaaucaccaaguagcuccgauaugguggaaggagagaagagacuccuaucugugugccauggcaaguuuguguacacaaauaaugaguaaaauguuaaaaaaaaaaauucaagucccucugccagucuucuuuccagcccuucuaguuacagucuccugggucucguucuaugucaccucuccuuuccuuagcaccucaaucauauagaaauaaagagacucuuuaagagcugugaucaagcugggcguggugguacacgccuuuaagcccagcacuugggaggcagaggcaggcggauuucugaguuugaggccagccuggucuacagagugaguuccagggcuacacagagaaacccugucucaaaaaaaaaaaaaaaaaucuaugaucaaaaccccuaccuuggcccaauuaucuguuugcucacuuuuaguguugguucaauuaagagggugacaccauccuugggguucaucuagguucaaggaagagaaaccacucaaaacuaguuuaaacaaaagagagaauuuauuaggcaaauauacuugcagagauuccaacagcuguaugggucaauagcuagagccacauuuucuuuccuacaggacaguacaugcugcaaucacaauucuggguucugcaccauccugagggugguccugcuuguacccugcacgagggacuagaaugugggcuccuuuuugcuugccuuuuuagcuuuauaguccuuuaugcuggccucaaacuugacaagcacaugcuggcagacauucaagagcucauucaggccuuucugaaacggcucaacagcuggaagggcaccccgggucugaauucgcaaauuaauuuugcucucugaaggaugggucguaguguaaccacaaaauuccacuuccggguucuucaugauuauguaccgcagacaguuuccuaguguaugguccuccucgugcaggacaaaugucacacacugucuaucuguuccagcugccuggaccauuuccagggcugucuuccucucgccuucagccauugaggucuucaauccugauauuuuucuacacacauauuuuuuuuguaagaauaagaucacauggaauaucguuuucugauuaacuuuuuaugauucacugccucauucuccugccuccacacuucuagccauagauauuuaacuccaguuuuucccuacuucauuugacuccagcaaagagggggaggggugucaucucagaaaaaaaaaaaaaccccaccaaguuaaauguuugcaaaaucuuucuugggauagagcaaaagaaaggggcagaguuacaauaggguaggcccugcugcaagaugaaaagggaguugacagguauaaaaaacacgauuacuuuagcauaaaaauggcaaccacaaguuaucaggguggcaggcucaguuacggcucccauuugaaagagguaaggaaacuacuaaguuaaaggaagugaaaaguuuaauaggagggagaauuugguggacagagagaauuuacgagcagucugcacagagcggaguugcaguaacuuuagccaacuuaaacacgccaggcccgccacucgggacggcuggcccggugcgugaccuuacaacgaggcaguucuaaugggggugguggcaguuugggacuuacagcaugauucccaacuucucuccccucccggauggcuagcaucccucugggcuuuucuguuacaaauaaacccacggcuccucccucuucccaacccggcccgcucuacucucucuccuuccuuccccagcgccuggggucaggccuagccgccacgccgggccgcagucggccgcgugccccuucgccacccgcuucgcuggcccgacccgccgccccacuccacucuuccccuccacccuuaccucuccagcuccugaucgucuuccaucgcgggagguggggguggcggcuccaggaaauccucagguggcgcuggcgaaauggaagcucuuccccaugucgcgaaaggugcgggacaaggcaggaaggaagaaaccaccgacggaagaagcggaugacggaaggaggggggcggagccgcagcggcgcggcagggcccucugugggcggggcuaaaccgggucccgcccccgaccacgcccaggcgcgggcaggacgguucaccuggaacugcggaagcuaagccagcugccgggcacagccagccgguccccaagugccacugaagagcauaggcucucaccugucgccccgagacaccugcuauuuaaaaagagucagagucggaucucuggccugcuaggcucuccaggaacccgacugccccagggcuggcuauucccaggacuugaguccucaggggccuuucauggggcaccuugaaaaagcagagagacuguugugcagagaugacucuccugacgauacuguggguuuuaaaaauuuuucucccuggggugcaaauguacaucuccacuaggugcaagggcugcgauggucuuucuuuugcgagagaagugagaguuuggagcaccgcccuccuuccucgggagcucacgcugugggacuggcagcuccuuuucccuuugaucccaaggaaccgcccuucuucucaggugcauccucccagcucccaccugacccuggccaggcuggguccccgccccacccagcuguccccucgcccugcacaccuacacgucagccgccccccgccaccuguucucccucagccuggucccgcagcccuccccucccuucagcugucccacgcccggcgcggcgcuccaggggugcacgcagacacuucccgagcguuuucucugugugucugagagggagaauccggccgggagcgauggcggagggcggaacgcgcucacucua

SEQ ID NO: 2807 - RNA, 2254 nt, Mus musculus
gccagcaccucgcccgcuccgggaggugcccgcagcagcagccaaggugauuccagcccgggcuugagccgcgcguggagccuccggggcccgggaagcugcggguggccgcggccaggggaagcuacgacaggaucugcaguucccucgggcuccaggggcgggcuggcggcagguggaccgcgcgccggagccaugccgcgcuccuuccugguggauucccuugugcugcgggaagccagcgacaagaaggcuccggagggcagcccgccaccgcucuuccccuacgcggucccgccgccgcacgcgcuccacggccucucgccgggcgccugccacgcgcgcaaggccggcuugcugugcguguguccccucugugucaccgcuucgcagcugcacgggccccccgggccgccggcacugccgcuacucaaggcguccuucccucccuucggaucgcaguacugccacgcaccccugggccgccagcacuccguguccccuggagucgcccacggcccggcugcggccgcagcagcugcugcacucuaccagaccuccuacccgcugccggaucccagacaguuucacugcaucucuguggguaagcgggguccccgcgcgaaauuggggggcgguggucccgggguggggggaagugagugagcuagggauggggaaacggcgcgcuaugggggacggugaggauacucgaggggcgcucacagugcuagacugggaccggacguaggaaccggggagaagccagaaagauccuggggcgaaggggaagggguuaaggccagcuuugagauguuccuuaaagggguguuagggacaaccgauuccgaggagaauuggagucugugacuuggcaaggaggcacccgccuguggagugaugaauggaaggauggaagggaugugugccugauuccaagguugaggcuagccucaguucagcgggaaauuaggcccaaggcucagagguuugaugaucucucucucucucucucucucucucucucucucucucucucucucucucuuucccucccucccccccccccccaucgcccuccagacagcagcucgaaccagcugcccagcagcaagaggaugcggacggcguucaccagcacacagcuccuggagcuggagcgagaguucgccuccaacauguaccucucccgccugcggcgcaucgagaucgcgaccuaucugaaccuguccgagaagcaggugaagaucugguuucagaaccgccgggugaagcacaagaaagaaggcaaaggcaguaaccaccgcggcggagcuggggcgggggccggcgggggcgcaccgcaaggcugcaagugcucuucgcucuccucagccaaaugcucagaggacgacgacgaauugcccaugucuccaucuuccuccgggaaggaugacagagaucucacagucacuccguaggugcgccuuuuagaggaccauugguuuccccaccccccaccccgacccuucccgcacugguccccaggcacccgcuggccaaccgacggauuucguugggcuuugcgguggugcgcagcuuuaggcagagcuaagaccuuagcagacacuugaagacagugccccugucccuugggcuucaggguguuuaggaggacuccaagcgaugaaggcugaguccuccuccuaggacacagccucuucucccaggcacgcaggccggagcacagcgccuugcugaccgccagcgccucuucgccugccaacucugggcugguucaagcuuccucgguuccacuauucucuccuucucggucaaucugggcuuuucacuccgcgaguggcuguuugcuuuucuuuuaacauuucuuucuugcccccaacucgucuccccccacugugguccuuuaugcaacacgucuauggacuuaacuuuuccuucccuccucaggaagucucucccuucuguccguuugucccuuaaacagggaucaggucuugcuguucgaagaagucccccuagcagagagaacugucucacaugguauuguauuggggaaaaugacucuguuuccaauacgcucuaaacccccuucaaaugaagccgcuguaaccaaccucuccccauuguccaggccccgacucccucuggggacugacugacugugucauuguaucgucucuguaaugccagaagauauuuauuuauuuauuuauguacaaaauuuuaaauaaacuuuuuuuuucuuagaaau

SEQ ID NO: 2808 - RNA, 2366 nt, Mus musculus
cgagaccgauuagaacugggcagaauggggacuuuccccccuauaguuaguuacuauuuucaaucacagcuaugcuucuacccgaacaggcaacuugggagaguaguccuaggaguccuugaaagugucacuaggguuuaauccuaaaauaagaaaaguauggagaggggaaggguagcuaguuuuuaaauuuauaaaucuguuuugcauaguauuuccaaaguaacuagccacugagugaagcgaaaauugguacaggugggggucguuagcagggaugaccgcucuagcagaggaugcucgcaguuuucccauuaguuugcucugucagccuacaucucaaagaggugagaacgcaccggcucgagaaucuauaguacccagaggucgggucagggagucucgggccaccugcgcugcugaagaagacucucagaggcugacggagcauccaagcccaagcccaggcgcgguggccuggggacugagcugcagaggagcgcugcggaggagggugagggcaggggugggcaaaccaaagccaaguucaccgcuugaaaggggggacgugaaagaggggagugaugcggcggcgaggggagcgcgcgguggguaugagggagugaugcgcgcucggccggggugcagagggggugaggggccuuaccaagcagcagcagccgccggucgcugcgcugcgccaacgcccgcauggccuccggagcgcgcgguagccaggccgccggcccagccugugaugcggucccagcggcgcgccccgggcugcagguggcucgcugaaggaugcgcgucacugaccacagauucccucggacuggugcagagcagagggggaggaaccucucuccagaggccgcggccgcucgcugcuaggcgggcugaacuggcgcagugcugcagccgaucccacgugcccgccgugguccccagccugcgcuccuggcaccgggacugcggcaggggagacugggugcgguucggcuggggaaguugccuggacuccgugguugaguccccggaccucugcuuuaaacuccuaagggugagaagaguggugacacacagaccuccuucuucaugcgcggggaucuuugaugucccgugaugggcacugaaucggugccauacacugguaaccccgugaguuuuauuccacaucugguagaucugcauuguggacugauuuucuuugucucccuguccuuucuuauaggauguccaagauucccauccaccuccgacccagaaaagcagacgcgguuucaaggucaauaaauuagagagguuaaacagacacccaaacaaauuagaccgugcaccucaaaggauguuuggaguugucaccuccuaguucuggcuuuuagucucauagugucucuagguaacaauuauuucccgugcaucaagcugaauauugaaagcacaggauagcagcccuggcuuccccaugaaggaacccuccugagccauuuguccucuguguccuaguucucuccccauaaugacgucaguaauaucgcuccaucacagcaguccuccgcuccucauucuuuucaucguuuuucucuucaggcaugaccccugagagcauacaagcacacuaacaacacuguuucuccuccacucaguccacagcacuaucagccuucccgcuaggggaaacuucaaagugacguccuccgggcagccacuguggaaaaugacaugggcuuggugcuuuaggcauuuuaaggucaggugcccgacgcauggauuccacuucuggaauugcaacaggagcaugaagaaacauuccaacauuccugcacaccacagugagacuguccacugaucagcggccagacggagaaauauacauauguaaagcagcacauuucaucuuuaauagggagggcaauucccacacagcuaccucuccagccuauucauggaucuuuuuuuuuuuuuaaucaucugauagcuuuguggggcuagagauguagcucaccgguagauugcuagcuuagcucuugcaaggcccgggguuauaucaucagcaagaaaaaaaguaaaagaaaaagaagaagaaaaagaaaaagggaaagaaaaagaaacacagacccaaaaccuuccagguguggagaguucacucuccgagacauguggugcucaggcugcugagauguguaucugugguuaucgguuauucaucuggaaccagaagacaaagcuuagguccagcccaucccaggacaguucucagaggccagccuucacuugggagaucacuucuucaaaccagguuuuuguuugcuuaguuugcuuuuaggcuuuccccuuuaauaaaauggaaagagaagacacca

SEQ ID NO: 2809 - RNA, 118349 nt, Mus musculus
cgcgccacucgcgcaggcgcagaggcggcgagcgucucaggaagaggaaaauggcauaaacaagucgggaggacccggagcgcgagccgacgagcgagcggagggcaagaguuuaaaaacaaaccggcggcucccucccgccgugccuuugccccacagcuuccggucgccgccgccucagggucguuucuccccgcagccccggccgcgcgcccaccgcggcgucccgcgcggccccuuuaaggacagcggagagggagagggagaaucccugcucgccgcccgcccgcccuucccccuccccgggcggcuccggcucccucagcggggcccaacccgcccgcccggcuuccauccggcuccggcggcggcuccuucccgcccucgucuaugguggcggcgggggacgcggcugcggcguggccaugaacaguggcggcggcgguggccucccgccgcccucggccgcugccucgccgucgucguccucgcuggcggcggccguggcgguggcgguggcggccucgucgggcgucgggggcguccccggcgggccggcggcggcggcgggcgugaagcucaaguacugccgcuacuacgccaaggacaagacgugcuucuacggcgaggagugucaguuccugcacgaggacccagccgccggcgcggccccggggcuuggccuccauagcaacagcgucccgcuggcgcuagcggccgcggccggggccgccuuuccuccgggagcgcucccgggcgggggagcggggccgcccgcggggcccaagaagccggagcugggcgucccgggggcggcgaccgcgggcggcggacucgauggcccgcggguggcgaguaagugaggcccgggcgggguggugcggugcgggguuggugcgguccgggcgcggggaggaggccugagccugcccgcuuccccucaccuccgggccgcaggagaggccuaggcccugcgcagcccuccuuccuucuuccuguuuccucucugggcuccgccgcucggggcaaaccccggagcuaggggaggcggguucccgggagcguggguggacggacggucgugguguaauuggggugggguggggggcgcugggaguggggugcggggagcaggggggaugggcugcggaguggaagcaagggggugucgcuuccggguuugugugugugugugugugugugugugugcgcgcgcgcgcgcgugugcguggaaaggggcugggucugcgagcacaugugucggugcgugcucgcguggagcgcgggcugccgaaaguugccggcugggaacuccuucuaaaggauguccggggccaggggugggggugcggggaggagagguguaugaagaucagcuuuauucauuuauuuauuuuuaaguaagcacagguuuaauagagagcuuagguuaggaauuucccaagacuugcgcucaggcagguuucuggaaagccagaguaagugaacugggcgucugcagggaucuugucuuucccauggcguuauaccgagugaacuugcucagcacugggccucaagagcgucucgcaccccgaaggcuuucgugagaagaauuuagggcuguguacguuauagcuguuaaguuaaguggaguuugcuguuacuguaaaugcuuugaacauuagaauuagaugcuugauuuccucuaguuuuagaucuugugauaacuugauagucaaguuaacuugaacuucagaacaaucugucuuuaacacaaacaaccugauaaagugguuuacuacuuacugggauaauuuauuuuuaacagcccccccccuuucuuuuuuuucuuuuuuuuuuuuuuuuuuuuuuuuuuuuggucucuuguuuaccgaagcuuaaaugguaauaaauuuagaugcuuuguaaagaaguuaauuuccuggugggauguagccguuaauuuuuuaaaaauuacguguguguguguguguauguauguauguaugugugugugugugucauugucagugugcucucacauagcaugaauguagaaagguaagaggacagacaguuuaggggagucauugcccuccuacagcauggguccuaaagcuggaacucagguggucagccuuggcaguaggcacuuuaacuacuaaggcuuaacaagcaagcguugucuuugcccccuuccuccucuucuguuucuuuuuucagacaggguuucucucuguggcccacacuugucugaucccccugccucagccucaugagcugggaguauagguuugccaucaugcccaguggagcuuuuguuuaagguaaauuguaugaaaugaaguugugccucugguucauuuaaggauaauguuugauugguaaggaaugaaaaaaacaguaucuguccuaaguuggcuuuuuguugcugcuuuaaaacaccauaaccaaaagcagcuuggggaggagggaagguuuauuaugcauuagagucaguuauugagggagccacacacaagcucaagguaugaaccuggaggcagcaacugaagcagagaccaaggaaggaggcugcauacugucacucuggcuugcucagcuacauuucuuaagccuaggcccacugcuguuaauggacuggguccuccuccaucaguagacagucaagaaaaugccuuacagaaauguccacagaccaguuuauuagagggaagucuuccuugccuaggugagugguuugugucaaguugacaaaaauuaaccagcauagugacugccuuccaaacuaggacaccuaaaagugcugguccuuaacgugugaucuuucuaaggucgcaguuggacacaagaacugggaaggucggauagaacuaagugaaggaaggagcugaaggaauggcacauguguacaugugugccaggugugggaugcuccugcacauguguacaugugugccgagugugggaugcugcugcacaugugaacaugugugccggguguguaaugcugcugcauguguguacaugugugccaggugugugaugcugcuacacguguguacaugugugccgggugugugaggacaguguacuuguguccauguuuaucugguauauuuagguggaguaaacccuagggguuccucucaggagggugcgcuccuuaucugagcaacagaaagcaacugagauagaaucuuuagacuauaggugguuaaugcuagggacauuuaaauacugucauuuuaauagcugauuaaauagcugggaucaggugguucuuuuucugguuuguuuuuuuuuuuugagacagaaucuuaauauguaucauugacuguccugcaacucagauaucugccugccucugccuccccagugcugggaauaaaggcaugugucacuuugucuggccuugugacauuucuuuaacauaauaguccaccauccuccuuuucucauugaccuuuccacugugcuaggcuucaguuaauggcuguucuguauuuguacacuuaguuauucaaucuguucucaaauagccucuuaagauagccuucaccagccgggcguggugguggcggcgcacaccuuuaauuccagcacucagggggcagaggcagguggauuucugaguucgaggccagccuggucuacaaagugaauuccaggacagccagggcuauacagagaaacccugucucgggaaaaaaaaaaaaaaaaaaaaaaaaaagauagccuucaccaacuaauuaaguguacaaggaaauuaaaauagaugacacauuccaaauauugccauuuagaaacaucuggauuguguuaguugaugugcuauuagagcauucuucaagugaaucuuuaauaauaauguaacugggcaggagaucauaguggaacugcuacuugauagauuuuuauguucccccaucuggccucuguggaauuguauauucauguguauauauuuuuaagcuuuuaauugaaguuccuguuuaaacauaguccaguuuuguguugcuauaaccgaaaaacacagauugaacaauuuaauaaaaaaacaaacaaacaggaauuucagggucuggcaagauggcuuugaagguaaaggcauuugucaaacuaaaacuugaguucaauccucaggacccacacgguaguaggaaagaaccaacuccuguaaguccucugaucgcagacuaacuguauugccacucguccccaauaaguacguauguaucuaaaaagggaaggaaggaaggaagaauugcagcccuguaucccagcacuugguagauggaggcaggagggucagaaaguucagggucauccuuugucacauaagaguuaggggcuugcugggcuacaggaaaccacaaggaaaggaagcauaucucuguuuuggagguugaaaaguccaacaugaagguacuggccuguguggagagguauccuccucagcaggcuguccugggacucuucucuguagacagauccaucagccucugccuccugaaugcuggggugcaucaccacauccugcagagccaccuuuuacuaggccaccccuucaccuguuacaccagggauuuaguuucuaacucauggacuuuggggaugggggucauauucaaauggaagcauuugacuucugaacucucaaaugcucuccucacuaugcccacccagugcauuccuuccaucucagucgucacaggacuguuaacuucuuccauuaucagcuuaagcaugcaugcaaaguccagagcugcaucugaggcagguacgggugaaugaugaauucugaggcacgguccucuaccccagagugugaaauuguuacgugcuuccagaguucaguggucaaacagguguggggcaaaacguuuucauuccagaaaggaauaggaaaagagggcucaaacaagugcauaauccaguggggaauuuuaagccugugcucaucuugggcugggaauuggaucccagagccucaggcaacccuaucccucuggcuuuuauuaugcacucacuuuuaaaaucucuuggcuuuuuucauuuugauuuggacacugguggcuuuacuguguugugaugucuugagguugguacuacucagguauugucugaguaggggcugugaauuuuuggcucuaacuccacugugaggccccaggcuguccaggagacucuuugaaauauaguuguguguuugucaaggcgccuuagauuuuacauugugugacagucagagguauacauccuguauccguuuccuuggcugugguucaugcuuccuggacuuggcuuugcuugagcaguugcuacugggagcagagaacagaguccugaggugauuuggcaaccagccugagugggcaaucuggccugggcgcccagacaauucugcuuucuuagacuucucagucaguccugggauaggacaauaauguccgauaacucuaaaugcccuaagugacauuuucagugucaucuugaccccacccccagcccucuuuucuucuuccuauucuuuauucuuugacaguuucauauaugcuuacaauguauuugccaguuuugucuuguuuuguuuucacuccuaucuccuuugggacccuucuuccuggcauguccccucuuucaggucuuuuuaaaaaacaacccacugaguuacacuagggcugccuguaagagcauugguuuaggauuauuuacuggagccugggcaguuuaccaguggcugcaccucugaagaaaaaugacuucugcucuuccaauagcuccuuggcuaggggaggggccucacgaccucuuccccaguucauguuggaaugccgacaggauccagcuugugcagguaaugaguucaugaguuccauggcugugucauguccagaagacagaggcucaauaguguuuguccccaaccuccagcucuuacauuuauuuauuuauuaaaaagauuuauuuauuauauguaaguacacuguagcugucuucagacacuccagaagagggagucagaucucauuacggaugguugugagccaccaugugguugaugggauuugaacuccggaccuugugguugaugggauuugaacucgggugcucuugcccacugagccaucucaccagccccuagcucuuacauuuauguucuuucugcuuuucccucaacguucccagagccuuggguuggugugugugugccugagugugugucacagauccuguuuagaguacuuggcaguuagguauaucagccuuaacugcugucauuaaaaaagaaagccuugcugaccaguguugcucagaggaguaagcugcuggugcagccgugcggaguagaaaggcgaagcccuccuaaauguuccucuucagucuuucacauggcgaggcugcagauuuucuaaauccuauuguuuagccucccuuuuaauugcacacauucucccuguguuuucugcuuuucagaccuuguauguaaaagacagucaugcaguucuuugugguuuguguagaaacuucugccagauagccuaguucauuguucuguugcagcuuucuucuggcagggacagaaguuggccaguguuugacauggaaugggauggacgagcagcuugcucuugugugggaagagugucuuagcucauuucugaguacugucacccuguucgaaugcauugacuacuuucuaauacugucggugucagugggcacuugcaugguuuaauuuuuuuuuuuuuucuggucugugaagaaaaacaguuauguaugugagcuggagagauggcuccgugguuagaacucuugaucaucucggugucuggaguugccuguagcuuccaacauccggaacuccagcuccaggggagccagcccauuuuucaucucuucugucaccuuuugcacacauguacaugcaggcauagacaugaaaguaaaaaucucauuauaaaaagaauucuagguguauuuuggagagugccuugcuuaauuaaggguggaauugguagguacaauagggugcauauauucagcuucaguaacccaugccggcuuugguuggaaguuuaugaauuuuggucucuucagaguuccucauugucugccuuauaauugcagcuauucuggugguuagaauggauggcacaauacuguuuuuuaaugucuguauugauuuuaauugaauuaguuaaugcuguuaauaucacaagauauaauagggaaauaaacagagguuuuuaaaaagcguauugcuauccugugugggauauaggcuacuugauggggcaagacgacuucccccauuuugccuggcucccuugugcgacuuaacaggaucuuuaguaauauuuuguuaguguuucagauaggguuaaaauaaccuuggaaguuacugugagggaaaacauguauccuuaacuaggcaggcaucucaagagugagccaggaaggcuucaguauauuaaguugccaugaugucucacccuugugagggaaauaguuuuuguuuguuguuuucuguaguguaggaaggcgcuccacuccgguucugcugacccugcagugugauaauagcguguuuugacagucaggguuguuaugaugagauaauuuaaaggcgugauucuguuggaguuaguuuuuuuuuuuuguuuuguuuuuuuguuuuaaaugugguucuguucaaauaaacuauugaugggauuauauuuccaaguagcuagauuuuccagauggcucugcucuggaggguccucaagccucaguagccaagaucugucaguguauguuucaugugcuugcuuucaauuugaaaucuagaauaucuguuuguuuuaccaaaacauaauuccuuuucauuucugcugauuuaguuaacagugaagguuuggaaauaagguggguugaggagugaagauacaccaggcagcgcccuccucuuuguuguaggaguuacuuuugagauagggucucuaacugaaccuggaccugucuccuccuccucggugcugggauuacaggugcuaauagccucacuuggcucuuuaugugggugauggguccucaggguuucaugcuugucaggcagguacucuacaggacggcauuuuugcagcccuuguugucuuacagaguaguugagugaaccaaaaugcaagaugauaaaauacuaaccuagugugugugugucuccuuucgguauuaggaauucauugguacugggcugagaaucccacagugugauuuucagcgcuaugacuuaagaacaguugugaccuugaccuugggcugcucauuugcuccguaugaaaauacaguucuuuuccuguaaaagaggagaauggaguaugcugcacauggccugaaagcuuuucuacgacagacagugcuguaaauguacuuguguuuaagaagacaagccuuuccuguuuccuaaagaauuucuccuucucaacuugaaacuggccagcacuugagcaucaguguguguggaugaagggucugcucuccuugauucuguguuaaucgauaugcagauacccguccucuaccagaagaccuccuccuccaugaagccugguugucaugcuguuguguugccaagguugaccuugaguuucugcuccucuuucaccucuguagugccugggugccacucaacugugcgggauuaugcaguggcugggaugaaagggaugaaagcaggguucccugcacgauacugugcacuguccagcugagcuaugguccccagcuccucucuuuuucugauuucucuuugguauauuuuucuugcuuuuuuuuuuuuuuuuaaucaguauugcuucuauuguucuaaagguaguuuuacuguauauucagaaugagaagagucuuaucugaaugauaguuuaggaguuaaaaguguaaaacauacagauugaaauuuuguuucuuuauuuuggagagagggucucuuguagcccaagcuggucuggaacucacuauguagcagaccuugaacuucugaaccaccuaccuccaccuucuacgugcugagacuauagauguaugucccuccacaccugauuuuugagguauugggaauuaaaccuggacuuccugcacucuaggcaaguccuuuaacaaaagaucuaggguucugacccuaaaaauuuaaacaagauaaagagcacaagagagagggaaggcucuccguuucccgggaaggauguuggcguagaggacauuggcuacuaugaguuucagugugcuguugccuaaaccacagaugcauggucuucauauucauggguucauauguuggugcauucacugugucccugggaguugcugcugucuguaaauuugguguggaugagccaagaaaaaaggcauaugcagauuucuacagaaauuaugauuucauggaacauuuugaagagaugaggaaggcuggugucuuucagagugugaagugauugcagaagaguccuuuggauuguguuccauagaagcucauugcugaccuguguuccugaacuaugaaaaaugaauaugugggcuaaggaguaguuucucuuaauaagcaauaauuauaugggggaaaaaaagaguacaaggaagaaaaaguuuccuucucuccuaaguucuccgaguuuuccagaugacagucauuuuuucuaguuuauauuaauucaugaacauuuuauuuuucuauuaucauucauguuuauauugcccuuacuucugugcauauuggcaccuacauacacacaggugugagcuauacagaaagcuacugaacuugcaguuuuccaagcugauuguuuagcuuuuauuuuguuccacauuuacagagaaauuuauccauuucuucaugacugcauaacacuucauuauaugccuguauuuuuuuuaaaaugauggcuauuuaaauuguguguugcccccuuuuuuucuuuugcuggaggauagaaucuagggcuuugugugggcaaagacauuguucugccacugaaauguaugucuaggcuaggaccuuaagugaugguuagcagauucuguagcuguagaucagcaguuuguaaggaaaugucccuguugccaaagcuuggaaaaacuagcaaugcagcucuuagaggagacuguugguaaggucuuuagguacaugcuuauaaaaagacaaguuacacagauauuuugaaaacuuagaugaugacaagcccaugagauaggguugccuccuuuuuagaagaaaauaucuuaagagaauuaucugcucaaggucuuaaaacuagaaaguggcaaaagaaguuuuguuuguuuuuagcauauauggguuuuuagcgcauaguuuuaaguugauacagucaucgugguggggaagucaaggcagcaaaaacuuagaagucauuuagucacuuugcauuaagaagcaaagagugaugaaugcuugacuuuuuuuuucuuaauguaguucagaaugccuguggagggaauggugccacccuuggugggcaggcuuuccaaccucauuaagguagucaagguuuuuauucccagacaugcucagagaccuuuguuccaguugggaauggguuaaccauuccagggaauuagcuccagugaugguaugagcuuaaaaugugcaaggcccuggguuuaaucccaauacuaaaauaacuggaaaaauguuaacaaaaaggauauaggauguauaucauuuuguuuacaagaaagaguugaaaaaaauuuuucuugagacagaaucucacuaugagguacuggcuaucuuagaacuugcuacuuaggccagaaaguaauagaaggcauguguaucaccacacccagccgagugauuuuaugauuaaugcaaacauuuuuguuuguuuugcuuuuguuuuucaagacuggguuucucuggguuguccuggaacucauucuguagaccagauuggcugugagcucagggaucguccugccucugccucugccucugccucuggaguucugggauuaaaggcaugaaccaccacugcuugguuuauguaaagauauuuauuaacaguuuuuuuagucuuucuucccuuguugcuaugauaagauacucuugacagaaguaacuuaguggagagaagguuuauuuuggcucacaguuggaggucacagugcauccugguggggaacccgagcuguaggaccuuaggacagcagccuagaaacugagagggagggaaggcugaaggauucuucauucugcucugcucgcuuucaucacuccagauaguaugggauucccugacuaggaauaguccugcccacaacuaggagcuagagaaauagcugcucucugggguuaagggugugcucuguguauuguucuugcagaggacccauuucuuggucucucuacaacucaagcuccaggggaucuaacccucuuucucugcucuguagguacuugcacccacuuggaauuugcaugagugcacaugcacgcagaagcaaauaauaucaguauuaaaaaaggcagccuucccccaagucccaaccaaggcagucaugacagucuucccaucggcaugccgagggauccaucucccagcaaugcuagagucuaucaauugcugcugugugaaugcucuuugugauaggaucauuaucuuuagaaaaacugaguaccucagcacucaguuuucaguagaaauacuguauuagaauacuuagaauuaauauuuauaguguuggagacuuaggauucuaagaauuaagucuuccucuguauucauacuccauuguuuuugaguucauuuauucaguaaucuccuuuauauacugguuuuuuuuuuuuaaacuguaacucauuuaaagacuuaaacuugucaguuguagguucauacuucaguuaucucugaugagcauaugcaguuguacagccauuggguuucuaaccugauuuacagauagucuuccauuguuuuucccuucgcaguugagguaugcagcacaaaugguaaugucaucuucaguuuaucuguauuugcccaggacuggccagugaauggcaaagcugagacccagcagguuaucacugaguggugguugggacuuuauaaugacagguuaaggaguugagaucucauuucaugugaguucuagugagcagugagucuguagaguauaauuagcaagggagaggaccuuguaaaguguccucugugcacuugcagcuucaggaugcuccucgguguuuuaggauggccucugucgcccaggacgaggaaguccaggagcaccacugcaagaggauaggacaagcuuuuuaguuccagucuucuuccuccuaacccaggaccuggggcaugggcuaggacuccaccacugagcuuuauaguguuggagacuuaggauucuaagauccaggcaagagcagguuugcuauuagccaugaggucuucaguuuuuguuucugugcuuucacaaaagcagaacgggcagacaguaauguuacauuuauuuuauauagguaugaaucccacucacuaaaaaucuucuaaaaauuccacugcuuaguacuauagcauugcuucaguguaugaguuugggcuccaaauucccaugucccuguuuguuuguuuguuuguuuguuuguuuuuaagcauagaaaccacacucguucugucccaguaauuccaaaaacgacuaguugguccugaaauguaaagucuugaagucaagaaucuuaccugauguagaugagacucagggugugacucauccucuggcaaacucuucuuucuggacaggcucuccuagcuccauugguggaugggaaaggauagacauuuccauuucaaaggggagaaguagaagggcgagggguagcacccuguagagcacauguuacugaggcuagagaaucaucuuuguccugguggucuacacucagcacuuagugagaagggggcuugaguucccgugcugcagagauuccuguuuccaaagccuuggugggagcaguccacauuacaguauugaccauuugcugcagcucuguccucaggcggauguuccaugcugguguguacaguucugggcuugugggugauucuuuccuuacauuguaauauacacugcuauaggcuacucuuguggcagucucuucuggaccaguuuucugccugguccccaagguuuuccaaaugcucuucgaaauguaggucuacaccugugucuuuauaauugcugcacucauaccccuguaguuagcaccuuacagauaccacuaagguuuacuguuguaccuuucucagaggcagcugagccacaaguggguucacuugagcaugauggaguaacaaccaaggaacacuacacaagaaugcaaugggccgggcagugguggugcacaccuuuaaucccagcacuugagaggcagaggcagaggcaggcagauuucugaguucgaggccagccuggucuacagagugaguuccaggacagccagagcuacacagagaaacccugucucgaacccccccccccaaaaaaaaaaaaaaacaaaaaaaauuaaagaaugcaaugggacagagacuugaggugauccagggcaaggagaacugagguccugguaacucugggccuuaccugaaagagcucucucuaucauuaaggccuugacgcugugggucugugguaggaguggcaggcuggaagauaacuagaaugcccucaaggucauucuuccagcaaaagcugacuguauugaaggcuguaaugcgcucuccuguaaacugucagacuuuuucuuuucuaaauucuuucuuuugauuauaaauuuuaucuuuaaucuuagauuguuucuaaacauuuuccuaugaacaguuaagauaaaccaucuagcaucuuaacacuuuguguagaguuuacauucaucaaacagaacaguucucugcuugaaaguuuagaaaacauuagaacacagacacaacucagucaagucuuugucacuuucuuuucuuuuuuuuuuuuugucacuuuauuuucauggcuuuugagacagagucuuuauuuacauauauguaugcauaaagguuggccuggaacuuggcaguaagcuuucugcuuuggccuccugggugcugggaccacaggugugcucuaucuuuucuccccuuuccaaccuauagcuuguuucugagaucgcagaacaaucucuacuaguauuuuuauuugcaucuaugugagguuauuauggaggcauuggguuccccugcuaagguugugggcugcccgacaugggugcugagagccaaaguugaguccucugcuagaguagcaagugcacguacaugcugagccugcuucccagucauccuuuuaucagcauuaaccuuuaaagagccgcagguucuucuggguguggcuucccacugacuggcccacccugcgcuuauuauuuaguucugaagcugcuuccacauuucucggccuuuguugauaugauugacacuucuuuuuuuuuuuuuuaaagauuuauuuauuauuauauguaaguacacuguagcugucuucagacacuccagaagagggagucagaucucguuauggaugguugugagccaccaugugguugcugggauuugaacucuggaccuucggaagagcagucaggugcucuuacccacugagccauccucaccagcccggcaccucauuucuguguacuaguuuuugaauaagucuuuuucugcagcuguaguaaaagaaagaacagagguuuauuacucauagcucuggagacugagguguugaaguucagugugccagcagguuuguuuuuugauaaggagugcugucuguuuaaagugauguggcuuucccuggugaaugagauauaacaggacagaguuagaauaauuuaguuuaacauuuaguugacuuuauuuucagcucuagaauuugaguaacacuucauuugagaaaauagaacuguucaugggccauguaaaauuugauuuuuauacagaggcugaaacaaaagaacacagagcagauuggucauuucaaaguuaauuacucuccagugauagaaaaauagcuaguuuguuaaacaaacagguuaguuuugcuugaugucuggagcacuuguuaauaggagcgacccucuuuugaacuuagccugaucuuuggggccuacuguaagagcuuaagucccagauggugagcugaugcacauuuccugaagaaggagcagcuuggguaucuguguggcuggggcucugggcgaucuccccauggagccggguucugaacuaccaccucagcucacacuccugacugcuacauaccgcagaugagacuuaaacaugugaaucugcugcacacagaggagugaaaacagauggcacugggcuucuguggagacaacaagcuuuaagugaauugcaaguuacuuuuaaaacuaggguugaaggaguggaaagaucuuaucuggccaguagcauuuauuuaauuuaaauauaaaaccguaacugauaccuuuugagguaggguuguuuuuguucuuacuaaguugggcauguuaguaucuucacgaucuauauagagggguuauguaucauggauuagugcuuucccuaacugcaugaaguguauauucacuucuguucaccucuaaacuauaauuuucuaaaauaagaaaaugcaaaugugagcauauggcacuguaugggaauucuagcauguuuaaagauuguucuguuauauuggcuuguaggaaauaaguagaggaaauugaauuuaaacuguaaaugaaaauuuagauauuuuuccuuuuuuuuuaaaaagauauauuuauuauuauaucuaacuacacuguagcugucuucagaugcaccagaagagggugucagaucucauuacggaggguugugagccaccaugugguugcugggauuugaacucaggacuuucggaagaguaguuggugcucuuaaccacugagccaucucuccagcccuauuuuuacuuuuugaguauuuugccugcauauauguauaugcauuauauggauacccugguauccaaggaauucagaagagcuguaguucugaauggcugugaaucaccauguggauucuaagaacugaaucaagguccccuccaagaguaacaaguguccuuaacugcggagacauuucuccagcccgaauuugguaauuaaaaaaaaacaaaacaaaacugguauaagccauuuguagugaaaauaacuuggaauaaaaaugcuauuuaaaaauaauuugacucagccaauguauaguggugcauaccuuuaaucccagcauuugagaggcacgguggggagaagggagaguaucuuugaguuuagaggccagccuggucuacagagugaguuccaggacagccaggacuacacagagaaacccugucuugaaaaaccaaaaauaaaaaguaaaaaaaaaaggccuguggaauugugcaguuaguaccuaaccuagaauuguauucuguucuguuagggaaagguaaggaggacuguuccaaaggguuagaggaguuucgucaugauggcucucucaauucucgucaucauuaggaugagaaauagcugcauuguauguagaaaagucaaaagaagaaacaaccucuuugcucacaacacuagaugguguucuuggccuguuuauucagucagacuuucuguguuuauguaaguguucauaaucaugcuguuugauguguuccucucccacuuaauauuauaaaugguuauuauacuaaaagggaaauagccagcuuugguucucugcucuacacuucgacacagucacucuaaagcagcuguucuccggcucuccacuccacuuggacacugugaugacaacaucuaucucccuacaagguuaccuccucuuucuguccccgugcugcaaauaucuguugagaguuagcaggucucuagguuaucucuucuucugucugacuuggcuaagaauuugggguugcuauggcuucuucauuggauuugagaauuugcuguacagcucacagaacucagggguacucacugcuccuugagcuaggguaauugguauaaaacaucucucuuaagugguaaucauuuggcgaugaugaugguacugucuagucaugcuaguugcaagggucucuugugaccaccaugaccagcagagucauauucugugggaggcaaggagguggucuaguuaaauaggacucaacaguugauguuaggucaaacuucccaagucugacucccaaguaaguuuauuuuaugcauauuuaagcacagcacaguuuggugaaaauuuuccuggugauaaauaacucaguuuugggugcacaguaaacuuuagacaauggguacaccagaacuaaaguaaaguacauuugacaucuucuauaaagauagguucuauagauugacuaugugacaugacaucaucuauaaagauugguucuauagauuaauaaguaucugggggaggauucaguguggccugagguacacagguaguacacaggucaccaggcuguuaaucauauccccacccagccuucugagcaaaaaccuccuguacauuccucacuuugaaggacaacccuguguauuuaauauuccuggguccuuagugcuuaucugugagcucaaagacuucucugugucucacaauuaguuauugugugaaugaagaaaacaauuaaaauuaaugguaagacuguugauuaguuguggauugaagaggggcacauaaauauauagagcaaaaugugacaacaaugagugggugauggcuguuggccaaaggcaguuugaagagaggucuguguagacagacuuugaaguaauguaaaguagugccgucucguguaagcuaagccagagagccccuguaacccaggucaguguacacuucucaagauagaagccaggcaaaaggaaagaguaaggagauggagagcaaggugauucuaggcuaggcuaggccaggccaggugagcuggucuaaacaguugacauugguguuaaugaaggagaauauguaggcugugagagcuugguggaaacagguaugaaauucacuagugugguggcuggacuucucugcuaugagugguccccgcucgcucucuuccuuuggaggucuggauuauggaagcuguccuagucuguagcugguacaucauagacugucucagauggcuauaccccaacaaauuuccucaggguucauguugagcaugaugccccugacugcagcuuuuuccaacauccaaaguucgaguacacacuuugaugacuucuggguuuccagcaucucccaagggaugcacagaucugaccugaaggguuuuguuuuguuuuguuuuguuuuguuuguuuuguauuucugccuguaacuucacaguguuguguugauuggguuuugugguaaccuccugugauaguuuggucugagcuguaugcgugguucacagugggucuugggcugccauccugccaacagaagucuuugaaguggcaucuuguuucugcugugaguugucaugguugagcgccucccuuugaggagagcuuucucccagcaccucucugcugauacugcugcugcccuggaugugauucaacuguuaauagcguguuuauuacucuuccaggaguugcucuucagcuuuacauagauuagucccugaagacucuacgcuuugguguugucuacuaccuuaaaaaagagaaacuugaaacuuuuguagaaguauugagaauauaaugacccccaaggcaucagaguuuaauaguugucggugcuuugccaaucuguccaguuuucuuuuucugggguauucaugcacacuagggaacaaaccaacagccucgcucaggcuaggcagguucucugcugccaaguucucagcccucuuuuaauugcauauuuuuguuaguguuugguugcuuguuuugcaugacucacucuacuccccagacuggccugaaacucacuauguagcccagggugacuuccugccuuagacucuugagugcuguguuauaggccguagccaccaugacugacuggguaccuuuaaaguaugacaccagcgucucacugaguugcucaguguggccuugagcucacuguuguagcucuagguaggccuugaauuugugauccugugucagccuccuaaauaguugauauuauaaaccuguuuugccagacccagaaugccagggauauuuuaaauaaauccugcccaucagucauaaugauuuuaaauuauuacaugguaauucaucacuggauauguuaaaguuuauuauaauuuuugguggauguauuacacuaucuacuuuucuuaaagugauuccuuuuauccauccauccaucuaucauguauccuaggcuugucucaaacuuuacuauguagcagaggaugacuuugaauccggcuucucggguuucaacucaccucauggaauuguggaguaauagguguauaucgccaugccugguaugugcagugcagugcaggggauagaguugagggcugccugcaugcuaggcaagcaagcagucugucacugagcugcauuucuagcuuuguggauuuguuuguuuguuuuuuagguggggacuguuucucagugacugcucagaucagcucagguccaugguuuaacacauaagacauuguagaaagacccgcaugcccaggccugagaauauuaaaacaccuuauccacuacuuguggcccagcuaguuugauuucuucaacauuucuuccuuaaagucagcacagagagaacacugccuuuuuuggggugggguggggugggguggggugggguguuacugcagccccuuguggccuucacaguuucucugauuucuaagguaguguaagacuguuucagauugguugugaaagagaaacagauuugacaaacuggucucuguuuauaguacuccagagauugugauuaggagucuccagucccuugcugaauuaaaggaaaggaacuugacuaggaagcuagauacacaagugugggcuuuuucauguugugugucuaccaggugauuaguauaaacauaccauucugggccagcagugacacacacuguuaauuccagcacuugggagacagaggcaggcccaucucugaguuugaggacagccuggucuacagaacaaauuccaggacagccagggcuacagagaggaacccugucuuggggaaauguuuuuuuuuuuuuuuuccugaaggcauggaggauguaccaaacauggacauuuuaaaacagcuuuuuacugucaagucagucuuaaucuugucuuggguuaugaccugguaaacaaacaugcaugugacagauuaugggacucugaaauuuauuuagaaacagagaagaaaaucuguguuuuguccuuuuaaauaauuguaaauacuugcguuuccccuuucuuucaguuccgggaauggauggaggugcuuuaacugaugcgagucucacagaguccuauuucagcaccagcuuuauuggagucaauggauuuggaagcccuguagaaacaaaguaucccuugaugcagguauuuucaggguggauugagaccucuuccauucuuacacuguugagguuggggagggcagacuuuaagaggugagagagauggguaaaaugcaggaugucguauaguuugggaagagugguggaagugggaugugaaggguagauagaaaucaguuacagguguuuaguauguauuuaauuaaagcuugauaaugcucauagcguaugcuaucaauguugaaaaaaaucucucauucucacucaacaaauagcuugcuaaccuucucagacagcuagcaguacuguuaacaguuuccugagcuugccuucuacuaggaguauucugcugcacauuucugaauuuacauuaaagcuguuaaauuugaagucagaguacuugaaugaaguuaacauugcuuuuuaaaaauuacuucuuucuuucuuucuuucuuucuuucuuucuuucuuucuuucuuucuuucuuucuuucuuucuuucuuucuuucuuauauuuaaguacacuguaguugucuuccaacacaacagaaggggccaucagaucucauuauggaugguugugagccaucaugugguugcugggauuugaacucaggaccuuuggaagagcagucagugcucuuaaccacugagccaucucuccagcccaacguugcuuuugcgucuuuaaaaugcguucugcuucuugcagcugacuuuucucuuugucauagcugggugugacacugaggacauuuuauagauagaugaagaauuuuguagaacuagaaugaacuuggaaaauguuuuuaauuuccuuuuuggaaaacuuggucacaauagugagaguaguccuccgcccuuccuuguuucuguugugccuucugguccccauaacuauaauaggaugcgacagcaccggccuuugcuuccuguuaaugcugcacugauuuuaagaagucuguacuuuuuguaugacuuuuuuuuuuuuuuuuuuuuuuuuuaaagauuuauuuauuuauuuauuauauguaaguacacuguagcuguccuuagauacuccauaagagggcaucagauuuuguuauggaugguugugagccaccaugugguugcugggauuugaacucgggaccuuuggaagagcagucggcacucuuaaccacugagccaucucgccagccccuuuguaugacuuuuaacuucauuguuaaaagcugauguuucagugucgcucuguuccuuuuggguuauuugacuuuaagccuuuaagaaagcaugcauagucaugaacaugagucaccucucucuccuguguauguuuaguguaugcccauggcauaggugugugugcccaugcaggauacauggagaagagagcucugugccaguugucuaucacaguuugccguacugaaaugagaugagaucucucacugaacuagaagcucauuguucugguaggcuggccagccagaacacccaggaccccucuguccccauccccacagugcuacaguacgcuaagccaugucuggcuuuuuauguagaugcuggagauucaauguuaagcccucauucuuggugagcaagagcuuagccacugaacuuucuacccauuccugagugccuuauuauuauuauuauuuuuuagugaucaauuaauguauaguaauuuuugagauagugucuuaugugucuuuggcuagucaaaaauuugcugcagagcuaacgauggaugaccuugaacuuaugaucaaguucuauaaguuuuacagguucuaggaucguaccucguguauuaccacgcauacaguuauauauuaaaauuguauuuaaauugucucaagaacuuguccuccugcuuccccuuuuaaugauggagaaacgaagaagccaagugauuuaaguuugggaucacggaguuuaagcaagagcugagacauuuuggauacuuuuucagagacuugaguuggcuucauauauaggauuuguugguuuuagauuagacauaggggcagugggguagaaaagcagagaauaugccuggcaaacagacgguauaugagggaaaauacaaauugagagauguuagggcauguauugacauuacauaguuauguccuaccuucuugaaugaguacuggaauuuguaucuuauggacagggaaacucacuugucuugcccaugcacauuugugaguuacacaguuguaauucagaauaggccuauggcagcaucuuuaauaccuggcuaguaaggaaguauuugaugugcuuccugggaggcugugcauuggugugaucuaagcaguguacuagcaugugcaggagggaagauuaguuugucagugguguuaaagaucagucggcuucuuacucaguuucugcaucauuaaaaaggaaaggaaagaugcaaccuggccuagucugucuuucuguuggaugcuuuuaauuccuuauuccucaauggcuccguaugcauauuguauuuuucagagaaugacuaguaguagcagcuccccaagccuucuaaaugacagugccaagccauacacaggccacgguaagauuugauuguguacauuaguauguguguguagcucugaaaguaauaugauauaguagauuauuuuagaaauugugagcagguauuaauuagaaaauaaaauuuaaucaagauuuuaaaucaccaauuuuucuuuucauguuaauaaauacaauaauuaagauuacauuaaacacuuuaaucgugguccuucuugauuaauaugaauuaaaucuuauauugcuauuuuuuuuguuuuuuuuuguuuuuuuuuccgagacagaguuucucuguguagcccuggauguccuggaacucacuuuguagaccaggcugaccucaaacccagaaauccgccugccucugccucucgagugcugggauuaaaagcaugugucaccaucgccuggccuguauuuauuuuuaaaaaguguucccugguuuaaaaguguguguguguguguguagagagcacauauacauauaugcuaguaacauagaucaacaaaauguuaaaacuuaauaauaaugaauaaaauuugcauguugauuauuuuuugugauagguauuuuuuuguauauaaaguuuguauacuauuuaggaauuucagucuucuacugaagaaaaaaggaacauuuuaauguuagauuuaauguuagaaacuacuuuguacucaggcaguggugguucaugcccuuaaucccagagcgggagguagagucaggugaaccucugaguucauggccaaccugguccauggagcgcuccauuggggcagccaggccuacacagagaaacccugucuuggaaaaaaaaacagaaagaaaguacuuuuguagcauccccguguuuuuaguguuccauauuguuuaagugcuuugcaagaugccaaaugauauuuaagaaauugugcccuuuugaaugucuaaaauuuauauaucauauaaacauuuugucuugcuguuaucacuuuccuuucuuagaguuacuuacuucauacuaaaugucuuacaucccagcaaacaguucuaccacaaaacuccagcuagaggaaggaaggcagagaaauuaagugaaaaucucuguguacuguguugugaggcaauuuaauacaggcuuugggaucucauacauaauaugauuaaaaaauacaagauuuauuagugcccagaaaugaagaugauauacaaugucauauguuuuaaaaaauucugauuuguaaagugggaaauaauucagaguuuuaauguuuguagagcauuggcacuuugaacccauaacuggauucuguuuguuuuguaacauugaauauuuucauuuuuaaaauaaaaacuuaacaagcauucuagaagucuguugauaaaccuagaacuguggaauagacuguagaauagaugguuugaagaccuagcucuucugucucauccaagccugaucucuuggacucccuuuauuauuccaaggacucaguauuaacacaaguguuuacuguaacuagacuuccuucccucaaaaccauacccuagucauaugacugaaaagauuuaccuacuguauuugacuuuucccuuguuuuaaucaaacagaugcuuucucacauagagguauauacuuggcuggguagacagcacuguagacugaaugaaguauccaucaucaguucgugucucauguguuggacacgcaggugugugagcacugaguuugcugcucuugugggcagcauugggcugcuguugaagcaaugcuagguuaacguguaucagccuugcuuguugucugaguugucuggaaaccuguguaacuugccuuccagaucuucugacuucaucugcuucauccuuguuuaaugacuucggugcccucaacaucucccagagaaggaagguaggugaaauugaaauuccagugcaacuaaaugugguuuagagguaguguuggguaaccaacauuuuccucagugggaggaagaccuuuaugggcugaguguucuucuugccuuuacuuaaauuucuccuuaccuuuuugcuuucugucauugcuuuuggcuuuuuugaguugugaucuugcagagcccaggcuggccuuguauuuaugaugguucuccugccugagccuccccaguguugagauuguggcgugcagcaccaccauuccugauggcuccucucuuagccggaauguucuuuggucugugugcauggggugaaacauuuaugcaaagggaugaaauccuuugcuugcuuugguucuuuuucuucauauauucuguuguuaacauaacgcaguguaggucacuuuaaccacauuuuagcuuuuuuuuuuuguuuguuuuguuuucgagauagguuuucucuguguagcccuggcuguccuggaacucacuguagaccaggcuggccucaaacucagaaauuggccugccucugccucccaagugccgggauuaaaggcgugcgccaccacgcccggccauuuuagcauuuuuuuuuaaaaaagauuuauuuguuaugugcaaguacacuguagcugucuucagacacaccagaagagggcauccaaucucauuacugaugguugugagccaccaugugguugcugggauuugaacucaggaccuuuggaagagcagucagugcucuuaaccugcugagccaucucuccaggcccccauuuuagcauuuuuuacauuucuuuaugacuaaauuucaaaggguuuuccauaauuuauacucaauacaaaacaaaccuaagauuuacagcuuuucguaauugauccaacuguuuagaacuaaauuuuaauuaaaauucucuggauuuguuugucauuuugcuuuguggagggggugcggggaaggagggcagggacaacacagucuuaccuagcucaggcuggacuugaauucacaacucuacuuccucaguuucccaagugcuagacuuagaacugugugccacaaugcuuaagucuuaagaccuauucauguuacaaauuuaauuuaauuugauguaguuuggaauugaaguuacagaccauuguagaauuuuauagcgacugauuuuguggcaaguugaaacgaauaguuugaugcguuugggucucaaugagagccaugcugaugucaguagucagagaagcuggucauuugguuaggacccagaagcagcuagagccaugaucuugaugguuguuauugagauguuuaaucagucuuucccccuaacuaaugaaaguuuccaaguuaaauauugacuuuauuaagaauaaacuaaacaagaauuugagggucaggcgucugggcagagggcaguguagcauggagcauuugguagacugaggugaugauguuucauaauuaagcuuauucccagacuugaugaauugagugugugaagcaggugugucuguacuuuugucagucacgccucaguaagucacuuacacuuuauagggguguggucacgugagcacucggugcacaugacuucuuuccaucuugagaauuggacaagagcaggaaggugauuggaaaugcuuuaacacuaggccugagagaugcagucuuuaggcuugauuuucauagauuucucaaugguuuucaccaggacuaaagcuaguuuugcuuuacccacuuugcucacagauagggauguaguggagguggccacaagcagauaugucagcgguagugagaagcagcacuggaagcugccauggcagaaaaguggaaagcagccacgaccugggaauaaguuaucuaaugcucuuuauagaaaaagagaagacuuuccuuugucuuaucggucccucuaacagcuuucucuuaguuaaaaaaaaguucucuauaguaaggguuguuucugauaccugaguagaaauuaggaugguaauugaguauuuaaaagcauuccuaugaaaauuaaacuuacuggcuauaucuuaaacagcugaaauauuuauaucuguuuuugaaaagauauagcaaaaaauaauggagauuuuaagggaaaaaugcagcacauagcuggguuuuuuugucuuuugguuuuuuguuuuuguuuguuuguuuuuuccuuagaagaaaacaauaaaggaaacauaguaugugacuucagugcuuuguagcucugguaggcuccaguuugcagugacucugacucucuucugccuccugagaccuagagucauaggcuugagcugcccugccuggccuucaguauuagaguguauuuuauuuuauauuauauauauauauauauauauauuuuuuuuuuuuuuuugagacaggguuucucugaguaguccuggcuaugcuggaacucacuuuguagaccaggcuggccucgaacucagaaaucugccugccucugccucccgagugcugggauuaaaggcgugcgccuccacugccuggcuagaguguauuuuaauaguaccagaauaauaauagagggaaccacuuaucucugagguacuuagaccgcuaaccgugugaccguguccaucauagauuguaaucuucccauuugugaaaugaugggacauccuaagcaggaugcuugucuuuuagcucuaagaccuacagugucuguaaaucagaaguguugggaucugacuggggagauccuuccccuuugcugcuguugacauuuaauguuacguggcagggagggacagauaggguucuuucagugacuugagauaggauguguuauuucuguggguaugugcacgaugcaauuccauggaaguaaauacaaauuauaauuauuuaauuaaauugcaugcuuauuuaagcaggguagcauaaucacucacugauaacuuuaaaauacugucagaacagguaguaggacauucacuaucauuucacagccuguaagguaaguuacaaaaucucaggugggcugaucccaacagucauaacucuauaaauaugugaacacaugagugcaaacuuaaaauauuuagugguugcacaguagcagcgaauucucuagaucugugagcgcacauaaggaggagauguuugauagugaagacuguggggaagccuaagccaucugcguguaagguagccaugauuagagaggaggaagccucagcacagucucucacugccauucccaugggagcugagggacaagagcugcacgucuuaguguucuuagagcuuacugaagucaaaugcacugugaaaagcagucuaaaaagguucauagccaucaucugucauuagaugaugagccgauccaugaacauuuucauauaugaacaugucugugccuuuggucauuacagauaggaucacagggaccaaagccagcuucagcggaguuuagaagcaccuguagcgacuugauaguacuguggcaucaaauaauaucauuacuuuuguugugauucacuuuugauuuuacacaaaucaauagaacaugauauacaagagaugaugacuuacagugauuuuuauauuugugcuugagaagcauuggugguuuuguuuuuccugacuaagaauauauguaaauugaaaagguuauaauaugaaauacauguaauucuuggguaaaagagaucggaagaaauaaauuuuaauuuuauagucuauggcagaauuaaauuccuauaaaaugcuacuaugacuuuuguuuuaaaaaugagaauuuuuuuuguuguuguuguuugguuugguuuugguuuuugguuuuugguuuugguuuugguuguuguuugguuugguuuugguuuugguuuuuuugagacaggguuucucuguguagccuuggcuguccuggaacucacuuuguagaccagacuggccucaaacucagaaauccgccugccucugccucccaagugcugggauuacaggugugugccaccacgccuggcuaaaaugagaguuauuauacuagagauuagagauuaauacaugaggaaacuuagcagcaaggaaggcacaguuaaaguugguuauugguguguacagucauaaaaauuguguaucauaucuuuugaaaacaaaauauucuuuuaucagaguuagauauaggaacagaggugugacugcagugccccaggcuuugauguuccaugcuguaguuuuuuuacagggccaccacaggcaguagguguaaguuaggcagaugagcagucuaagcauccugauauucuuggauucuuuuucucucugucagggugguugcucacuuaauucauuuuccuccuucuucuagaauacaaacuauggaauagauacuauguuuauauuucuuuggccugcuuuagugagucaguaagacugaaacaucauaggguaacauucauuucugucaguuuuaaguuaauuucaugacacacuaagauuuuuggaacguuuguucugauuuuaaagcucauaguaggacugagagaaguggagcccagaggauagcucaccugcugugguuugugauggaauguggguggugggagguacuuguggauuauuuugcuugaguacaauucacugguagcuugcucccucauuauugcuuuguuugagcccaguuugggucuuccugguucuagucgccaucacaaagcuuacugaugaaaacuaguuccuguuuuguaaggaauacuuuauuuuuaauugguugugcagugagcauuuguguugaacuaagaaacauuuuuuuucuucccuuggggagggagggucagagcgcaggguagcaugggaaggcagggccucugcauagcucugacugagcugacgcugacuguguugacagacuggccuugagccacccagcucugccucucaaguguugggacguaaggugugcauauggcucuaagaaagcuuucuucagauucaugacugaaagagaauuuugucuuuauugauuuuucaaagggagcacauuuuguuuuggagggugugugugugugugugugugugugugugugugugugagagagagagagagagagagagagagagagagagagagagagagagaaauagcauauccaaacaacugaacugaaggauguaccuuuuacacaguauguaacacuuggacagacuuggcacccagucuucaaacauuagagaguuuugaguuaguuuuuauauagcagcaguuguuuaauaaauauauggugcuuuuaccuuaguccugagagcuaguagaucauugugagauuaucugcuugaauuuaauguacccuacuggggucauugaauuuaugaaguauacauguuaggaagaauguggccuuguuaguaauucauuuuguuugccugggauguagguguggcgagugaauuaguaaagacgacuuuagccaacccauguuaugcucaccaacuagacaauuguaguucuuaacuuuuuccuuuaguuuucaagagugaguuaaucuuuuaggcuuuauuucuuugauuaucaucucuuauuguuucuuaccgauuccuucaugcugguaagauugagagacagagucuuagguuuagauaaaugacauuuggauugcuguguguuaagagauacuuuaaggugcagaguugguuucuuagagacaggguacuguaauuaagaacagguuuuugagccugaccuuagugguaagagucuagaaaacuuauuuuaaccucuucaaaucauaauaagacaaguuugaagauacucagauucauuuaaagauucaacuaagcaaauacauagauauauguuaaauuuuuaaaaagucaggcuggagaaauaguucaguuaguaguagagugcuugucuugcauauauccugcuugggguugaucugauccucagacugcaaaacccaaauguggguuuauacucgggaggagaaaugaggaggaccaggaauuuuaggcuagucugggcuacaucauacugugucucacacaaaacaaaacaagggacugggaagagaugacucauuguauaaacugcuugcugucccaaaccugggaaccugauugugauucccgcaccacauagagauggguguguugaaaccugugaccucagguuuguuagcccaugccuagauguaaucccaguaucccaaaggcaagggcaggagagagaauugccucaaguuggaagccagcauggucaauauacauggucuacauagauggucauccuguguagcaaaguuggcuuuaauuagguuuaguggccuguuuguacuccagugaauuuacguacugaucauuaaaagaauuauaauucuauaauuaccuuguauaaguaaagauacacugaaaugauuaagcaauuuaguuaacuaagggaugacucucuggaguuggaggagauugugggagaaaagcaugcuuauuuggaaauaaguguguaguaaacuuaggccauucuugucaauggacuucacaguugauuguggagagagauguuggguuguuacugcagaagauaauggauuuggacugucauaaacaucaagugaagggauauguuugcccuguguucaugacuuaccuguuaagcauguguuuuuuagucauuguuucauaguacaaauaauagagguccuugcuugugaauuugauauuuagagggauuucuuguaauuugagguaagggaaacauuuuguuuggggacagcaucuuguuuucuggucugucauuguugaugaggaugguguugcuuuguagucacuaagggcucuguguugugagcacuggccuguuucugaauguuuuugaaaaaacagauuuuacuguucauuuauuucuaaggacagaaaggcugacacugaaaucuugagugagugaauggaucuuuuguaagugugccugugcaauaagagggucaggaguucaaggucucacuuacacagugaguucagaagcaguccuggcuacagggacccugucucaagcaacucuucucccccacaaccaucccucaaacaacauaaaaagugcauaaguagagagacuuaacuugcccuaucagggauaucaguagcuaucccccagacuuaagucacaggccaaauccuuaggaaagaaaggcuuuuguaaaaugaggguaggaggagguguuaaguaguagcuuugaaggcuuugaauuuuaagucaagguucaaaaugcagaaagcuaugauucuguaaagccuugaguuuugagggugucuccugucuccguuguaucauucauuuuccacucuugagaaccugacccuuuccaguaaagcuuguuacacuucuacucuagaauauauuuucaaccuuuuuuucuccuaaaaacuugagcucaagaggccuuuaaaacuaaauccugacaaaaaguaagacaguguucagcuaccacuaucuuacugucuuaacucuuaaauuuuguaagcuauaaaaauuagucauaguagaaaaucuugacuccggguuaaaaaaaaaguauguuuuagagagggugggggggaggauguuagaggcacuacuggguguuugaccccaggacaaggacacuggggacucugcuguguugcugguuugcugggggacagaggaaagaagcuguuuguuagagggcauacaaguccccaggagugcucaggcuguuuggaaacaagaucaacacuaguauuggcgcuuuucuuuuuuuuuuuuggauaauugcaauucucaacacuugucugcaaguuuuggaagcuaaggggaaggagaaagguauguuugcuuugugcugaaggaaaauucacacuuuuguuuuguuuccuucuuccucacuguccacuugauucucuguuucuguuggucuccgauuucagcuaaucaguaguuuuuagccuaccagucccuuugcauucugcauuuauuacacucacucccauguucugccaugguacuuagccagaggcaguuucaccuugugugcauuuggcgaguccugaagacaguuuuguugauagugugguaauagugcugcugugggaaucuacuggggaagacaauauaagccucuauaaauaaggcuugggcaccccacuguaaagguuuauccagaguguagugcugaauuugagaaagaaagcguguccagugauuugucaccugcuuccaguuugaugccugcaccuccuccacacugauguagaacuuccuuucugagaugcacccaccucugccaacucugucucaaccacucccuuugccaauggaagugcaaauuuguuagcauagauuaugacaaguaagugguuuuuuaaaauuguuuuuaggcuuccaucugugucucuuuauuaacucucgagugguccagugaugcaugaacuccgugccaccuugcuuugaucuucaguuuauuuuccuuaggccuccauucccacuugaaauacagucucagugagcccacgccccgacucuguccccuuccuuaccccacugucccccauuuccuccugccuuggcacacuuacucugccuuaaacauaugcuuaagcauuugacuccuugugaagugccugucucugcucucuugguaccucagucauguguguuaauacauguguguuguggcggugaguuauacuuccuguagagccuccuagacuacaaccucuguuccaaggaaagguacaugugugugugcauagcauuuguauacaaaguccuuucucggaugcucaguuguaauuuuuuuuuauuagaacucagcugacuuggaaauuagcuuacagauggaacauucuugugguuuuauucugugcggugaggcuaauauauaagccccucuuuauuuuucucuauacucuuuuuuugcuauaccuuuauguucccuguugcugccauuucuuuuuaugaaugccauuuuguuuuguuaauuuguauccuguagcuuuugguacuuuuaaaaucaaucucuuucucucucucucucaucuccccccuccacuuuugaccucccccccuucccuucucccucucccuccccuuccccacgcccucccucccucccucccuccuccaagauagggucucacuacguagcucuggcugcagaccuaugcagcuuguuggcugcuuauuugaaucaagagcuugugucuguuacggcuccacaggucccuuuaguugcagguacugguuauggaauagagggaaaggaguaagaauuguuugggaaaaaacuaagaaacaauuauaaugagaauuguuggggcugaaaggugauaucauuguuuucuauauuacuaguguuccauauagaagaugaauucauugcauugacuguuuuaacuggaucaaaaagaaagugaauuaaaaaagaaaagaaaagaaaaagaaagugaauuuaaauugcuguagaacauuuaaaguuuuauauauauauauauauauauauacacacacacacacacacacacacacacgcacacacacacgcacacauguuuguauguauguauguauguguguguguguguguguauaguuucacuauaugauuagaauugaagaaucuuugucuuaaguguuuuggccaguugugacuuuuaaaaacauuuuugcuaugugcacaaguguuuugccugcauguaugucugcaccuugugugugcaguaucuauggaacccagaaagggggaucagaagcucugaaacuggagcugcauaugaugguggguccugagaauugaacccagaaucuuuggaaaagcagccagugcucuuaaugagugagccauuccccccccauaugauuuuaauuggccuuugauauuuuaacauuugugauagagguagaagaauuuauaccccaggauuuuucuaaaauacaaagucuuaauaguaaauguuuaauaagguuguuauucucacuauaugucaaagccuuacaguaauugacuugaacacaaaaauguaugaguuuaaucuuaacuuuuucuaaggaguuaugauguuaauuuugcuuuaaaaguguuccacuuaaaaagugauuguggcuugagccaugaagcacauagaauguuuucacccagagacguucuuucugauuuagacaugcaaggaacugcuuuagcuuuauaaccucuacuguucagauuauugggcaggcagguaaaauaguuucuuucuuaauucaaguucaauuuuuauucaccuuauuaguguaggucuuauaaaaagaacugucuuacauaguauaguuuucauaggcguuuccaggguuuagaaauguaaaaauuguguauuuuuuuaaauugaugauucuaccccuguccuuuuaaauuuuagcuguguuuuggcugcuuguauguauguguacaaugugugugucuggugccugaugaggucagaagaguguguucgagcccuugggacuggaguuauaaauguauguaaggugccacaugggugcuggagauugaaccugggucuuuugaaagagcagccaggugcuguuguuaaccauugagccaacucucuagucucuuucaacuucuuuuaaggucuaauuuugcuguguaguuugggcuggcucaacacuaagaaugcuucucuauuuuagcuccuugagugcugggauuauagguuuuugcaccaacaugcacagcaaaaauaagcucccuuuauauuagauucuaaaagcaaucuuacccugauguugcaguguaaugauuuuuagugcauuacauaucaggcauagcaguaaguaaguguguggagcuuguuucagguuuuuaaggagauaaccuuucaagcaguuuauuuccugauggggacacacacacacacacacacacacacacaucuuuauguaaguuguauuuaugcacauguuaccuuuaaggugcagugaauguaguuuguacuugcuguaauuaagggaggaugguaagcucuaauaucuucauacagcccugcuagcugcugugagagugguguacuaacuuuauucguauguugacaaaugaguuugccauuuuguugcacaauuuacucgcuuuucgcuauuagucuguucagguuacuauaauuuaaaaaaaagcugugaaguuuuuguuauuguacuguuuacuuuuuaaaauuuuagucuauaauaucucaguuuuuucaguaucuuacuuugccuacuuuagaguaacugccauauuccagccuaugguacaaagaauuaaaauaauuuacaaaaugauuagcaaucaguugcuuccuuuaacugggguagcugugaacaggaaauaagauagugagaugaacugcugaagaagauuggagagguggguuuguuuuuuuuuuuaaucucuauuuugugccccugaaaccacuuuuccauauuucagugagaauagguaaguucauugggaaguuauauaaagcauucaccuugcuaaguuaauuucuguucaugagguuauaagagcagguaauuuucuacaacauugguuauuuauguagcagugaucagccugugaguacuaugguuauuuuagagccgucugguggggugggagauggugguuguuagaaacuuagaacauuccuagcgauuuuauuuccuaucacaccuuccuaacacuuucauuauauuagguuagauuaguguggggauguuaggaguggcucgguuucuuuccuucuuucuccuagccaaggaaguaucgccuggggaugcuggaggagaggcuaguuccgaugggaucacaggcacgaaaagcaaagaacccucuuggcugccuugcugacaggugugagucaggagugcccgucaguaugguuuggugggacagagucccagaaaacaauuuacagguaaaaauaauuucucuuagacauaucuugaaagugauucuugguuucuuugugggcugguggauaugaaaagaugggcuggccuagcugauacaccuuugucauucaauuguuuuucuaaagucaaagcaagguuaguagucuguuaaugagccauuauagaugauuuuuguuugguuugagacaggguuucucuguguagcccuuucuguccuggaacuugcucuguagaucaggcugacccugaauucagagaucugccugccucugccucaggccuggggcuaaggguaugccacagugucugccucacagauacuuguuuggaggcugccuccucuucuuccuccucuucuuccuccuccuccuccuguuuucucccucuuccucccccacauccugcuugggaggguuuacuugauuuuuuuuuaaguuuuguauugacuuguguguugcacauguguucaugucuguacauguguaugucuuggagcacauguguaggucagaggacaacccauggaacccaccauacgggucccaggaaucaaaaucagauucucaggcucggcagcaaguauccuuauugagccaucuuguuggcucuauuucuuuguuuuuauauuaacuuuuccuucucaauuuuguuauuugaagauauauuuauuuauuuugccuuuuuucuugguauuagggagucaaacucagguccucacccaguucuggaacucacucuguagacuaggcuguucucgaacucauagaaaucugccugccucugccacccaagugcuuagauuaaaggcgugcgccaccaccucacuuauauuuucauucuuaaaaauugggaacuauucuaugauuagggauaguacuauuauaacuuuaguuagaaauuuguuuuuccagguuuuggauuacaccccacauguuguauacaaaaagauaauacaaacuuaauaacuugguuucacuucuguuuuuaaauuugauccuauaacauuuuacucuguaauauuaauuuaguagcaauaauauguugacuuuggcacaagaauaauuuauuccaaaauauauugcaaagcaugguauuuuccuuaacugaaacuucagaguuaaagaaaaccaaccaaucagggaguuucacagaauuauauuuaaaacaauacuguggaaagguuuugaauaugguaugaaugaauauguuaugaauucauauauuaauaguuuuaaagaaaauuuuuucucugagaucuauagaaaaaagcuauuuuguuuggguuauggcaaauguuuuucaguuuuaaaaugcaauucugaaaaucugcugaaccagccggcuaagugagugggacagugacagggcugagguccagcucccuuucuggcucucuuacuacaucugucugagcgccuuuucucaggagguuaguaagagagugcgcauuugaguuauaauucuuaacauugccgguaaaaacauguggcucugagguuaagagagcauugggugcucacaaccaucuaugacucuagcuccaggguguccaacacccucuuaacaaacaaacaaacaaacaaacaagguguccagcacccucuuaaauggaugaaugaaugaauaaaaauuuuuacuaaugagugaaaaauggacucccugucaucuaacccuaacauauuucuaaugcuguugcuuuaugcuucacauuuccguuaaagcauggaagguucucccagcucagaacuugucagcuugaaaugccucccuacccaagucucauggccugaaaacacucagcugccuccuuacuguguuugugggcuccuaaaccaggaaccaguaguagcucugagcuaaggaagucauugugcugucucuccucccccucccccuguccuguccuguccuguccuguccuguccuguccuuuccuuuccuuuucuuuucuuuucuuuucuuuucuuuucuuuucuuuucuuuucuuuucuuucuucauagaaauaaauuccacaccuuuuugggaccuuuuaauaugguuuuauauuuuuaacagaacaauuuuaaaacaguuuuacagccagauucauuauuugcauuuuuguuuucauuuuuaaacgauuagauuucucauucuaagagcacuuuaaaauuuauucaaauuuuauuuaaaaauuauagccauaucucauaggugguaagcuugauagagacucugcuuuuacauuuguugucucuugguuaaauguuuauggcaugaggguuauaguuagugaagaaacccaucuugagggaaguuaacauaguauaaagaauaacauaguauaaugauucaguaaagagguuggaacccaugcuuuucagagucccggucucuccccuauuuuaccuaaaucagcaauguaauuguucauguaacucuguaacuaagcuucugccaggaaacuucauuuugagaaugccagugauuagagcuuaggcauaauuugugccauuugaaaagcuagacauuuuucaugugauuuauugaagugacaucaagcuaucuuccucagauuuuuaaacauuucuuuucauugauuuauugaucuugacaugaguuuuuuccacuugugaaaaccaguuaaaaauuagcaauaacuucuccguuuugaggcuuguuuucaacuuaauuaacguauuuauccuuugauaguuucauguauguguacagugaauuuuaguuacuuuuacuccuguccuuuugucucuuuucuucuuccauugaauacuucuuuuccaauagucuccucccuguuuccaugucuuuucuguugugaaccaaccaauuugugucuuucuugagagcaaauguuuuuaaacucaugagccaucuuucuagucuccuucauuuuaaaaaauguuaugugugcuuugccugcuuguauguauguguacugugugcuugcuagugcccauagaggccagagggggcguuggagagccuaaaacuagaguuaacaugauugagaaccauuuuuguggguacuggaaacugaacuccagaccucuggaagagcagccagugcucuuaucccaugagucaucucuccaguuaagugaaggauauuauaaauuuaugauguucuugguaauaacacaugcccauugaagccaaaaagcuagaaaagccauuacacuuguuacuugggauggcaaucuuagcagucagucaguuauuuucuguagugaucauuuuaaauuuuguugaucugaucugaguguaauaagauacauaguuaaaaucagaagagaaagcauaggguacaccauuccuguuuaaaagaaacuaaccauuccagaaucaacauggcaaauaauacccuaaucagcggguuuccacuuaugcuuuggcuggccaguuuucaucaacuuggucuugucuugucucucucucucucucucucucucucucucucucucucucucucucccucucccuccccucucuccucucucuccucucucgucuuucuuuuaaauuaaguguauuuaauucuucaugcuagcccagacccucuccuaaaaagauuuccaugagacgacuuugucaguggcuccauuuucuuguucauuucuuauucugcccuacccuuaaaagcuuugcuuagauuuucucaucuuucuuuaaagcccgugugcagaaucuuuccucaagacugauugucuucuacugcaucucuuuacacuuacaguauccucaacgucuucaucauuucuuucuguuauaagucuccucuugcuucccgccucccaucaucaaccaguugagaacagaauucaaacccuucucaccaaggaucaugaacacuucuccugcuuugaagaugauguuuucuucacguguucagguuuaucagguuuuugucugugugagaaaaggcaccaacacagcaguucucaaccuggggcugaguggccuuuucacagggguugccaucugcauauuagauguuuacuuuaggauucauaacagcagcaaaauuauaguuacaaaacagcuacaauguaauguuaugauuggggcucagcauagcaagaggaacugcacuaaaggguagcagcguuagaaagguugagagccaccgcucuagagaaacugguuacguuucaagcuaggaaggagcuuucaauuagaucuuauacugagaucuuuuucacccaacaaauauugaggagguaaaugauacuaucaaccccagaauaccgaaguucacaacaguuaagguuguguguuccucuuuucugccuguguuucuuguucacuguacuugguuuguccucaaguuccuguugcuucagcaugaagcuuuuucuucucauuuccaucuugaaguucuuguggggaacuaaaaacuugcugaacuuagaggaggucaccugucuuuacuucccaaguguugcgaugaaaggccagugccaccaagcccaccuucuuacccauucuuuaaccaaacauuuguguucuguaauuuuuugcugucccaacccuggaccuguuagagguugagcuuugagaugaguacacagcauggguugcgaauugaggagauggccacacagcacagcuucuaugauuaaagcucugcacaaguacgccuggcaaaacuaaauguuugccuuccauacugagcacgcaguaccacuucuuagcugagguuuuccugcugauuaacugaaggaugaaaaaaucaggcaguauauguuacuguuguauuaaauauaacccauuugccaaauggaaaacugcuuuaggaaaaaaacccaguuguaauuaaucaagaucuaaaucuugagguuuuuuuccuuauuauagccugcuuuuaucccugcuuuuugauaguuugcuugugguaccucuccuguuuuugguuuucaugauucucaccuauuuuguuuuucgagagaggguuucucuguuuagcccuggcuguccuggaacucacuuuguagaccaggcuggccucgaacucagaaauccgccugccucugccucccgagugcugggauuaaaggcaugugccaccacgucuggcuacaaaaaaguuuuaaaacaaaauucucaccuauuuauaccuuucacuuaagugucugaaccagugcuaauguuaacugcugggccaucucuccagccugugucugaauaucugauuggguuuuguuuuuaagaucuguugcugccuuccuuuucugggccguccuuucugucuacauacauuguguuugacuuggaugggcucuugcuuuuuuggggaggaaggugguucauaacacaggcacuggaacguguuacugagucucuguacuucuguuacacugucucauuguaaguggggccugaacguguuucuuuucucucaggagaugguguuaauguggccuucccagggagcacuguuaagucuggaggaaauagacauaucucacuguucucuaguaguucuuaguugaaaguuuuucuauuuuugggugauuuucuuuaaucuguuugucguuuuccacugaauugugcacuauuugaaacuauacuuuuuuucucaaauuauuuuggucauuauuguaaacaucacuuugauuuucuuuuacugagcaguuauguguaauuuuguaguaauuauucuaaaaccauauguauauauagguguuagugugugugugugucaugcaugcauggguacauacaccuaugugugugcuuuuggagccagaaguugacauuggugucauucuucauaucuguuugcuuuauuuuaguuuuuauaagaauuauuuuacguguacaguuguuugcauguauggaugugugcuuggugaccauguuucaucuuguaagaaucugaugccuacuugaaugacaggauugagugauguaaagcucuauaaaauguuugugguauuagagauuagaauuugccugaaaguacugauguauuaaaggcauucaugcugccucagaaguuuuaaaauaguuaugaaccauaaguuuuucgcauuacugugauaguagcuuaucugguaaaaugaugaaaugcaugaagacuguuggguuugugcuggguccggcauggcugcauaaggggaggugugacacaguuccugccccuggagcauuaccaggcuguugaucgucacgguccccacacgugcugauggaugcuguugcccucaagcugaucugcugucuuuacuacuuuacuuucagucucucucuggggaauauacuucccccguugccauaaucaaugaaacagaugugguucucaggagugaggaauggagguggucaugaggcugaggaggaugaggagcaugccuucugcuuggccuuuagggccaugggaaaggaucuagacaacauaaccacagaggccauaaaagccuacgugguccuuuguugaaauaguucauugccagacuuggccuugaauuuaaaaucgugaggagauacagguacccucugguccaaugacugcugcauuaauuagccagggugaacuuggggacaucaaggacagaauuaaaguggucucaagaagaaaaggcacggauagaaaaaaauaguaaucuauaaaauaugagugaacgauagacaguuuuauaggagaaagacuuaugauguauaauuuagaacaaaugguacuagaaggagaguacaugagggcauuggaauugcuaggauaggaagcaaagauuagagaaauaaaaagaugauagauaagcauauaaaaaguuaguacuuuguucuucuggcuacuugaagaguuggaguugauagugccuggagagacaaagagcucacuguguuacuuaaccuaaaguuuaaaacuuuguaaggaaucauuuuaacuuuaguaguauaucaucuuucgauuuuccaugaaaauaguuacuaaaagacugcugucugcuguaccaagaaaccgcaagagcugugccuagcuagccgugaagaacaggcuauguaaaaccuaugaggaaaugugcuuuugcuuuguguuuaguuucugcucuaagggagugaggcuugggacuauugaucugagacucaauagaauuuauguaaauguaagaauuuuaaauauuaugaacaaugagcaaagccuugaugauauaauuuaaaaaauaaaagacuggguuuaggcucucuggucagaaaggaaaagaaggaaaaugaugagaauccucagggaacagagagcaccugaacugacagcuugcaucugcuacugacccugagucauuacugaaucagcaccacucccaucccugccucucucaggacccuucucacgcugaggcuggaccuuggcagguuugugagaggauccauuugauuuccuugucuacuugucaguaucuccuuugauguaacuucacccucuugagaccuacuucauaaguaggugcacguuaguguuauggaucacagauccuucugugagugcuuucucuaacuggugcuucuuuuaggaacucagagaaguuuuggaagcuccuuagauaugcuuaguucuuuaguuacucacuagguuagagugcuacuucagguagguuuuagucuuuagggcccagggauaggaauauuauagauuuugauggaauagacuggaauuaguaaguguaagaguuugcuuauauuagguuauauauuauuagguuagaguuccuugggacuuuggagaguuagagaacugcagugacugcagucccuugaagugaaugcagugcucucugccuccauccccuuagcacugucuccaucuccccauucccuuucccugauucuacccagccugcuguuuccugguaaguaauggccagugaaccugggagauucuuauucagacccuuuggugcugugguuuguguucucuccugguacaggaugccuuggaaucuggcuuuacugcuguuugcagaucuuugcuuuggcuuuucaagaacuucuuccuguagaaagauuucuuccuucuaacuuauaaauaugccauguuuaucuucuauuaucuugguaaccagcaagaaagaauacuacauaaggaaagggcucauaugucugggcaacugugcagcagauuugggagccuaguuccuacuugugugagcuccuuucaugccuuucguucaucccuuagcugaaguuugcacuuucaccagucacuugaaaauaauuuugauaaggcuaucuacuaguuagaaguuaauggcauuuguauuaguuagcuuuuuguugcugugauaaauaccacacccaaaaguaauuuaguaaagaaaggguucauuuuggcuuuugguucuagagguuuagagcacaugaguggugaggagggcauguuaguuagcaaguacauaacauuuucaucugcauacaugggaagcagagaacaggaaauguuguaaaauuucaaagcaugcccuuagugacauaguuccuuuaucaaaggcuccaguuucuaaagguucuuucacugccaccccuaaacaguaccaccagcuugcuagcuagagcuaagugucgaaguacaugagccuguagugcaucagcuugcaaccuguagguuucaaccucuuugggggucuuucacaggacccuuuuacaggggcagccuuagaccgugugcauaucagauauuuuacauuacaguucuuaacaguagcaaaguuacaguuagaaaauagcaacaaaguaaauuuuugguggaaggccaccacaacacgaggaacuguaucauugggaagguggagaaccacugcucuaggggaacauuucuuauucauuuggcuacacucugcuccguauucuccauaggcauggccauaucaugaugcagauggauuuagucuaauuuuagaugcccuuggaguguuugacaauuucaacgcuguucaaaagcccaaagucucuucugacacaaugaucucuuaacuaucauuaaaaaaaaaaaagaaaagaaagcaaauuauauauuuccaacauacaauggcauagaauauacuauaauaaaugggagcacagccaggaaaaacuggaccaacacaaggcugaaacccagaaggguaaauagaaaauucuguagcuccaugacugguucuagguguuuaguugcaaagggcuuauuacuuagaugacugcacuucuggcuucguuaucugcaacaugcaucucucuuucgggcuuguuuuacuuucugucuacagcuagagagaugaguuagugucagaaguggaagaaguaacgguuaggggccaggucaaaaagaagacaccaggcagugguggugcacgccuuuaaucccagcacuugggaagcagaggcaggcggauuucugaguucaaggccagucugaucuacagagugaguuccaggacagccaggguuacacagagaaacccuguccucccccccccccccccaaaaaaaaagcuagguuuuccggagucuggagagauggcucaucgguuaagagcacugacuacucuuccagagguccugaguucaauucucagcaaccacaugguggcucacaaccauucguaauaagaucugaugcccucuucugaugugucugaagacagcuacaguguacucacauaaauaaaauaaacaaauaaaucuuuaaaaaaaaaagaaaaggaaaaaaaagaaaagaaaagauaagauaaggguuuucaaauacaaaacgagugaagggcauauuaagggaaguagaauguuucugguguaauuucaggagaaggcuaguaaaguggugugguuacugaguguggcacuggucacugcugauuacucuuauuuagggugacaacaacaaagagcaaugaguagggcagggagaaauaaccgugcuuacuguaauugcagccaugcauauagcacgugacuugguugcaccuuuaagguuuuccuguacagaggcacauaguguauguaguguuuucucccugccccacuugauucucuugccuucucagagagcccuuuugcagauggcccaccuuuaguacuuggccugcucuagucacauuugauuuccaaauccuuccuucaguugucuguagucagucuuccuuaguauaugauuuauagaaacuguucaucugcauggcccagaacauggaacugaggaucagcgcauucucccucaggcgcaucgcugcucucugcgcgguugcacagucagaaaugguugcgugcacaccuagcuugguuauaaauaccugucggugcucuucguuguggcuuccucuagacucugcugucuuugucauguccuucuuccacugaugagaacucuguguccuucccucuguguccuuccuucucaguuaucuucauuuuuacuguuaccgaugguuucuuaccuuguuuccugcucuucuuaaguaccuuccuguuuaucugaccuugcuccucucaucuuugccuaucuguuuauuauaggaagagaaguugaggucuucuguccauguuguagcuuacuaccaaagccuguuggaagaccaugccccucaggcuucccugccuucgggccuccuuuuuagacauccauacuauauggccuacccuuaugucuaacuugguuuaauuugcuuguccuuucguauucaaauuaugcuauugucugaguuguagcauuagacacccgcuuuccccuuagaacuuuauuguagucaauuauuuauaucacaggcaaauuguagguaguguaguguagguacuuguguuaagagucccggauguucugggcucuuggaaacagacuuccauuuggaauguguucucuguggaguucugccugugagcuuugaagcacaguaucugugucugugccugcagcgccagccacagugcccagaauggcucuuguacuguugaaugacccgcuuuauauauuuuguuaaccuuuuccuugguauaguuuuaugacaaaaugucauugugaaaagaauugaaagucguaauguauuuuguggauuaaaucuagcugaauucuugguuaggaaaaagugcuucuaaauaagucugcuuuuuuguggaaugggacagauaggguuaccuguuagucauugugaauagaauguacauauaguuucuguagaagaaguuguaccugcaugggacauuccucucuuaaauacuugggguacuggcuuucuggauggcauacuuccgagacucccucugacagugagcuacguggcaugcuuugugacuguuagaaggauugggagcacauugaugugagugaccacagaggcuucgaaguagaauggugguccuagaugcgaaguucuuucuuguaugcacagugagcugcuggucucauuuaaaguguuccgauuguauuuggauugcuagugcaauaccacuguuuagcaaagacaugcaaauaaaauagagugguaugaguggcuuugugauuuauaaucuuaaacuacuguuuacaacuuucuaaaguauguaugcuuuugaaaauauucggaugugagagaaguacaaaagagaaauuaaaaaauguguucagccgucucacaaccuagagucagcauuuuugcuauuuuagugacgagcccuuauacuugucauauaccugccuguauauauacucgauccccuuuguaagcaggagcaagccacuuuaaaacauagcaguuuaucauugccuaugguuuuuaaacuuuaaucuuguuuuacuucugcuauccaugcugguuagaaaugcaucagcccacuuaacuuuugcugcuacacacuguugucugugccauaauccuuagugccagaugccccaucugaggcauuugguagagcugacccugccccucugcagcuguggcacuuggaugagcgugcacaaccaaguacaacacuguaggguugacucugguugagggggugcaggugagccagcccguaggguaagaguugaggagagcuggcuguguguguguguguguguguguguguguguaugccucccccccccccccaaccccaaccaccaccuguggcagucgggggaacugacucugaguuuaugagagugggugaccucuuccuugcugguuucagcacucagaagagugggcccugcaccucaucugggcagcauaguagaacuagcccugccccugggcuagcaugacgugacuugaguguggaagugggaacuggcccgggggucaugagaacaggaacacuguccuugcccccucuacugccuguagcacuggggagagcuggcccugcaccuggccugggcaacacaguggagcuggccuugaugguaaaggcaugggugagccagucccaaaggugugagagcaggagagaaggcacagcuccuugcaggcagcagcauuuggaagaguaugccccgcacuuugacuuggcaacacaguggagcuggcucuggaggcgugagugccagugagcuggccuugagggcaugagaacaggagaggugacucugucuccugucagugucaugaaggcauuggugaccuaagccagagagagcagugguagagaaccuacccugguugugaggagagcugucaggcugaccagcucagcuaccacccaggcccagauccagggcucugaauuaauuggcccacccacaaaucuauaucauuugcaaacuguugagauuggcuacuccaaagcugcaggaucuucaugacacaggacaguaauggaauaaccaugacuuccuauaggauccaguauugaugacggcacagaaaccagagauuucgaaccagaccaaugacucauuacaacgaacauuugcaagugaagauguauggacagagggauacacuguggggcacacugugauauacuauagcuuccaugaugagauguuuucuaugcuuuguuguuguuuuuuuauuauuuguuugugaguguuuuauuuuguaauaaguuggaagggcaaaaguugauaugagagaacgcggagaugagugggaauggggagcaugaugugaaacucaacaagucaauaaaagguacagagauuggauaggaaugaugggugguuagaguuuguagaagaaugggcuuaaagacaagaccauauauuaaaaaaaaaagagguauaaggcacuguuagcugcuuuaauauaauugauuguuauuccugaagagagauggaguuguuaagaaaaaaucauuuugagaauuaacgggcaagcauuuucugaagcugauaaaaaguuuaaaccuauagaugaaguuagcccagaaccacaauccaaaauacaauaaacagagggcacuaagcagcaccaggcuaacagugcugggggaagacacagcuuuguguucagguagcaucuuuccaacuggaaauaaugcaaacagucagugcagcaucagcuuuuuuucuaauuugauuugaaaaaggguuuccuuauuauguauccuugcuguucuggaacucacuauagagaccaggcugaccucaaacuugagagagaaugaacucuuccugccuccugaggguugggauuaaagguauaugcgaccacacguagcucagauugcuuuaauauacaggaagcaaaaaacaugccauauuaacauucugcauuuugggaaaauaugaaaauguaaucaaaugaacacuuauagaacuuggugaaacucaaguuagauuuguaguuuaguuuaaaaugauuacauuaggccuaaucccuaugauuuuggagaugugcuauggucauguaagauguugcuuugguaaaggcagucucucuugugacccaucauuucagauuaaaaauucucaagaagcaaaacaucaaguggugucggugguagagcucugucuaggaugugcaaggcccuggucugcaaagacaaaugagauuguuuucagacgccuaaaagccagagagucaagaccuguagccccagcauagagugagggaguaggauugggaguaggaugcuugccugggccgcauagucagaccuacucccuuuccugggggguaaaagaccaacaaguaaacaaaaacauugccaccagauauuuuaauacuaacguaaguauuuuagaaguaaauccccauggauucucuucucuacagaaucuaaauaacuacaacugaugcaaaaauaauaugaauaaauuauaagaaaaaauggcucauuucuuuuugaaagaauuggcuguucaaaaaaucauaaaaucuuuaggauuuauaacuguuaaaaugacaauaguaaagucugaagggagaaauggaaaugauacuuuccuuucguuauaucuugagauauuaauugacuuggaugauaguguuaugaacugaauuaugucccucuauccuccauuuauauauguugacgccuaacucuucacaugaccauaaguggagaugaggccuuuugggaauuacuaaggcuaaaugaggccauagggugauacccuaagccagaguuaguuuauaauaaaguuaguuaguuaguuaguuuuuuuuauaauaaaguuaguuaguuuuauaauaaagggauggauaccaggguucugauauacagaguacagaucuggggagauaaaaugagaaagcagcugucuacaagagagagccucaggaaaaaccucuggugguagguaccaccuugaucuuggaugucuagcuugugagacuuagaaaauggauuucuguuuguaguguccaguguuugguuaugguggccucagcaaauguaagacaguuucugaaaaucuaaacauauuucaaacccugagagaauuauuacaacagcagaacauacuuuuagcuuaauucaucaagagauaaaugaaaaaauacucagggucagggagggggcugcucagauggaaacagaaguccucuuccuccuccuccuccuccuccuccuccuccuccuccucucuucuccuuccuccuccuuucuucuccuuccuccuccuuucuucuucuccuucuuucuucuucuuuucuucuuucuucuuucuucuucuucuucuucuucuucuucuucuucuucuuucuucuuucuucuuccuucuuccuucuuccuucuuccuucuuccuucuuccuuccuucuucuuucuucuuucuucuuucuucuucuucuuuuuuuuuuucccccagacaggguuucucuguguagcccugguuguccuggaacucacucuguagaccagacuggccucgaacucagaaauccgcuugccucugccucccaagugcugggauuaaaggcgugcgccaccacggccgcucagugagagcaguagaggaagaguccacccugcacgcccugccccaggugcuuacgaauaaaucacacacauucaacauagacaaacaaaaagaaaucuacauuagauauauguuagaagauccacuaucccgcccaaaagauagcuaggacauuuacacauuaugugguacaagcuagacuuuggagcauaaaauaacaccaaauaaaaugauacacaagagguacagaguacuguuuagcuagcuguuaggaggauggacaggucauucuuuauuguugauuuaauuacuaacagaugacaaagccugauagaacugcaaagagaaacagauaacaguagggaggcugaggcuguuugcuuguuucauaagaaggcaguggagauuagagcuuuaaacaacucuuaaaaaccgaguugaccuaauuagcauuuauagaauauucugccuggcagcagucaaguacauguaugaguguguguguguguguguguguguguguguguguguaucucaagaccaagauaaagaccaauucuggauuauucugcaaaucucaauaaauguaaaagaacucaaaucauaaaauaugauuugaccauaguggaauuagaaaucggugacaugccuuuaauuaggggucaaagaagaaaucaaaggaagaaauaaaaagaaauuggacaauguuucaaacugaauaaacacacaucaaaagauauaggaugccacuaaguuggugguaaugauaggaaaugauaggaaaguuuuuuguuuuuuuuuuacaauaagugauuauagcuucagccuuaaaaacuaggaacaaaaugguaagucacacccaaugaaaacaaacucugagcagaaaugaauaggaaaaagaaaaaaaauugggggguagggcaggguuggagagaugcuucagugguuaagagcacuaacagcuuuuauaaagugcuagaguacaagucccaguacccauguagggcagccacacagcuaccuguaauucuggcuccaggaucugauacucuggccucugcagacacccacccugaugucacauuccccaccuacucucacagaguuaagaacaaagcgacaaauguggaucuguggggcguauugcuuuuuuuuuuuuuacacacacacacacacagacacacacacacacacagagggauuuaacaagaugaaguggacgauaucugaaugacagacacuaaauuauuugaugagcccucaguguauuaaagaauuauguuuaguguguuacacagggucucacuguguacccucggaacuagcguuguagagcaguuggcuucaagcuaauaguguaugugccaucacaucuaccuagaaaugagcucuguaauuaucuccccuccccaugccuacccuguauguauguauguauguaugugagacaauguuucuguguaaccccagcuguccuagaacuuacuguagaucaggguggcucuaacucagagauccacuccaccugccacugccucccaagugcugggauuaaaggugugagccaccaccaucuagcuguaauuuacuuuaauacgaaaaaguuuagauguuuuuacuuauggauuugcuccuaauauguaaaagaagaaacuucauauucuacauagacuuaaguaguaaauuuuuuuuuaaaaugcuauuauaaaauuuauucuaugaugauuucaucauggauauaacccucgaauccaucuuuucaacuuucugagccucuccccaauucaguuacaucucaauguccuuuuuaaaaaaauaauccacuguguccaguuuuuugcugcccauauacaaauggguguugggcaacucauugaagcacauuccuaaaggaaaauagacucuuccucuuccagcagccaucagcugugcauagguccucagccagaggagggcgcuugugaaccccuuuauuguuggaauguugaaugguuugcucuuuggucuuggauaggucaccacagcuacugugagguccugagugagucuugaguugguucuaugucguccagaaggcacuauuucuucccagucuucuccauccccugcucuugacccucagaugaggaagagguggugugaaguagauuucucguuuauggacgagcucuccaaugucacuuuuuugcugcacuuuguccaguucugaguuuauguguuaaucacauuacauccauuacacagacauguuucucugagggcugagagcaucacuaaucugcagcuagagaugcucauuuagagagcaguuugauacuguacugugauauuaaguuuaguucuggggacaauaagccccauagccauaguccuugaccagaucuacaguaccugccauggguuuucuccuggggagugggccacauagccgaccagaaagccauuauuccacagcauccaugcuauucugcuguuguacucagggccgugucuuuccaggcuagcuguuguuguaacgugcaggauccuuugagggguaaaucuuuggaugauguuucuuccagcagcccacagacuaccuucuaggucaguacuagcuugauuuuucuguccugugaccaaaaugugugcugucuucaguaauaggggcuuaacuaucaaguucuggugggaggccaagggcagugggaauagccuguauuguucuggggaacucugagcaacaacuugaggggcaaaauuucaaaccuggcauugggucuauuugggagccuguguuuugugggaggaggagcacugucccuuaaguaggaugacuaguuaguuauaaacucguguguguguuugugugugugugugugugugugugugugugugugugcgagagagagagagagagagagagagagagagagaaccugaaagccuauaaaauaaguuuccacauucaguuuuccagccuauuuaguauuaguuauugcuuccucaccuucacaucuccucugucuucucauccuucuccccacaccuuccucccguuuuucuuuccauuucguaucacccauauucuauaaucccuccuccuuuaaaaucuuucuacucuccucuuacucccaguggccccuccuaguuuccuggcuuccagguugaacacugaugucuacagaucccauguuagaacccacacaugggcaagaacuuggggccuuugcuuuucugauuugggguuaccucagucaguauaauucuuugaaauuccaucuauuuacuuucagauuuccugauuuuucccuuacuaaagcuaugcaguucucugguguguaggggccacauuuccacuauccugaauguguucuuuuaucauauugaccgacuuccugagcuuugccaugagaauaguauaaguuagggaaagaggacacgaugcuuuucuguccugccuaacaugaucugucaguagcucccauguguuuauuccuauauucuuuugagcuuauuuauuucuaagcucgaguucucacagguaaacaaacccgcaagucaccuacuuagaggaggagcaggagagauggaggguuaggaccuuucaccugcuuaacaguuuaacaggcuuuugguuucggugguuggugguuucaguuaaguguguuaacuuuaagauacauuaauuuuuaauaacuucuacuguaaugaguuuggggcccuuuuauagaugauugauuguuguaagaagagugaaccuucucuuuuguuuuuuauagggacccuuaaaaauaggcuuuuauggggcuggggaauggcuuuguuggugaagugcuugcuauuaaacacaaguccuuaaguuuggauccccagcucccacauaaucaccagggguaauaauaggcuuuuguaaucccaguugcaaggauuguagaaugaaugauaggauuccugaggcuuacuggccagcccauuuagucaguaaauccuagguccagugagaagccauuuuaaaacugaggugugacuugguagagucaaacagcagauauugacuucuaaccccacauggaagcauuuacucucauaagaaguacaaacacaaacaccuuccucuuccaacauacacagaaaauacgggcuuuagaaagaaguaaaaauggauuuaaauuggagaaacucaacuuggaaaucugguagucuauuucagucgguauaauuacaccauaauggagaagguaauuuuuuauuuuuuaggaauauacuaaguauaugauuuucccuaucuaguuuuguugucucuaauaaacuuguaaucuugaaguugccauuuucccuaggcauuuuguacuuuuuuccucccacuuuugguuuuucaagacaaggacauuuguauagccuugacugcccuguaauucucucuguagagcaggcuagccucaaacucaagauuuaccugccucugccuccugaguguugggauuagaggcgugcaucacuaugucagguagcuuuucauuuaccccuccucuuuuaaaaucgauuugggguugacuggugcagacuggggcugccaugcuuggugccuccugguuugucacuugcuuccugugacuuggagccacuguaccaccaacucucauuggcuugcuuucuguucuagaaguuugguccauccacuucaugaauaugccacuauuuuuuuuugaaacaucaguauuuggagauuuuucuuuccguaauacuuuuacaugauuaaaaagagaauuuucuuuggaaaacauuuuggacuagguguggcucuuccuuucagaauuucaagucuuagacguggcaugcgaagcacuucacuguacuuccaggauguucacaguaagccaacuugagguuagcucaaguuaaguuagguuaaguuuaguuaccaguaacauuauuuuaaaguuuuuaauuuauuuaguuuuuauuuaaggcuuauucccuuucugaacucuuagaucauucauaucuaauaagaaaguugugguaggcuuuaucauaauuagcucaucuuuuuauuuucuaucuugugagaauuccaaguggacagaaacaggcuuuaugaauuuaaauacauagugucauaauuuuuaguaaucuucaaugccaaaagugaauaaguaagcaguuauaugggagugccacugugaaagcauugcccacggaaucucugugcuaagugcuguggagucacugugaugcuacacagcagggccacuacaguuuacauuuuguuuuucuugucccuugcuucuuauguuugccuuagauguuuccuugacuuugcauaauaucauauuggggaaauguuuguucuuacaguaaaggaagugauuaauuuagaaaaaaggcaccuugauccuuauccugggaaguaguuuaaggauagacguuugaaaguuguugcucaauuuugaaguaggcucaacuuccaguucucaaaaauguauaaggaugauuuagaaaugaugcaugcacauuuuacgcuuuauggagguuuaaauucuucacacaaacauuuuuaccucagauaugauuaucagauuuccacuaagaaaguuaauuauacucaaguauugaaagugaaaggcuuaaccucuccgaauaaguuuuuagugagugaacuacugaagaguaauaccuaguagggucaaaugucuguugggggccgaaaguguguuaacuuccuauauuugauuuucaaauagacaccaaauccuacugcaagcgaauuuauaccuaaaggaggaucaaccuccaggcugaguaacgugucccagucaaauaugucugccuucucucaaguuuucucucacccauccaugggaaguccugcuacugcuggauuagcaccagguaaguugaguaacuuucuagugaguuucagguaucagaucuguaagcauuguggguuuuuuguuuguuuguuuguuuguuuuuguuuuuuuauuuuauuagaacugaaauuguauacuugaaugacucacuuugcaacagagagcacaugucuuagucucagagcuggaauaacaagcuuguguugccaggggcuguuacuagcccugccccccuccuuucuugcucucucuacacuugcccacuuccuugccaccgcuccuuccauuugguuccuucccauggcuucucuugugggucuuuguaguugaguuagcaagcauucucugcccuggaacguggugucagacuaauguggugauguaccgugcauauaaaccuccccgugagcuggggucgcaucccuugcaaaagcacaaucugcggaucagucaggcauccaucuagaaauucuuacagagguuucugugcuucuggggagcuucauaaauuaaccauuaugucuugauaaagaaucaacagaaaugagccaaucauaaaacauuuucuuaguuaaaucuuuguaucagaaaucaauauuguaugcacaucauugaugagacuacuugaggauugcccuucuaaggaauccaggcuuuacauguaccagggcuacggguugcgguaccaugcucccugcaaaggccuuuuuaaaugaggaggugagaauauuacaaggaauuuaaauuuuaaaagcauuuggcuuagaaaagguccccagccccuucaugguauugaagcuuucuaguagccugcaggcucuguuuucaaggcuccaugcugaguagcacugguguggcaguggccaguccacagcccucugcaaaaucucacacuuauuuuauuuaaagcauuaugguuuguuuuuuccuuuaauaacccaguuagcaguugucaagcacaaacuuuguagaucacauguaguugcaauuaguuacaaaagguuagaccagaaccucuagggugaguuaauuguaacuuacuguccugcauaccuauguuagaauaguccaucuucuuccuguuaaugacauaaccguuuucucuggggcuguuugguaucauaacacauaauaaacucuuggacuuuagcagccauuguguuaggagugccuguuuggaugguagccgcuaugcuagauacuucacgaaguucuggggugacacagcacauuuauuaacgccuuuccuccuccugucaccuuguuaacaacgucagucuucagacgagaaaagaaaagcugagcugcuuuuccuucagaguaucauuuuaaaaacccuucaauucuauuuuguuuuucuccacaaauacauuucuaggcuggggaaaguguugauuagguuauaguccacacaugggaugucuugguuauugugugcacauuggacuucugagcaugagcugcaacuugaagugcccuggguugugguucacacacuuaaggaccgaggaaagcuugggcuuucagaaccccugugcuuagucacagcuuuuaucuguaaguaggcauuuuccucuggacacagguuuuauuaucagaggugauagccuuccaaaaauuaggaaucauuaguuaacaccuuuuucagaauugacuuuucaagcacagucuaauaagaauacuuuuauauagcuggucuagagaguguucuauuagcaaagguuuuccugaacugaguuuuaggaaguuuugaaggugccaaguuuaugaaaugauaguuuaaugcuuuugugccacgaaaauaauuuauuuuaagcaugaaaauuacuugcugacuuuuaaaagucacacuuuuuccuaaugcuguuuugauuuuuauaauagacuuaguaagcuaagaauuagcaugcuuuaauuggcuauuaacaaauugauauaaccacagcauguuuaaaugugaugagagucauagaagcagcauacauuucuggguaguguucuucauucucauguggugcguggcaugugcacaugcgacucagggacugaucaccuugcucugcuuaaugaaagaauucuggaguuuaaaaagauggcuauuaauguauaaauaagaaaaagagugacuugaacauuuucaaacauccauuccuucaggcuuuuggauugagcagucaguauaucuuauggcaaauuuuauaugcuuaauauaagaaaaagaauaauuucuguuguaagcauuauuaacgauacucauuauuaccaauuuuauuuuagguuuuuuguuugcuuguuuuuacaugaguggggcucaaacccaaggccucaucuguacuaggcaaggguucugucacuaagccguguacuuacucugcccugauucucaugaacugaagggaaauagguauccgugcucugagaaagugccaguuguccauugcacggucuuagagguagugaugccagaugaguggaacugcuuauacugcugcugucacucugguguaggagaagggaaggggaagagguggggacaugaacugcuucaucauucuuguucauuaaugcugacaaaauuuuaaauguggacauuacaaaccuuaaugauuuugaacgguuugggucagaugaucccuucugugcuaaaaaaauaaaguuguauagccuauuaggucuguguuuucugucagagacaaggaagaggggagauuuaauucaucuaauuuggcuucuuuugcaaccugauccaggaaucuaaguagauggaaacaguuuucauagggcuugucuacagcggccauuuuugacaaguuguguaaucucugcuugcauugcuuagaggcuguggacugcauuggugguucaccgaggcagcucagcucacaugucagcgggaggaauggaagcacaugcuugguuguguugaacugugcuguucugggcugucacucgucaccugcuccuaguucuuuagccuuugucaggugcuuuuacaggguuuuccacacaguucuaauuacuuucuuaacauuaguucauguauguauauauccauaaaaccgagcuguucuuuaaaagguaagauggaggguaaaucaggaaaaauaauuaaauugacaaaauguauagguuaaaaaaauaccuucuauaaauuguaaggaugagagaaugcuguggguaaaaugaaacccacagcuaugucugccugcuguaucugcuguauucauaugcggauauccagcuauguucagcuggaaaugaccaacagcgggcaucugaugguucagaaucccugaguuagagcaugaagguucagaggcuacgaccuuaauugucuuguguccauuaagaaugugauauugcaaacucauagauugaugcguucuaaacauaaucauggugagcaggagagaaauucaaacacguuuccuuguaauuauuuuucaaaaccacccuaaaauugauucuaugaaauucuuaaguaauucuaccacaaauuuauuuugaaauuuuaaucugaauugauuucucugaauuguuuuuauauuucuuuuaauagagaucauucuugauuaaaguacuauaauuuuuuauaaaguacuauuauuuguuucuaaucuaccacaaauuuaaguauuugcagugcuuaauaaagcuuacucaaaaaaaaaaccaauuuuuuauugggaaauaauuucuuagcugauguacauuucuugaauacagugaauuuuaauaauucaguaaguauuuuugaagaacuuuuaagaauuaauguuuaauuuauauaguugaauaagucaaacaaacgaaucucaaaguuucagagcaucagaacuagaagucugugugguuagguacugaucauuccuauuagcagcuuugaaggauuuguuaaguauuauuuuaaaguugcacguguccuucuuuuuguaaccacuuuguuuuucagguauguucagcauaaucuuucaaaucuuuuaagguuaucuaguuugagaauuacuuuauuuaauuaaaaacaaauguaaaaaguuaacaguuauuuuacuguuaagaucagggccgucaagaguuuuugagcagaggagcauuuuguuguccucuaauguagaguuggucccaaaagcggcugcugcgugagugcaggugcagacacagacuggucuccuggggaagguugcuggcagugaaacucuagaccauacccagguuggggaugcuaucugguuguauuccuguccuacuugggaauuucaggaaacugagaggcaagacguuuuuggcgcagagggggauguggcugcugcagcuggcuuggagucaugucagguaaggcuuaacuagcuacuaguaguuaagaugcuacuggcuggggagggcccugcuuaauuuaccuguuagacuugagagguccaguugugguuuuccagugugcauuccauucuguuggcugucuugucccugagcugaagggaggggcuggaugggaagggguagguucccuucaaugguaauugguagauucagugaccuacaucuauagcaaacgccuguaguucuuagauaugauuguauuguugauaaugaauaugacuugacacauuugaaaccuggacaguucuaccaaauaguccuuuggcuuucuauauacuacuuuguuucugaaugaagacaguuuaaaaucugaaaugguauuguucagugacauuuaagguguagaaaucaaguuauagaaauaaaacuaugaagagaaauaacaaaaacagaauggugauucuucuguuagaugagaaagggauuugaauguccugugaucuuccuugccauacuuguguggaaauaaaaauccuaccuaguuuaccuuuguuuuauagguggacauuaagggaguucugucggcaagagccuguugcauuagugaacucugcucgugacugaacugagaggcagagagaacguauguuaacaaaagccuagaucauuugugagccuuaggugaaugugaguggagagagaaaagucaguccuucucccugcuucuaaucaaauggguuuacagcuccagucaccaucauuucuugucacuuuucagcuuauuguuguagacaccccguggagaaagccuacagaguacaguugcugcugugguugcuuguguagcuaaggggcaggccucacucugcaggagucaucuggaugagugagucaucuggaugguuguagcucuuccugcucaguuaucauuugaaucuuagcuugauuauuaagguuauuuuuguuacuccuuuugucuuuuagaugugcauauaguugucuuagaggacagggcacauguaaagggucucagugaaaggaggacuacagacgucguuugcccuuucuuguuccuacuauacauaaacaugcagugaagacuccuaagagcaccucugaugugggaggaggguuauccugagcacuuaguucuagguuauuuggucaugaaucuugcacacacugacguuacuaaaaugggauugcccccugcacgcgcugugcgcccccccccccccccauuucauaaauaacuuuccauguuuagaguacugguucugaaacuaguaacuauuaguggucacuuguuggggguggggcaguaugcccacgugcuauuaaaacaacuauguggguuaagcuguagacacacuuccccaaugcggagacuacauagaacagaagugcauuucuuaguuauaaaauaguugagggcagguguucaaaucucuucucaacauuucucuagucagcuagaagcugcguguagaagaguacgugggaaagcugggacuuuguccuguggccucucuccagucaggaucaaugcuacgcuacuuaaguaguugugcuagaguucugucucuuuugaugcaaaguacuuacaauugaaaacuuugaaguauuauuuaaguauuuugagucuguauuuuaauuuuguaacccacuucuaucuccuuuuuuugcugauaaaagacuaucaaagcagcuacaguaacugaccuagcuaccucuacgugaacugagaaggaaaaaaaaauuguucuuuugcuuccaaaaaugaaugugguauccauccuuucaugugcucauucuaacacuucaucuuuuuauauacuagugcacaaaguaagaguuuuaaguuuguuacuucuccugccuuucuguccuuuccccaauccacuaccuuucuacuacuuuaaaaucuagauucggcuugugagagaaaacacggcaugccuguguuggugaggcugguuucucacacguguggggggcaugccuaucuuugcuguacagucuaguuuuagcuguuccugcugaagcaagcaccccacucuguucugauguuccuuugaaguaaucuaaaugcuaccagugaaaagaccacagaagagccugucaucucaggucuuagagcagguuugaggacacccaggucacuuuucuguuuucuucaaacauuagaggcaaaagaaagaucuacauaaaagaccgugagcaaggugggugaguuacacagaguuuagggguuugauuucuguguuguacacgauauugcaagggugaaggcugaagcgauucugcuguuuguagggcagggcuuguuagguugaagggaaggaagaucaggauauggcgaugucggaaggaaagugauccuaugggugggagucuccaccauauccugcugaaaaguacacgacugauaaaacuugggcgucgaugcugugaguggacaauguaggacuuugguuguucaggaugggaggaagcuuuaggucucauaaucacuuuaugauucaugcauggauguuucuaacguccauguaucuuuucugucauugaugcagcuuaaccaaagggaaguaugauuauacuuuaaaaguugucuaguuauuaacaggaaaaccagacauagauuaacuugcacuuaucuuggccacauucccauaucuccuaugaaagguuuuuguuuguguguguuuguuuuuuacgguuuagggaaguuaacaaagcucugagaagguguagaagcaauuaucacucggggggggggggcaguuguuugguguucuuucaguuuguuuguuuguuuguuuguuaagacagaguuucuuuccauagcccuggcuuuccuggaccuugcuuuguaguucaggcuggccucaaacucgccugcuugugccucccagaaaaacuacuuuuuauaugauauaaugacgauuaguaaguagcuacaccugauuaauaugaaacauuuucuaguuuuuguuuauauuugcuucaugugaaagacacccuugccucuucucccccaaggcacagggaucuugguauguaucccucaggcuggcauugcucaggccuacaguagucuugcugccuccucucaagugcuggaauucauuguaggccugugucaucacaccuggcaucuguuuguuuauuauguauauacaguguucugccuguauguaugccuacacaccagaggggggcaucggaucccauuacagaugguugugagccaccaugugguugucuggaauugaacucagggccucuggaagaacagucagugcucuuaaccacugagccaucucuccagcucccaacaaaguuuaucuuuauggucucauuucauaauuuuuaauucuugauuuacugauuaauugauagcugcucauuuggcuauuaaaggauuucaaaauaagaaugucaucaauuaccacaaacccuggaaagucuuggauccagcauuguucuguugugaaucaagauuuugugugccuuaacaauagaaaauuauuuaccuuuuguaaguuauuuuagggcuagccagauggcccaguagguaaaggggcuuggugccaaauccaacaaacuuaauuugaugccagggaaauacuugguggaaggagaaaacaaccauucacaacuauccucugaccuccaccugugcccguggcacccacucacuccuugaaggccuuuucuuaaauuaacaaugacgaauuaaaguacuauucauggcuagaguuuucuguccuuguuuaauauguuacuccucuauugcuuguguacucguauucuaguuuuaaauucuguuagguacuuccuaggaccuuaccuucugcucggcaagugcuuuaccccugaguuacauccucacccccacuuguuacuuaacaauugguucugcacugagucuggugauucaugcuuauaagcccagugccugggcuaacacaggaggauuaccuauuccuggcuagcuaacuaaacagcaagaccaucucucuagauaaaaaauacaaguuuuggagauuuuucucaaguauauuguuuccuguaauaacuuuauucuugggauugugauuuuuuuuuucuccuauaaaugagagauauucuuugauuguauggauuuuauuauguugcagauuuuguguuuuuaacuuuuuaucuggucagaguaaaggugaugcuggcuuuuuuucauggucuuucaagcacacauuuucuuucugaaaucuaucuaauaucccuguugugagagcuccugagguuuucuuuuuuuuuuuuuuuuucuucuucuucuucuagguuucuauguuucucucuuuguuucuauggaaagaacacauuugaaauagaaaaccccuuguguuugggcuggaguuuggauucaguggauaaaguuggugucugaguuuggguuucuagcacucauuacacccugggcaggguucacgugcuccugggauuccagcacugggaggcagagacagaggagccuccgccuugcagcccaguuugucugucugcccuuggugaguuccaaguucagugagaaccugucacaaaauacacaguggugaggagcugaggaggagagcagaugcucaccucucugcauggaugcacacagcccauccacaugcgcuugugucaugaagaaugcuuuagucaaaaacgcuuagauguuguauuaaacuaaauguuguuaaaggaaauauuagcacauccccaguauuuuaaauguugaaaauuuggggauguuaaaguuagcccaaguguuuuuugcuucucauauauaacuacuaaaaaugauucugaauuauaugaguaauauaucagagggcagauuuguguacaagcuuuuaagcagauguuuagacuggucuuguuguacaauuguuguauauacuaaagcuagugggaaagcauugccccccuccaaaagagggaaguguuuguuuuauaugcaauauguaacgaauucuuucugcuccacuuuaauaauuuaaacuaguauucaguaagaaggcacuauugcuuugaacuauuagugcuauaaagaccuaauugaaaucuuaugaaaauuaacauggcucuaaucuuugcacaauuuacuaagaagcagcauacccacauuuucccccuuuuguccaauuaaaaggcacuuaagcucaaguuuucucuccccgccccccuccaccaaauauacauuucuuucugggcaugguaguacaaggcuguaauccaagccaucagaaagguauggcaguaaaucucuaaucccaauaggcccggguaaaacacacagcucaguuacaguauuuaugagcugccugccuagacugggcagauucaccagcacacuacucuauuccccagcuaugagcccuugcuccuguggcuucucugggccuugugguuuaguuccauuuuccuuccaccuucacuuccucugucgucuucucccccccccccccccccaaaccuccagccucaucuuuccuuucacugcccaauugcaggcucuagccuuuaucugacaguuaaaaugggagaaggcucacauggaaucaccugaguaagugauccacuccucgucggagcagccccucuugagggagcagaauuaacaccaaaauauaagcagccccaggaccacccacaagaaggcugggguagguuugugauuuccaggccagauccuaguaguagugaguaaaacacuguuuauaacaacaaacacacaaauaaauaaaagcgagugaauucuugacugggacccacucugauuuuaagaauuuaauuucucacuuaguaccuuagcaccuuauuuauuuucugaucaucucaacaugacuguuauagaaaggguuucgggcaguaaggcugcacucucauagcagccuuugcagucuguuugcugcuugccccucacuucgcccagccacucuucucugcugcacucuguuuggcuguguauacuacuucuauaguuacauccaguucuuugguguagagucagucuuugcagaauuccccugugcuuuggcucuguauuugaucauacuaccuguucauuuccuucucugaacuguuuaaacuuuuauuuuuauuuaugauucauuuuauuuaaaauugaaugaggaaucuuuuggggaggaucuuuauacuaucggaacauauaccuuuccuuguaacaggaucuuuacuaaauauuuuucaaacuaaaauuuauguaaauuuuuaacagucaccagcauauccaauuucugaucuguuagucaaauguguauauaaaacugugaaauuauaaauuccagaacuaguugacagguuuugauuucugaaugguaaaaugaaauaucccugcaucuugcugugucccaucagguccccucuuuauauacuaucugugcauuugucauguagaagagaucgaucugugugaauauugaaguguguucaacugaucccuaauauacuuacugaccccagagcacaaggugugacaugggccaaggagaaauugugagaguucucaauucaagaaacaaacaauggagccgggcgugguggcccacgccuuuaaucccagcacuugggaggcagaggcaggcggauuucugaguucgaggccagccuggucuacaaagugagguccaggacagccagggcuacacagagaaacccugucucgaaaaaccaaaaaaaaaaaaaaaaaaaaagaaaaaaaaaagaaacaaagaaacaaugggauggauaaagaucuagagugggcaugaacaugccugugaggcugugcaggaggaaggaauucaggcucuuguugcugucucacuaagcuguuugaauuccauccacaguguacagugugagcuuuaugaagagaguggagacguaaaacugaaagcuucaacgcugccucuaguuuccaguauccacuaguaauguccagaaaguagccacuggagaccacuuucuuuucuaacaaagucuccuuuugucuaccucauguggguuguacuagagccugcacucugcucuuuaagaauguauauucaaacagguaaaccucccucugcucuggacuuugcuuauuguucugccucuggcaauaugccuccguccguggcuaauuugcugccagguuuggcgaccugagauuaacccccaggaaguuuaaguuguccucugaccuccacuaaaauuuuauggaaaagaaaauacuugagaugaauuuuagaggaugggugcaguuuguuuugauuauccuuuugguggucugucugucugucugucugucugucuguucaagacagaguuucucuguguggcccuuacugucuggaacuugcucuguagaccaggcuggccucaaacucacagagauuugccugcuuuccaaaugcugggauuaaaggugugcuuuaaucccaccaccacugacaccaguuuaauccacaguugagcagugcaugacuuuaaaccuagcacuugggaggcagagguagacagugcucugaguuggagccagggcuacacagagaaaccugucucaaaaccaaccaaccaaccaaacaaacacaauaaagaacccucauaguugagaauuuaugaacuuuuuuuucuguuuaaucuaaauuuaaaauuuagauuuagucagugaacuuucaaaaaacaaaacaaaacaaacaaauucuguagucugauuuacauuaagaaaauucuaguucaggcaugguccugagcuguaggcuaggcuugguauaggauucucuguuugcaguagccauuacccuuaagugcugaucaugaagaguuccagguucuuaggaauacccaaggcaaaagucaagcugccuaugucuuccuuccuuccuuccuuccuuccuuccuuccuuccuuccuuccuuccuuccuucccucucucucccucucucccucccucccuuccucccuuccuuccucccucccucccucccucccucccucccucccucccucccuucuuccaccaccaaguuauacuuucauacuguacauucauauuuuucuaauacuucauuagcaaaauucuaaccagucaauauuuaguucauauggauaguucuuuuugacagugcccauggcuuuuuuuuuuuuuuugauucaucuuucaagcuguuauuuaaaacagggugugugauaugaaaagcaaaaaguacaugaucaccucucucuuauaucuucaacaauuuugccuuuaauuccucaaaguuggauacauuguauacgaagcccccaaaguuucagaacugugagaacugguaggagagaguuaagaagggaccuuggagcaccugcagcaggagauggcagcaaagccuuccauuguaucucugccucuugggaacuuguaagucaaaauugcacuuagagcucagaaggguuuccaagcagcguucucauaugaagucuguauauagccucaagauuugaaauuagacagaauuggcauguacagggucaaauuuauuacacuaacucccacagaugcuuagaugaggcuaagguuaauuuguuuacuaguagcuugagauugugggugagcaguaacauuugcucuggaacuccucagucucccucucuauguuuacaugugguuggcauaggaacaucauaggucuguggaugaguugugugugcuucucuucugaguauuuguacauuuagauaaaggcuacugcagaggauuauucccuuacaguuguaacaaugugucuguaaaguaaaacgugagcaagcaagccuuuaagcauuuguggugugaaugaaaacacuacagcucaguacaaguuauauuggugucaguauuuuaaaauacaaaugcaaacuaauuguagccugcauuuauguuuugcugaugcaguaaauagugggaaaacagcucaaaaauuuaaauugaguacuggcagagaguccagaagcucuuacagaagccugugaauacgaaauacuauuugaaaaccacuggcaaagaaggccuguuucccugauaggaggaacauuaccauaccccauuaaggcacugggaggucuuagcaccucaccagagagcuuccucauuugaaucagaauacaggaaugacaagucacuucccagagaucauacauaacacauacauaccauuuauuggcucaaaggucucuuggcuuguuagccaucuccauacucauuaccaguugggaaaaugaugacucaaugaaauccuggaaaagaaauuggcucaaaugccaggugucuauuuuuaaugaguacagcuuucaggauacagucaccaauauaucuucugccacaaguuagagaucuaaggcaccgagauuaugacauggaaaugaggacaguucuuuagauuauguuuacauacaugauuacauauuaacacugauaaaguuuuuaaaggugaaaaauuauggcuuuuagaaaugacucagcaguuaagaguaauugcuacuuucccaaaggacaugaguuccaaucccaccacucaagugguggcucacaacugcuucuaacuccaguuccagaaagucuauaacccucuucuggccucugaggauacuaagcaugcacaugguacacagacauaaauguaggaacccauuccuucccccaacacauacacauacacacacauacaaaauaauacaugaaaaguugugcuggucaauuuuaugauuuucucuggucauuucaguguuuuggaauuaguuugagcuguuggguuucuuuacauuuuuggcuuugcuucccccguccccgugacucccuuacucauaguaguauauuuuugugauaaacaccacuaaccguuggaauggaaagacugccuugcauuguagagcuguauucucaagcccaagggcuuugcauguagacggugucuccuuucuguuuuagacauaccaaggaaggcaggucacaggguuagaauugaagaagagugccuguuaacucuucucacagcuugagugagaguaauaaacugcagaagagccuugcgcuuaaggaacaccccugaagcaaagcuacucuggguaugcccacugcuucgaaauggagagauuaguguucucuaccgcaauauucuaaggcagccuuucaaagauaacccgaacaagccuuagccuguaguauaguaugugccacuuacagugcccucuccgucaagagccaggugguucugugugguagauuuccuuauaaacguuguuggcuauuuaauauucuugcucuacuggagugaauacuucaagcaauugccauggcauauagaugcccucgauuauugacuccuucuguaguugaaaggaaguugaucucugucugucucucuuucucuuuuauuuuuuuaguuuuuuaauuuuuaauuuuuauuuggacccaauaaguauguccuuuccacuuggauguugaaagagccuaugagcaguagcuguucugauuuuuguugguuguuuucucuagggaacaagcuacccucugagucagcacuggacuugaagauaaauccuacaguucaugaaacagacugauucgacuaaaggauggauaguuugggcagcguuggacagcucuaugaggggucuguuuguuuaacuggagggauuguugaguucagcaacuuuuaacucccccaaugacaagggguugcuguugugaaaacaggguuugugaaggaaucaauuuuuggcaauuaaucaauauucuuauugacucuguuuucauuuaaucacaaaacuucauaaaauaauuuuguaaaaugaagaaauuggaauuuguauguccugagcggucagcauaggguauuugcggcucaaaaauccuaauuacccuuuuuucacacggauuauaagcugucuugcguaaaccuuuggcacuuggauguuuaauucuugcaaagggaggauaugcacucguggcuugaaacuggucgaguuaagugggaugcgauuucaugguuaaguauuuuauuagaucagcgaauaaguauugcagacuagggcugauguuucaaugugauuuucaaaauugucaaaaaaaauuaauacgguauuuuuuuaccuuaaaacuugaaauuuuguguaaggacuuuuaaaggaaaugagaauaauuauguuuaacugaauagauuuuuaauuuguuacugaggguuuaaaaaugcuucagaaggaaaaaaauucuuugcuauuaauuuucuaggcacaguacaucauauugauuuuuuuuuuuaagauugucauuucgaaggauugaaauguaccgugguugagauuaauuuuagauaugcgaaagcuaaugugauuuaaaaaucagaaucauguguguuuuuuuuuuuaacguagcaaauagguaaauuucuuuucaauaucuuuuauugucgaaacuagcagcuagagguuuuaaguuaccuaacauggcaguuugaaaaauuggacugagauacaguuuaacuuuggauguguuagcugcggcaugguuauuauuaugaccagaaacauggcacucacuauacuuaaagucaguuuuaagaauuacuugcaaaacugaauuugauugaacaaaaaaauuuauuagguggaacaaugucuaauauuacucuagccuuuucuagugaguuccauugauaguauuuggugguagggugguuuguuuauguagucuaccuuguaaauagauccacaguuuaagcaucuguaugggacuggagugaugguucagaaguuaggagcacuggcuacuuuugcagaggaccugaguuugauuccuagcaucucuauggcaguuaaccaccaggcacugcauguaugucgagcacauagcauaaaugcagacaacacacccuuacgcauaaaaucaucuggaaagugaaaaguuuuagaccacgcacuguaugauacuuaauucuucauuuauguucacuauuuaauuauuauuuuucccaucucuuuuugcagcuuuaaauagaauaccaaaacaauuauaauuuaaaguuuaguaagccccuuaaagaacccauagacagaccuugaagaaauauuacaauuaguuuuauagacacaaauaugaccacaaacauaaucaagauuuguuauauuccugguuccuaagguccucuuuuuuuaaaaguaaaauguagcucaucaauuaaugcuauccuuuggggguaugguucauauauuuuggugaggaaaagaucaaauguauccacauugcuuagauucuccagaaacccuuuaauuuuaaacccuccugaauccuugucugaagcacaaacuagguucccagcaccuaauaaucagccuucggaccaaccauguaauacauaaaggagcuuccuacagaaggccaggcccuuggagagguaaauguuucggucuuccgugcuucagucccugggauacccugugaagugcgacagugcacaguguuuuaugguauuccuuuuuguccuauaacuuuugcuuuuaggcuuacuauuuuacaaagucccuaagaauuuaaauuuagguuaaauugggcagcguaggucacugcauauauuagcacacgaguucauuucugucauuauuaauuguaaaauccugaauugugcucaguaguagcugagcaguguguaaggaguggggaaucuuccccuacuuuugccuuaaaauuggaauuuuguaaguauuuucuuuaaugaauuagauucucauagucuauaaacaguaaucuugcauuguuaacuugcauuaauagacacucaaaggggugucuauuaauugacaccaaggauuucuaaauuuagaaaauuuuaaguuuauucugauauugauuacuagauuaaaacauauuaucaaggccaugcaaagaauaagcauaauaaaaugugccugaagaggugugagggcugauguagguucaagcccagccugugcugcaaggcgaggacaaggccacccuugcauccgucaugaacccaucucagaacaaagugauaggaagucuguaaguuagagucuuccaacaacucuuuuguguuuucaauuucaaauaacuguuguuuaauugacauugcuuugacuuaaauugucaggcagcuaaagacaguuuuaucuauuaauugagucacuauuacuuuuaaaacucuccuuuccccauuucugaugugagucuggguucaggaucuugcauauuuuauucuaguauuauccuuuacuuuuaaauauuuuaaaaaauauuguuaucuauaugugugugucugugugagugaauuauguguaugugugugcaugcacauuaccugagaggccagaagagagaacauuguguuuuggaggugaaguaacauguauuugcgagccccacccaguaugggcauuuuggaagaucaacaggugcuccuaaccaccaucucucuauuuaaucccagucagcguguacgucucuaaccugagggggggguaggggaugggugguacugucucaaacucaggcccuugugaugcugugcuggugaagacugcuacaaacuguauucccaccucauuacugggauuuuuuuuuuuuuuaacuuuuucuagcauggugguggugguagcacauuccuuuaaucccagcauucaggagacagaaauaaguggugguagguggggugucucagugaguuugagaucagcauggucuacaaguuccaggacagccaguacacagggaaaaaccuuacuggaaaaacaaacaaauacacaaaaccuuuuucucuucccuguuuccugagaaauguauucagacaggaagaccagaacauugcucuucgucuuuuuguuuauaagcauuggagagcagaguggugcuccucggcugauagcaauccuggagacagucugugguaugugugcagaagucaggcucaaagugcacuucuuaaaggccugccugggaaguugcuacgcagcuaguaucugagaaguagaguguugaaaacuuuccagucuucuucaacugguuaguuuuugcuaagaagcucuuuugcagugguguuugcuacauagucuguuuuuuccagacuuuacaauucuguugugcuagaacaucacccuugauaccagucucugguaaaccuugggcacccagccuucauaggcuucuccuugucuguaaauuacacacauagcugggggcagaguguacucgugguccauaccauaacacaucauuaauuccuuuagacucucauagugucuuuuucucuuguaguugauuuugcaucacagugauuaaucuuagcuauuaguagaucuguaugcugagcagaauacagucugaugacuuccuggauguguggaagugucuuggauucaaucaacaugguuuugucacuaaauucacugaaggaauauauuaaggaugauauuguaaagcagcuuugcuuauaaguucuuagugugucucugaugguguuacuuuuaaaugucuuuagaaaccagagguuugcucugcguucgggacaguucccuagcuuguucuguguugacaaagagggcuggcaucuauaggcauaaguuguugaagcuuccaaggagugaagagaauucugucucuugguuuuuuucuaaaucaccuuuagcacauucagcuuaaaacuucacacaaacuuuuauaguuuuguguuuggauacuuuacauuguugucagauuucuucucaaguaguauccuaauugaugucuguaaagaggcagcauuucucugauucacucuuucuguuguauagauacauaaagccaguauauuuucuauaaauguuaguuuuauuucuggcuuaucuuuucacauauacuagcuuggcucauaguuugauaucauacagaaucgggcauuugacuuuuuugucuuacuuccaguuuuaaaauuaguuuuucccaguuuuauaugaugaucauucugggaaucuuagaugcguuuguuucugaggaaacaucuauuuaaaaauuucccauugaagaaaguacuuugccaggcgugguggugcaugccuuuaaucccagcacccaggaggccagaggcagguagauuucuuaguucgaggcucgccuggucuacaaagugaguugcaggacagccagggcuauauagagaaacccugucucgaaaaaccaaaaaaaaaaaaaaaaaaagaaagaaagaaagaaaagaaaaaaggaagaagaaaguacuuuaaaaacuguuugauccccucccuuccuuccguguguguauggacauguauaccacugagauggagucugggccucaccagacuccgguuaccgugccuucaaggggacuuugauccaguaagcugucucacucaucacaaggagacuauuuuuauaauugucauaggaugaaauuuaaaauaacuuaacauuuacucaugagacucucgguguuuccucugccuuuaccaucgcuuccagggaugcagcucuagucagcgggcuuucacagcugcagacccuuuaacugccagucaccuagcugaccuuguuacccuauaauguccuagagaguagagcuccaggcaucauacauaguugguagcaaauuccuuuacucacugagcuggcuugccggccccugguuaaacacaagcuucaagacccgaguuuggauccucagcaaacacucaaaaagcagaguacagaggcaugugucuguaauccuaguuguaggagguagagauaggaucucagaggcuugcuggucagccagucuuagugaguuaauucccugccucaagaaauuaggccaagaugucagauaucuuaauggugaggagcacuuauuuccuuuuuucgaggucuugcauuugguucccagaacccacaucugguggcucacaaccugcuguaacucccaaccccaaggaauccaacacucuuuuggcccccauagguacuugcauacaagugcaaucugugugucuguguguucccucucccaacacccaaccucaauaauuaaauugaaaaauaaaaauugagugaaugauagaggaagacaaggucaguguacuggcauugacuuuggaucaccacaugugauuauggugccuacaacauguacaaauauguagauaccacacacaaauaaugguaguuucuacuccuuuauuaguauauaaacauaucuuuauauuugagggagugugugugugugugugugugugugugugugugugugaaacauguucauuuuucacugguucuuuugugugguuuguucuuugagagagucucaguauguaguggugguuguucuaaggucacuauuuuucccuggcuggccucuuaguacagaaaucugacugcuauuuccucuuuagagcugggauuagaagugggccaccacgcccagcacucuguauucccuaaugaguuuaaaaacuaugccuuuuggggacuaacucuuuuauuaauaaaguguugcaaacagguaggguuuuuuguuuuuuugcuuuucgggagaggguuucucuguguagcccuggcuguccuagaacuuacucuguagaccaggcuggucuggaacucagaaauccucuugccucugccucccaagugcugggauuaaaggcgugcaccaccacgucuugcugcaaacauguuuuuuuaguuaacaucuuuuuugacauuuguaucuuuuguguauauaaauguguaagauacacacacacuuuuuaaauaguaucagagccucucccuuucauuuuaaacuccugaguauucaucugagauugaugggaaugacagggaaucacuuuguuguuuuuucagguaacuaucugauaguaccuuuuauuuccugggucaccuagcaaugucuagcuaguugucacaucugguuagucacauuuccccugaaguuuguuuuaucacccccccaccuccguguaagggucuuucccaaugugcaugcagcaaccacagaggccagaaugcugcuuuggaucuccaagagcuggaguuaauaugauuguuagcugugcccugggcacugagaauugaaccuagguccucuggaagaccaggcagggcucuuaauuguugagccauuucugcagccuauuuuuccaccuuuuuaauauuuggguuuuuuaauguguauuugagcuccuuuuuggugcccuguuucuuuuuuuuagguacauuuaccuaauuuuauguguuugaguauuuuccguguauauguauguaugagugcaugcauguauacuguauuugaacagugcccauggaggccaggaagagggcauugaauccccuagaaauagaguaacagaugguugugagcuaccauaugguugcugggaacugaacccagguccucugcaagagcagcccuguugucuugaugaauccuacagaauucuagaacaucuugaggacuacacuguuguucaccuuuuacuauuacugauguaauagcgucuauuuuuuuguggggcuggagagauagcucagugguuaaaaacacugacugcucucccagacgaccuggaauucaguuccuaacauccacaugacagcucacaacugccugaauuccaauuccggggugugacacccucacacagacauacaugcacgcaaaaccagaugguauagaagauugcgcacccucccccauuuguuuuguuuuucagacuuccuuuuuguuuguguuucuuaaguguugcuuucuggcuuucucaaugcauacuuucccaauuuuuuuuuuaauaauuauuguuacuuuugcugaacuagagucauuuuuuagguucuuuuuagguagaauugucaucugaauagcagauaagcauggauacuaaccuguauucaaauuaucucaucagaauuuaauuacuuacuuucccagagucuacucguuuaugccuaucuuuguuuuuuaucccuaguaaaugagauggguuuaguguguguuguauuucauugcuccccucccuccuucagcugggcugcugggaugauuuggaucaaguauuuuugccgguauuuaguuuacauauuuauuguaagacuggaccuuuaaguguacauggggcucacuugacuuugguguauucacuagguugggcaguuguaaccgugaacuguagauaagccgugugccuuuuguagucugugcuuuucucuuacccugaucugacuuaagaguuauggcccuuagaacuguaauucugcuuuccuacugcauaggcuuggccaugcugugcccuucauguacauuugguacuaaguggccacuuucacuuaauguugugugauccccauaguaguguggguucauguccauuacaauccuccaacuuccauauuucacagagcaauuucucaguugguagacauuugagguuuuuucugaguuugaacagugaugaugaucaugugcucugggcauucauauacaaguguuuguguggaccuaaguucuuacugcgacugggaaauauacauaggagugggauuccaagacaaaugguaacguuuaacaauuugaagaaccaaacucuuuuuucaaggugacuacaguauuuuacauuucugccagaaggaaugagaccugcuuucccucuuccucacuaacagcauuuguugcuaugcucaguauguucuugugggucuguguucaugucccuagugauacuguguuucuuugcaugugguugguugacauuuguauguugucucugaagaaaccucuggucguauugcuugauuaguuguuuaauucaccgguucuuauugugugcucuaggcauucuuuuuauugaacagacuaaacugcagccugcccaccaugaucgcgccuuauaaaauacacgaauggcugaauucuuauuaguuucacuuugaacauguaauugucuuccuuuauuguucguggugaggccauugcucaaccgaagggcacacggugcuuacacauguuuucuucuuacagugucaugggucuagcuguuuuuaggauauuaaaagcuguuucacaugugguauggaauagguacuaaaggggaugcauuuguguuucuguuuuauuacucuuccccacaaggcaggcggcucucugugauccucgugcuucugcucuucuguggacuuggaugacagguaugugccauugucacacuugacaugguguguucuguguggucagacuaaggguuuucauuugcaggcuuucuuagguaaaaagcacgggccguuuuccacacuugcucuucagugcuggggagcagaacucagggauuugggcucccugggcagucacauguugagcaagaguuuuuaauggcucguagcugcacucucccuuucauuauuauggcucuguagaauugugcuacagagcacauuugugcuugaaacugucucagacuuuaaaagaaaaaaaaccauccagccauuuuuacgguccaggacuuugaucugcuuuaguugaccugagagcuuuuucuuuaauuuaaugcuuauacaauuuuuacucuuggagaaccuacuugcucugugucaagaacaaauaccuuguuugucacuuuuguguccuucauuuuaguaauuaguugcuguuuguuuguuugguuguuuuaacucucuguguuguuaucuggaguacuuuauauuagugaauuuucaugaauuuuguacauuuuaguuuuguuacuuuuuugauuucugaaacagggucuugcucuauggcacaaguagacuugaacuagaauuaccacgucugccucguuugaguagugggauuauuggugugcaguguagggaaagcuaccauugggauuaggaauuuagauccaaaagagacauucuuaccuuugggaaaugccuugggggccuagcuuggagcccugcagcaaaaauuacuagcaguuucagccgaggaauaacaugcgauuaaaaaccgucuacuugacauucgagauuuaaggcauacuacugucggagaacugcucuagacuuggccacggauaaacgucuuacuccccccaaacucaauguuauaaaauaaccacuagaauuuaugguccuuuccccuuaggaagacuaggaauggucuuaggaaggagugaauuaacgucccaaggauuaauugaacauccagaauuauagauaaagauuucagaggagaaguuaaaauuauggccuguguaaaaagagagagaugcagguuaacacaggugguagauagaguugcuguuucccuacagcaaaagcagagcugcuccaguagggaaaaacagaggguuuggaaguacuggaaaacuuguguuuggcaaacaauucuuaauuaucagaggccaaaauuaaaauugcagguaaaugguguugcuguaggagcugauguaacuuaucauuuuacagaaacauuuggaauucugaauugccucuucaaaauguuuauacuuaguuucuaggaauuggagaguuaucucagauaaauagaacaaaguaugauggaauuauagaugauuucaaaggaaaagucuuuguuggguuagauguccugggaggucaaauaggaaagccuuauguggcugacccauaaauuuauaggggagggaucuuuuacaacaguggggugcucagauuaauauuccugcagucccagagauagccccaucgugaaauaaguggugaaaugguagauauuccuggggaagguauugauaugugucauuaaaaacaacccagacucuaccaauuauccaaacauggggcauaacagagauugaguuuccaaauuuauggaggugggggagggugcaaugcugauauuaucaguggcucuacccuuaaaaugauugacuagccaacccaaccaaccaaccaaccaaccaaccagaccuaaaaaaaagcagcaccugagcagcuggagguucagcagauagaagagucugucaguccuuggaauuugccacaaaaaaaggaaucagaaaguuggagacuauuaacagauuuaagaucugugaauagaguaaucuaaccaauggauuuguuagaacauggaauucuuguccuuucuucauuaucuaagguauggcuuaugauaguaauugauuuaaaagacuguuuuuuuuuuuuuuuuuuuuuuuuuuugguaaccccuuguaugagcaagauaaagaaaaauuugcuuucucaaugccuauaaacauauaucagucaauaguucuucaacaaagaaugcuaaagaauccaacuuuaugucaguauuuugugcaacaacugcuagauaaaauuuguaggcaauuuccuguauccauuauucauuaucauauggcuauuuugcuggcuaaaucagaugaagauacuuuagagaaaauguuucaggaaacaaagaauucugccaugcuguggguuacagguugcuccugagaaacuacagagaaaucguccaagaucguuaguggcugaagcagaauuaacucuaguagaacaaagucugcagacaaguauguggauugcauagaucccaaacgugauuguauuuugcuuauuuugccuucaacuuuuucuccuacuagacucaugggaaugggaugggaagauaguacugugaaauugaucuucuuagcacacaaaguacaaaauuaaaagacuuacauagaaacauuucugauuuaaucauaaaagggagaauaagacuaugucaguuuucaggaacaaacccagcagaaaucguacaguaauagugaaauuaugucauuauagguaaucagugaagauugguaaagaacuuguagcaacuauuugguagauauuaacaacagauauccuaaaaagcaagcaagcaucuucaguuuauaaaaagguucucccacauacuguaaaagaagcaccagcccgaagcgccugcauucuacacugauggcaaggaaguugacccaaaugagcaaaguaauacaaagcccauaucccucgguuaaaaaaacacaguuacauggcauucucaugguauuauuagaguuuccugaaccucuuaauauaauuacugacucucaauuugcagaaagaauugcucuguauauaaaaacugcugaauuuauucccgauaauucagaauuaaccuuguuuuuuuauagauucaacaaucaggaauaaaaauuauuauauacuaaccagauuuguucccacacaggucugcuagguccauucgcacagggaaaugaaacgagccagcuguugguaggaaguguguuagaagcuucaaaguuugaugaacagcauccucagacagcuggagcuuacaaaagagacaaacuaggaaggcauuauaaaaaacugucacaugugucucuuauauaauuaagccuccuuauacacuggaguuaacccuaaacguacccaaagaauuuaaaucuggcaaauggauguguuuauuuuucagaauuuggaaaacuaaaucuaccaugccuuugauacauagucaggauguuaauggccuucucuguguuaaguucugaaaaggcugauucuguaauuacacauuuacucuaaguaaugguuaucauggugauaccuucccaaauucaaacugaccaugucucugcauaugucucuaauaaauugaaacaguguuuuugcauauuauaauauaaaauauauuaccagugugcuauacaguccuacaggacaaggaguuguagaaagcucuaauccuaccuuaaaggaaaugcucauaagacaaagggauagaaucaauagugcucuaacuuuaaauuuucagaauguuaaugagaaaggaucaauaacagcuaagagauacuggguuauagaaaaaaacuguagaauugaaucagccuauguucuguaaggauguguuaacauuagaauggaagccaggaaaaauuuugcguuggggaugaaaauuugauuauauuuccccaggaaaccaaaagcuguggauagauacuaucaaaacuguuaaaaaauauagaacuaaaaauuauagaucuucugaaaaccuuggccacugacugaaaaagcgcuuauuucagugaaaauggcucuguuuauaauuccccaccacacacaacacagcuaaugucuuaaaacagaagaggggagauguugugacauaguugagauuucuggaauuugguuucuuaagaaacacaggaauauuauaugaaugugcuuucaauuuacucccagguguggggaugaggggcugguucggacuguccguagcagcagaccauuaucugccucaugcucuagcaaaagcaugguuuucccaucugcagauaauuucugcgguugugugguacuuugaauucugggagcuuuucagaugguacauaaaugcuaggaccccgagagaugggguaguuguuggucccuuagggaauuugguugagauuuguuuguagccauggucaaagaagaaacaaaaggaagaaauuagauucaggaucucuuuccucucugucaucuccucuuucuccucuauccuuguuucucuacuguguaguguuagaggguaagaccagggugugaggggacguagggcaggcaguaagacgaagaacccaugaaguaggaaagagcagcuccaccuggaugccuguauuauugcucacuuuccagguacucuacgguaguuaacuuauccucagagucacucacauuucucagcuugauauuuuagacagugucacuuugaugauugacaaaaagguaauacagaaauuaugauggugaauauuguuaauuugagguauuaaaaugcauguuuucauucuucuauuauauauauauauauauauauauaguaguauaguaaggaaguuguguuggaucaaguggauucugaauccuuugggaaauuauuucuaugguuacugcuguagaagggaaauacuuucaacuagguaucugccuggccuggccuggccuggccuuuccuuuuuccuuuccuuuccuguguucuuugagacagcaucuuucuuugugacccuggccagccuggaauuuacuuuguacaugaagcuggcuuaacuuggaguuaucccccugacucugccuccugaaagcuggaauuaauaggugugggcuuugcuaagggcaaguacuuagggucauugucccuugauuuaggcagagucuguuaauuguaauucagccccuuguguguaaccacuugucgacagagcauucucuacucguuuaugcuguuucuaacuuaguguugugcuuacuaacaagcauguucaguacaucuuuguuuacgcaccuaugugggaauuccaccccauucuuuaguacucauuaugugaguggcacguugcauuuccuagguguuguauagcaguuuugcagguaauuuugcuuuuagcugaguacguuuccauguggacacuaaugaucacuauugaacguauuuuaguucuaguguauugaguaauucuaguaaaccucagcuuaaacguauaaacuacaauuuugcacuaacauaauuucacaaaauugaaaaugguuccgagaagucuugauacucaggugucugcugugggcagauuucccucuucacucaccucgaguuguuugugaugauguauuuagucuuuuuuuuuaaauuuauuuauuuuaugcauaugaguauacuguagcuguacagugguugugagccuuugugugguuguugggaauugaauuuuagaaccucugcuugcuccggucaacccugcucccuccgaucugcccacucacucaguuccugcucacucuggcccaaagauuuauuauacauaaguacacuguagcugacugcacacacaccagaagagggugucagaucucauuacggaugguugugagccaccaugugguugcugggauuugaacucaggaccuuuggaagagcagucagugcucuuacccguucagccaucucaccagcccuguauuuaguuuuacagacucuaccuucccauuagcuuagcuaugucuuccccacacaacuuaaguaacugaagcuacugagauggcuacaaauccucuucuccuucauuugagacagagauuggaauaugugcuuuaaacuaguuucuucuucugugaaaugagugugcuauacuugucccacagggugguauaaggaugaaguagacugaugcccaggacaccuuuaggugggaagcagggcaggauuacuacuacacacauugcuguuaaugagcagaacaguagugaacucauuuauucaucuuugguuuccucucagggauacuuagaagcuagccuuguggggaaacagugcauauacaggccauaguuuuagcuaagugaguagaguuuaaguauaaguaauaugauagacuccuguagauuccuuuagcuaacugugcaaaucuagagguagauaaaaacaaagccccauagugguuaaaaccaagauaauauauggcucaucuuaaagcagagacuggacuucauagcuuuuuuguuuguuuuuucuuuucuuuucuuuuuuuuuuccuaacuuuuuuuugaggggggaugauagauuuuuuaaguuuccccuguuuucuugauauuuggaauucuggccuacuucacuauuaauaacaguagaagcaguaggagauacuggguugggaauuugaaguuggcuugaguuugagucuuggcuuugcuguugacauuguacauguguuugguaaagugacauaaacugcaucuaaguucugacugguaggugcuuggagacucagaugccauccuugugaugaggcuuuagaagugcuaagugcucaccagagacaggaggucucuucuuaguuuuaagcucaguuuuguuuaccuuauuuucuaaaagcaaagucuugauguuuuaugagacacuauugaaaaauaucccacuaauaauagcucuauagccaaagguauuuugcuagucccucuucccccaauuguguagauuuuuagacauuccccaaauaggaaaugguuccuguacaaguguuacuuguagcuagaucuucugcuucaucucugcucaaacaagccaccucccuuaaacuugagacuaacuucaccugguuuuaaauaauuugcauuguaucugcauuuaugcaugcaguuuucaguguaaauuuuguuugaguguuuuggaaaucauuuuaugcuuuuauaugugacuuggucuuacuuuacuuucucaucuggcauugaauaguccaaaggguaaaaauacugguucucccuucuccacacaucugugauagaguccauuguucacguggcauuuuguugacagugguugagugacuugcacuuggacauacaucugcaacaguuccagauguuuaguguacaucuggaguugcagacaggugucaaaacaggacuugcuuagagauuuggugcuuacacugccacuguguauuuuagcauagucccaaccauuuuuuccccaagaaauuuugcuguucauguuucgcugaaggaauuuaguaggccguuauuauuugaauuuuuaauauuugcauaauugugucauuuggguaguaauaacaauuuuuaaagacugaggaaagagcuguucaagagucucaguucugguaguuuucaugauuucauuaaacuaauuuguuaaucucgggugauucuuacaguaguguuaggagaagucuguguugucaaagagaagucuguugcugauuucauuuggaagugacuguaguuaagaaaaagaaacuucuuugcacuugcuuuaaaacaagaguuuuuuuccuuugcacuuaaaauggauguuucuuucacaugaguguuugcauuuauuuuccaguuuuuuucccccuuuaaaaccagucugcuauuccgcuaagacccuguuuugcaucuuccccaggaaugucacugucugcuggaucuuccccucuccauucccccaaaauuacuccacacaccucuccugcuccuagaagaagaagccacacuccaaacccagcaaguuucauggugccgccuagugccuccacuccugccaauaacccugcuccucagccuccguccucuggucaggugauccagaaggagacugucggggggacgacuuacuucuauacagauacaaccccagcaccuuugacuggaaugguauggcuucugauaaagagggaaucagugcucuuagaaaagcugcuccuuaacuaaugaggucaccccccacccucccacucccucccacacaccggaagggauuuagggacaugaaaaaguauuuuacuuuuuaacuuacucucauaucuuuaaauuguuaugauccuuccuuccuaauuucacucagaaaucagauguaguuguacuuuguuuuagugugcugggggcagaagggucaccucgucaggacguagcuagcuaaaguugguguucucuggcuuuuguuucuagcuacuggguaggcaaguuuaccuuugggaagaaguugaagaaaguaggcuguauauuaauuauugaaagcaaguugaugagccauguugacucagauacagcugugcugugaagggcagagcucuagguugcagaauggcaugcaaugguaaaggcuguaguguaucuugcaggaggggaagguuucagacaagggggagccaugauugugaguagccaaaugacuagugauggggagaguauacugggggauagauuuucuuacaaagaugacgaggagaagaacauguucagcagacguguccaugucucagagugcauucccaaugcuagaacagugugugugugugggggggggggagcuugguguuacuuagugccucucuuuggccccacuguuuugucuacauuaaagaaaaaaacuaaauaaauuaguaaauagcucucggguaagaaaaccaaaucccauuaaaaugauggaagcuuaaauuauaaacaucugagugcguuucaaugagcacaauuugacugucacacuaaaguaaauuuaauauuuugcagaagaucuuuuugagugacaggaauacagguuugucuuuuuuguaaagcuuaguccugcuguguuuuguacacuaaagucuuuguacuuuugagagaguuuuauuugacacaugagaagaguagugacccacugcccuguagaaauaaauguggaaaccuguaagaccuguacagacuucagggaaccauuggggaggucuucugcucugcuuugcuuuguuuuggguaguaugacgucauaaaccugugaacagugaccauggucagaugaucaagguagagacuuguuccuuucaagccaaaucuuaccaguuuaauaauuuuuaguaauucaaaaaaaaauuguagaaagaagaaauugcacuuaacuauguagagauuuguuugucacagaaaugccucugcuguuuguagagaucaguauauuuuauaauguuuucagucuuuaggccauguuuauuuuuuuauuuuuugcaaaccugagauaguuaacuguuugauagaaggaagccaagcaagacaaaggcauuuuuacuuucugcaggccagguuguauaguuucauaaaaaaguacuuucuaguugcauuccacagcaggugaaugucugaggacaacaaaaaaaaacagcuaaaguuauuucugagaaagagagagaaaaaaacaaaccauuggcgugaaugcgagagaagcuuagagacacagcaaggaugaaggaaagagcccuagggagggacaugagaggagggaccagagcggcuuggggcuagggcugacccuggugugccucagcuuagagcguuggacaggugugccagcagacuguuagccacagcgaugcugccaggggucgguagccuaccucacucuacccugcagagcucggcaucuaucucucucucucuucuagcugguuuaaaauccacuacugaacuguuggaaauagagcauucugccaaagacuuauuuuggcauuuucaguggggcugaaauuuuauaucugaauaaauauuuucuucuuagacuuuuaaaaaauguauuguuuuuaaaauuguuaaaauagaagauuuaugaaaugaauucauucagaaaguauucuuguaaaauugcauuuuaacuauaccaaaaucacuaucaauuaaaaguuaaaccuuuaugaaaacgauaaagcuuacuaauugagaaaaauugaugaucauauuuuccucuuucuugccuuuuuagguauuuccaaacuaucauauuuauccuccaaccgcaccucauguugcuuauaugcaaccaaaagcaaaugcaccuuccuucuucauggccgacgagcuccgacagguaugcuugcagaagcuagugcugacacugaccguuggccgugccuuagggugggaaagaguaggcgaguguuuguguguggucacgcagucuccuaagcaaguggauuuagacugugcaaguuuuauguuuaagaaaagcauuuuaaggacaucuuaaauaauguauuagaguauaaaauacagaauuacuauuuaaaugugcugcuuuucuguguuucauggguuuuuuugugcggaaaugauucuuuucauggguuuauuuauuuguguguguguucuugugugcucacuuggaaugugucagggagagcauaugugggagcugauucuccuccuccuauguggguaccgggaacaaaauucagauuaucaggcuuggcagcgagaccuuuccucacugagccaucccaaaugggaagggcucuuaaaauauauauaacuuaggugcccuuuaaccuuuaaacuguugcucuuauuugacacagaaauaagcuucauuuuaaguggcccaacaaaaaucuuaaaaguagguuuuauaaaguaauuuccuuucuuguuuuauuuguugugauaagcagcuuagauauucuuguuauuuauagcuucuuauauguacauucucaaaaguaguuuuuguuuuucagaguuuuucccguacuuaagcaugaaguauauguguacaugugcuccuuuuauccuuuugcagggccuggggguacaugcuaggcaaacauuggcucacugaccuauguccucaguuucugccuaaugauuuuagaauaaauuuuugacuacauuaauagaucuuauauauuccagguugguuuauagcacuuuuuuaguuuuuuugagacaggguuucucuguguagcccuggcuguccuggaacucacucuguagaccaggcuggccucggaacucacagagaucugccugccucugccucccgagugcugggauuaaagguuuguguaccgccaucuucaucuuuuuauuauuauuauuauaauuauuacuacuacuacuacuacuacuacuauuuaaacucagacuaauaaugggagauaguuugucuaggauuggaauuuacguaucguaacaccuagaaauguuaugacaugaguauuaaaauauauguaaauauuuaaauagaaaaauauuuagguauaaugggaaaucuagauaucagaaccucuguuuagaaguuguuaucaauauauacuuauuuccuauucuuaggagcugaucaacagacauuuaauaacgauggcucaaauugaccaagcagauaugccagguaaaaugcaugaugauaucuucuuuccaacccucaggcaaggcaggcggaccucugaguuuguggacagccuggucuacagaccaaguuugaggacagccaaggcuccacagagaaacccuguauuuaaaaaaaaaaaaagaagaagaagaagaaagaaaggaggauaaagcuggguccuauccuuuuuuuuuuuuuaauuauuuucuucauuuacauuucaaaugcuauuccaaaaguccccuauacccucuccccacccagcuggauccuauguuaagccacauuaaaaaaaauuaauagauuaaggauuuauaugccuaaaaacuuuaaaacuccuacuguguauaccuguaaauugauaaaagcauuuuaauagguaaagguuuacuauacgagacucaaagaagccuuuuuuuuucuugugaagaacauacuggacuacagauuuagcucaguggaaagaacuuggaccgguaauuugauuuacuccccagcgcuggaggcuaaaaucacaaaaacaaaacucugauaaauucuucuaaaaugacccaaagacacuuacuguuaaaguagaacuaaaacaagggcuggagagauggcucagcgguuaagagcgcuggcugcucuucuagagguccugaguucaauucccagcaaccacaugguggcucacaaccaucuguaacgggaucugaugcccucuucugguguguccuaagagagcaacaauguacuccuagacauaaaauaguaauuauuuuuuuauauaaaaaagggagaacuaaaacuuggaagaagauacuuguaaucuauacaauugacaaaugagagaaaaagaccugaucaaacagcucacuaagaaaauggcugaagaucaaugugaacauuuuuauggaugguccuuauagccaagaaauguuucaagaggaaauacaaguaggaaaugauuuaacacuuugacaccuuuuagugguagaauauagaucuguauauucucaauauugacaauaguuuaaauuguugaacacguaacuguuuuggaaagcucaaaaccauuaaccuagaguuucaagguaaacuuggaucauuucagccggaagagauauaagauagucauaaauguacacacagcaguggaaaccugaagcagucugaaugcucaucugaagaauaguggauggauuaguaggacauuauggaagaaaguauacugauagacagcaacacagaagaaacuuaugaaugcgauuuaaaagugacauggacgugacuacauccaacgugcaccuuuuuaugaaguuacauaacuaaaauuaacacucugugguguugcauaggcaugaaccagugacuugaguaauauaaacuaaagauuuagucuuauacagcuguguucaaacacauccuaaucaaagagucuuucauuuuuguaacugauaguuuuguuucugagguucacuauaugugcuuuguuucuauuagucuuuuuuuuuuuuaaagcauuucuuuuuuuuuuuuuuuuuuuuuuuuaauugggguggggggguucgagacaggguuucucuguagcccuggcuguccuggaacucuguagaccaggcuggccucgaacucagaaauccaccugccucugccucccaagugcugggauuaaagacaugcgccaccacugcccggcuuuauuagucuuuuguuugacaguuugacuguguugcccuggcuggccuggaacucagaaaacugccugccucugcuucuguuuccugacgguuggggugggaugaaugcuuggccauguucacuaucuuauuagccuuaaagccucacacuggcucaucucuucuuaaucuguucuugcuguccucuuucuuuccgucuccucaguguggacuaaauauguguagccaagcauguuuuacaucucagaagucguuagcaauguccagagccuucugagucaucaucgcuguaagcaguguugcauagcgcgcagcggacggaggccgggagugcucugaacacccccugcaguaugcgggacagcucuucccgggggcaguuaugccaagguugagagacgugacauaggcuuacugcagcgaguucuguauacucaagagcucuuaaucuaacucaucuuugacuuuugggcuuuuaucucugcaguauauuuuuuacaucaauuauuuuauuacuaagcaccccuuuagucaugaucaaauauguggaauuuuuagagcugaacgcauagaauagacuaauaguuaauaauaccuguuuuuuaagauucagcaucccuuugauaaaaacuaaauuaaccagauauaaaaggaacacaucuuacuacaagacagcacucauaaaauaagccagcagcuaaugguaaauagggcccagaguugggaccacagcacagagagcugugccccaugggaaucaagaggaagcuuccggagcuugguaguuguuaacucgaacaguggugcgaacaagugugaccgguugaaaggacagcgcuaaaaaauccuauacucauagccuugucgugaccucuuuuaaacaaaucauguacagccauugcauggaaauucaagauguacagcuucugaagccagauagcguuugcuguggagacccuugcguauugaguagaguuuaucuuuuaccuugucuauuuguuuguuuguuguuaaaaaccaugguagucaucaaaaagguuguuccaaauaucauaguugguuugcucuugugcugucacuugacuguuaauuuccuugugggcacugcaccucuuaauuauugggggaagcauaguuucuuuaguuguacccagucgagccagaggagacuuguaagaguuuugauggcaaaugucacauagguucauacauauauaugcuacccuuaucaauuucauacaacuuauuuuaaauuuaugcucuaaagauaauucaaaaucuaccuugauuuuuauuaauauuagaauaaaauguuuaauauaucaauaacucauuuuuaauaauuauuucugagaacaaaaaucccuauauugugcugcuaagagacaggagaaugugagcuucaguugugcuuggcugccccuaaccuguugguacugaagcuuaguuggguuuauaacaagccugucagacagcacugccuccugacacaagucuguugggguuugacaguggguagugaugcgugugcuugcuucuuuaaugcugugagagguuugugaaugccugucauugacaguugucuuucugccacuuacucuagcaguccccacagaaguugacagcuaccauagccuguucccucuagaaccacugccaccucccaaccggauacagaaaucaaguaauuuuggauauaucacgucuugcuacaaagcuguaaauagcaaagaugaucugccauauugccuucggaggauacaugguaaggaagguggauuuccucagaaguauacuacucuugcuaagauuauucauacuuucauauaaacagugcugucuuauuaugcgugcuuggaaaacaagguuucuuuuauuuuucuucuuuuuuuuuuuuguccccauuugaagauuaauacuuuacagccaacauagaccauuuuuaaaaauucaaauuucucuugagcuaucauuuacaguugauuguaguagagaauuuucuucuuuagguuuucgucuuguuaacacaaagugcaugguguugguugauauguggaaaaaaauucagcacucaaauauuguaacucugcgugaaguguuuaccacuaaagcauuugccgagccuuguaaguacccaguccuguggguccugcucaugggcuucccuguguggagccagacuugugugauguguguuucuguuucuuuguaagcucugguguucgccuaugauuuccaugcuggaggagaaacuaugaugagcagacacuuuaacgacccgaauucugaugccuacuucacaaagaggaagugggguaagcaagagaugcgagcagacuguuuugaugcaugcuuuugaccuggcgaggaguuucuuaugaagacaugcacaaagguuuucuugccauuuuaagggucuuacugcauuuuuauaaaguaucucaaagaauuggaguugguuugcagcaaguuaggaaaaauguguauauugacucauauuuuauaccaguauuuuugguuuauuuuggauauaucccauaggauauaaaauuuccuaugaacaucauuugauagucuucccacccagugugacuguauggucaucuaugaaaucauuucccuagaaacauucuuuuguuuguuaaacgucaaguuaguuuuuuaaaaagcgacuuuacuuuaaaauggaagagaaguucuuucgucuucuccuucuuuccuaauauuugcuuaaauagucauuuuauaauucagauauuucaagggaccuagaaauuuauaauugcagucuaaaacaugcuccuuuagaaggaaaaugacaccacagaaaacguaaauccaauuugagaugucaaaauuuauauuuuuguagguagucugauuuuguguggaaccaagaaugaagcuucaccuuguuagcuguaguuuuuaaucuuaagauucucuugaacacaaaacauaauacuugggugugcucauaaccuugcuucugcauucugacaguugaaagcaguugugguuucaacauaguuguugaauuggugguggaagccugucaggcagugugguggcuucuccuuuugugcugucgucuguagacacgggcacagguuuuuggaggaugugguggcagcuuucccugaagaugugugguuguggcucauauuuauuuuaguaauaacucuugugagauggcuguuagcuuuauuuaucgcuaucuuaaccuuggcucuguugacacuugggccacacaucauuuguucuguggaaucuacccuguauuguggguuguuggacaguggugcuugucuucuggauaccccuauaccucagcucugaugccagaaauaacugcaugcacugccaguguuccuuguugagaacuacucagagcauguuacccauuuuagaagucuguauuuuuucuaggacuggaaacaucucucucaguuucuacauuuucucagucucuguucuuccaugcauuagacucuuauaacccccacuauacuccuuacacauaugaaugccuuacuguuuucuccuacugaauaacuguuuuagcaacaacuucuuuaaaaaggcauguuugucauaagugcauuauuuagaaaauggggaugauaugagauagugaaaguguauuuauauagaaacuauagagauuaaaaugaagugaauggagcaguuagaauggaaucugauggaaaguaagaccuauguguuugcuguaaguccucacucuaagaauuguagcaucuaggaggcuaagucaggagaauugcuacaaauuggaggguuacagaguacaguccucgucucagaaaaacaacaacaacaaaaaaaauagcuggguguaaugccacaugccuuuaauugcagcaccuagaagacagauugagacagauagcugaguucaaggccagcccaguuuauacagugaguauuuccaggacagccagggcuacauaguggauccuguuugaauauaaacaaaaacaacaaaacaggauaacugauccuccuccuuaugaucauaucaguuguguaacuuuauuuaaacauucuuccuuuuggucauggugcugugggcugacuugcagucuugaugcgugcucagcugugcuccagcccucaaagucacacggauucaggacucucuuggguucucucugacaucuucuuagcgguucccgcuaaaagcuguuuggagacuucuaaaaacuucuuuauagaauguaaugucuucauucuguacaaauugagaggaaaugguucguguauauguacuuguuuaaaacauugucccaagccauaguuacacauucacuuuaucuacgucuaucuaucuaucuaucuaucuaucuaucuaucuaucuaucuaucuaucuacgucuaucuaucuaucuaucuaucuaaucuaucuaugauuuuuuuaaaacaaggucauauuuuguagcucugacuuauccugagccugaaacuugcagcacuccuccugaaugccaggguuauaggcaggcaccguggcccccgacuuauacuuucacauuuuuaccucguucacaaaagguuggcuugcagccauauggguacaugauuauguucacuaaaauaacagaauauggauuacguuuuuauaucucuguuacuuaaauauugacauugacucacaagguaugaugaaaaaucaguuuauaagcugggcauggaacuccaaguggcagagcaguugucuaaugugugcgaacaccuagguuaaauuccuagugccacaaaauugacaaacaaaaacacuuauaaaaguuguuaggguaaagacaguuacuuagauagaagcuugcuuguuucaucauugguaaggauacugcuuuuucaguaauuuguucuuauucaacauuuauuuggucagaggaaagaguccuuuagugagaucucugcuacucuaauagugugaaaccugucagcucaguucucgaggcuccugagcuuguuuguugggccuuacugcugugaauggauauucauuuuucuucuaggccagcacgauggaccacugcccaggcagcaugcuggauuguuaccagagucucucaucugggcauacauuguacagcugaguucugcucugcggaccauucauacagcagguuuggccuguagaguaauggacccaacgaagauucugauaaccagcaaaacaagguacuagcauuuucaauguucugaaucuggguuucuugucauuuuucuuuagugaucuauuuaguguguguguguguguguguguguguguguguguguguguguguguguguuguguguucugccugcauacauaugugugcaucacaugugcuuggugcccauggaagccagaagaaguuauuagguucccuggaguuaacagaugguugugaauuauccuuagaaagguuggcaagagucacaaagguauuugacaauaaagacaaaaguaucagcaccacuuucuuguacagaaccaucauucuuaaguugcaccguaagucagucucagauuggugggcucugccugcacagcuggugauguaggaagucuacagaguuuguauuguuaacaaguuguuaaaugauuauugauuaggaucuaaguguugaggauaauacagugagguaacagagaucuuagcuucagcuaauacuuuaguguccauaauauuuugcaaguuguuuugggcagcacagcauguggaagugaagauagugacuggaccuugggguuaauaccuauagucucguuacuugggaggcuaacagcuugggcuacaacauagagacagacccuacacacauacacauacacacacacacacacacacacacacacacacacacacacacacacagaguaaaaaccaacaaaacaguaaagccccaaagugcccugguucauuuucuugccuguugauaauugaggaaauuuuuggcuuuucuaagcuucagcagugcugcuagccagugcugugacugucugauaaacucauucagagguuugaguuaaaacaaguaagacgcuaagaacacagcuaagacacagugucagcugcaucuuuaggaaagugaaggauuaccauuccggcucuuuucaguuacuaacuuuaugccuggagucgcaccauuuaaugucucucaggcugaguuucaugaucuuugaaaugguuguugguuuuguggguggggaggauggagauggacauuagucauuaacauuuuagaucccaucuuaauuauguucuuuaaauuguuuugauccuuacagguuacgaguaaauuguguaggagucuuugauguuuuaacauuugauaacagucaaaauaauaauccuuuggcauuaauggcucaguaccaggugaguaagaauuaguauggcugcuuauuuugguuuuugguuuuuuuuuuuuguuuuuucucuuaagcuaaacuugguuuuaaaguauuugggguuuuaaguuuuccugcucaguguuugauagcuguuaguuuuacucuagaaugcuuguccuacuacauuaucuuccaaggauugacauuagagcacccuguccuauguuuuuccuuuguugccauaaaggcugucauuuuuuguauauuaccagaauuuuauuauucucuaaauucacucuauuauuucugauucaugcuccauaguguucuuagcuauuuucuuacuuauuuucuuauugacauagaacuuaagaacccauuccuggguauguaaucuagugguagaaaaguucuuagcaaauuccaggcucugcauugcucuccauaugccaguacugaaaaaaaaaaaaaaacagagagacuaucccuguggggaaggaguaggguaggcgcuuccauuuggauuccuguauguaagaaccuggguagcugguuugucuugcagugcuucacauugauauacagcuguugcuaaagcugguuuuagguuuuguguguaagaagucaugcgagguuugcuuauuuguguuuagcugcuuguuaaucugagguuugaugcaaggcagaauggcuuggucacaugaggaggcacuauucuguuguccuccacuguucaacuuugguuuguuucaaaagaaguuuuaguuuacuuuaggguaagacaaguuucagaacaagaaggaaggaaaugaugggaugagaaauaagagucccgggcccuguucuguguuuggcuucaugcgacagucugcggcuguuggggauuuagaggcacucugacacccauguguuugcaugccguuccuaucuuaguuccccuuggcugugccuaccuuagcaggcugccuugguugauaucugguauccaguaggcaaugugggaaggaaucgugaugugagugagcacagagcacaccuccagcagcagauuucuuccaucuaaguauggucuacuccuccucuucucauggacuguuauuucuuagugucuucugcugcugcguuauacuuaggaacucauuggccuaauuuuuaucuucauccaaaagugacuaaugagcuaggugugcacuagggaguaggcugaaggcaggucagugaguuugaagauagaauaggcuacuuugagccggaaugugacugaaaauuacuaaauacuagugauuuagauaugucuuaagaaaguuaugcuacauuuuuggauaguauuuaaagccaguacuaccaggaaucuagaaacuucuuguccaggcuaaaaaaaaaauaaaacucgugucuuaagauuaucacuguauauuuuagauagaauuugacuaagaagcugugcacaaaaccuuggguucaaccucuagcacuaaacuauugcuuauuacuauaaaacaaggcuacuuugaauuuucugagucacuuuuuuguguuuugcagauggguacuauuucacuuacuuuauuguguaauagcuuguaaaaugaggcuuuuuuaaaagggagauagauauuaccuugaauuacaaccaaccagcuauuuuauaagccuggggcaaccauuuuauuauaaauaaaauuuuaaaauuauaauaaagugccuuuauuuauaaacugucagcuuucacccaguugucacucucuuuacuuuucaguaaaaugcauuucucagguuucuuuucucuuuuuauuguauggauguagaagauuuuuguauagauuauuauagcaaggccuagaagagauuuacagacaaucccaaaggggagguuuguuuuuuguuuuguuuugugagggcucaggagagaggagcgcauuguuucuuguagucuauuucucacagucugcuucagacacgugauuagagacugacuuucaguaaaguggacauaaguagagccauagauaaaaucagagaaaaaaaacaagaaaccaagaaucaggaagacacugaaaaugaguuggggggaaccuccugaauucaacaaauggggguaaaaaccagauggagguaagaagcaaaaaaaauggaaaauuauuuagcuggaaaauacaggggaaaaaagaguuccuugagucauuaaugccaaaauuucuuaacuaaugaagacuauuaaucuuuuauuuaaaaguaaguuguaauguaaauucuuuuauguaguguguauaucuucuuucugaguuuacgucccgagucagcuuuagauaggugcaacacucagauacccacguagcccuccugugggcccuuuguucucacauaggauaugaaauauuuuaggaggaaggcaucaaaccaggguagagccagacugagacuuguuccguuucaaagcuugggaggcugucugauguuacagucugcucacacacuugauaaaugagcaccuguaguuuacuuugcugacuacaauguauugaaaccguguagaaaugggaaauacuacguauuucucaaagccaaaaguuuuguacuuucaucagcacaacuugggagauuuuauuuguucuuacguugacugaaggacuccuaacuuucaguagccagacagggaugacauuggcaccucccaccaaccugcgcccucccacaccaggcugcagucagggucccuaaaucugguauuaauccuuggcuucuuccaacaaauucaacauauuuuguacauuuacucaguuuucaccugaucacagaaacucauguguaaaaugucagggcuguacugguaguuuugaauaaaauguugaguuugaauagcuaaguguuuuaguaauggagucuagcauguaaacuauuuaggucaaauguuagggauagccaucuguugcugcaguucacuggugaauccuuagaacccuuggcucccugcaugcccauuucauauucuaucaaggccccaugcuucucagccacucagaacagacacaccaaccccuagacuuuaucacuuauuuugaacuuauuuugaaccacauggugggucacaaccaucuguaacaaaaaucugaugcccucuucuggaguaacugaagacagcuacacacacauaaccaaaacucaugcgaggaggaggcuacuuagacaucauuuuauuuaauuugguuuguauuuuagcucuuuggauuuuuuuuuuuuuuuuuuuuuuuuuuuuuuuuuuuuuuuugguuucucgagacaggguuucucuguauaacccuggcuguccuggaacccacuuuguagaccaggcuagccucuuucucagaaauccaccugccucugccucccgagugcugggauuaaaggcgugcaccaccacacccggcucuuuggauguuuuuaauguauggcuagauuugaaaacuccuauaagaaaaaaaaauguucaguagaugaacauggauucaguaacugacuugguaucucagauccuaaguauuuauagaaaucaucaguaaaaguuacuucaauuguauuccaugcuuaaagcaaccacauucuuuuaggcaugugaugauugucauuguagaggaguauugcuagggacuguuuuguuugcuggaguuguuuuguuuuuuguuuguuuguuuguuuguuuuuguuuuuugagacaggguuucucuguauagcccuggcuguccuggaacucagaaauccgccugccggggcuggugagauggcucagcgguuaagagcaccgacugcucuuccaaaaguccugaguucaaaucccagcaaccacaugguggcucacaaccaucuguaaugagaucugaugcccucuucuggaguaucugaagacagcuacacacauauaauaaauaaauaaaucuuuaaaaaaaaaaaaaaagccucugccuccagagugcugggauuaaaggcgugcgccagcaugcccggcuguuugcuggaguuguaagcagugcucaaauucuuuuagaacagugguuuucagucuggggguugugaccccuuuaaaggucaaaugacccuuucccaggggucagauauuagauuguuauaauccauaacaguagcaaaaccacaguuaugaaauagcaaugaaaacaacuuuauagguaggcgucaccaccccaugaggagcuguauuaaagggucacagcguuaggaagguccugaugaccacuguuagaaggaaaaccucacgauaauggaccauuuuuaaaacaaaaaauggagggaaaaagaauucaaagaccuauuauuaucagugagcaaaaauagcucacuauuggaaaacaaagacacggggugucauugaugucugccguuuugauguucuaugauaacugugaucugaaugcuuacuuguagggggcugucuugucuccacauucacauggcuaucuugaacucaggaaauguguguuuagucacagugaucuuggcaaagcaagcauguaguggcccucaguucugugaaacggggaagaguaucaguugcauuuaaaauuucagaauaaaaauacaaauguuggaacaagugagagagauagcucagcacauuaagacaucuaucauguuagccuggagaccucuugaggugaaucucuguagccugcauguaaaggugggaagagaaagcuacuucagaguugucuugguaccugucucaacccccuccugcacccaucccccacccccgaaaacauaaaagcuuguaaaagcaacaguuccauaauuggaauguaaauuguuuacaguaauguuuccuaaaaguauggugguccuagaaaugcuuucauuaggaugacuuggaugcccucaaauguuuggaccuauuaauuaaaugagacugugacagagaggcucaguaaagucacagugauucuuacaaguaaccaugcuccucgugucucucugucucucucucucucucuuuucucuuuuucucucucugugucucugucucucucucauaaugugcuauuccuguuaggugauguguucaguguguuugaaaauauaccuguaaagcagaaauuaaaaguuauguuuauuuucucaugucagcaagcagaucugauaucauuaggaaaaguuguguuggcuuuggcuugcaacucuuuggcaggaauucagcgagaaaauuuacagaaagccauggaauuggugacaaucaacuacuccucugaccugaagaaccucaucuuguaaguccaugaagcagagugguccucugugauuaagauagagauuuccauaggagccgucccacuguuuaaaguuagcagacacaagcaguuauugauuuccuaauuuuuauugauaacuauguauuucuuaggauggauauauaaaccaguuuguuagucacuuggucagagagugccuucuagaguuguacugauagccacuuguugcuagcucuuggguuacacuagucauacugaagagcuccacagccauguauguagaccccagcuaaggcauggacaacaaagaaaugaaaagagccuuuucaucuuuugagcucccucggccaguguugcucuagauagugagagaugcuguaaugcagccuccuucaaaguccaguuauguguaugaaucucugcuccaggggugcaagucaacggaagacuccaagaagucuuugaauauaaguuugggaugaauuugacuuucacuguggacuaccauuaccaccaaaggauucauuacugucucuugacacgagcgggagggcacacaacuuuuacuacagcuaugaguuuaaucuagggggaaagaugcuaagaaaacucuucaaauuuucccuauuauguucuagaagccauuagaauuuauugauccuaaucaauagucucuuuuagcuuccagugaaccuuucugcucuuucuguguagcccuggaugauccaguuucuuuuuggaccagcccugggguauggaacugggggauggaggauggggcugcccaccuguucuuuguuacauuggcuucaccgucuugcuugugagacacuagaagccagugcuugccugggaccuagaaguagucaguuaagaugguagagcguugggaagaaggauuuguguaugauuccacccuuaguuugcaauguccaggguuuucuggacaguuacaggcuauauaauacuagauacaccuuuuuuaaaaaguagaaguuaaggauacuuuucaaauuuucuuuauauuaauaauuauugaaagaggauaauaauauaugugagguuucauauacuauucuuuuuaaauacuugaagauuuccuuagaaaacaguaaauaauuuuuuaaaaaauccuuuguuagugacaauaaaaugguacauaaguaaaaagucaucucucauuagucacaguaaauaccaccaggucuccguaagacugcuugacaugaauugcaguucagucucaaauaaccugcaaguggggugucauuauuagccccauuuuagauacaagaaagcugagaaaguagacuuguccauauggcacauagcugguaauagcuuuuaguaugauuagguaaauguuguaaacguuagugguuauaauggauaacuaagauaguuugugugguuauaaucauucauuuacucaucaaaaggaugcuuacauagggguuggaaagauggcucagcacuuacgagcauuggcugcucuuccagagaccuaaguucaauucccggcacccacagggcaagcucacaaccgguugucuguaacuccaggucuagcauacaugcagacagacgccaaugcauauaaaaguaaauaaaucuuuagaaaaaaagaaugcuuacuaugugccaaaaucugggaagacuuuaauaggauuagcaaaauuuuuauauaucuuuuagaugcuuucaaaagacauuuaaaagacugacgagauggcucagcaguuuagagagucuugcccuuacagagcacuuaaugugcccagccccauacccagcagcucaaaacugccuguaacuacagcugcagggcaucagauuccucuuggggccuccgugugcaucugcacucgucauaccuuaccucaacauacauacaacaacuaaaucuuaaaaacagacagacauaaaaacaagcagguuguuugcaggcagagauuagguccuggacgaaagccuaguuagacaggaggugagagaaggacugacccuucugagugaguuagagaccagguauuaacagucauugcauucugcaggcagccuggaaaacagcaaaacuuucugccuuaauggugauagaaaaagaguugagcuggucccuugugcucucugagucuguagagauuuuuccagaaauaacaggugacacaugaaaucauggagcagaggauaguucuuuugggcuaauucaguuuuuucacaauuuaagauucauuuuuagacugaaaaguuauuuuugguuaggugugguggcaucugccuguagaacccagaaguuucgagcuaguuugggcagcauagcaagacacugucuugaaaacaguagcaguuuaucuuugaagaacaggagggaaaacuccccaucccucagccuuccaguguuuuaacccucagaauucuugagagucauuccauuuagcacuguugacacagggcuccaggguggccaugggcaggcguggcauccuucugcuuuccuuuccacaucucugacugugagcacacagaggagagaugguggauugguaaauguucagggaagagaaggacuacucaaguuucagaauggaauuaauuugcaugaaaaguauguuuucaaauugugagugccagauuauagugacagcagcaucugugugcuuguggcuguguuguuauuaacccuugcugaccauucaugggguucuucucugucuugguagguacuuguugacugaccaaaacaggaugcggagugugaaugacaucaugcccaugauuggugcucgguuuuacacucaauuggaugcugcucaaaugagaaaugauguuaucgaggaagaccuugcuaagguagagucuaguuccuguuuaacuugguauaaaguacagcauucgcugagccagcuagcugggacugugaugcuccuguucacaguaggcaguaguuuagucucuaguauccuauucauaauugugucuaaaauugguuuuguuucacguuaguauuuuaaauaauuccuagaauugaugaguugcauaaucuccugaguacaacugugcacaaaaguaggcauauguuuaagagcagacccagcaguguggguguuaguacuugcugcauuggaaugauguggguacagaguaccauuuuuaaagacucaguucauauucaguuagcuggaacacuaacauucucucucuuuuuaaaauguuuuauaggagguucaaaauggaagacuguuuaggcuucuagcaaaauugggaacaaucaacgagaggccggaguaaggguuuacaguauuuacagcauguuuuaaaaccaaggguuccaguuuguguaaggaaugagcgaacuaccuuguuaauguuuuuauuuugaaaagggaaguucucauaugaagugaccauaaaacugcuaguuauuaagaacuguuugaaaccacagccuggauguggcuguucuuaagaauuuaugugccauacuggaaacuggccgugaugugcagacgugaggcagugcucugccuccuguaggaagccucaucucaucaguuuaucuugucaguugagagacgcuagcagucccuuguuuguaguguuuccuucuuuucuaugaaaaugcacuuucauagaugucauuauugguaaugaagugacaucauuauuuuaugcugucccaguuuuaccuuuuaaguuagaguuaccuuaugcagaguugaugucuguacuuuguuaacuguugagacgggcuggacagaguugcaguugugacuaaaauguguaaguuacacaucagaauugugucacuucucauagagguaggugacagacaggugcuuguggguuuuucuuuuacagcuuaucuuuaguguguauggguauuuugcuuguauguguauugugcacugcgugugugucuggugucuuaggaggcagaauaugaccucagauccccuggaacugcagugcacacaauuguugagucacuguauggaugcugaaacucuaacccaggaccucuuaaccacugagccaucucuccagcccugcuuggcuguuuugaaaaugaagagccucaggaucaucucuaauaaucguccuaauaagaggaugugugcugagccaguuuuaagaccucuuucagccuguauuucaaaaagguggcucuucuguucugugacuuuucuugguauuugauccaccuggugacccacccauuccuucacucugcugaugcauagaucugagaucucuguucucagggcuggcacugcugggaagaggugcaugcuguugucagugugcccaaaguaaagccugauuccaguucuucuccucucgauuuucaguugugcugucuuggaguugaucauaguuccauauagugaacuuaagcagauaauuguacagcagucaacuuucugacagaguuacagaugccuugagacauaguagccuaacaguuccuuuucucaccuucuguucuuguccaggcugcuugugccucguggcugccacauuaaugccugccuucccucauuccggggucuuggcuccuucccucuccggagcgcacgcucuauugccucucuuuuuucuaucauuuaucccuugccaguggagcacacccucauguacaccuuucaugugaggugaauucauuaguccuuugcaaaucuaaaguacuuucucauuuuauacauuauugauauaugauauuauauuuauauaauucuaaacuguccuuauaaaauuuuauuuacauuuuuuaauacgaaauuuuaaaguuuuguagaauagugaaaaauaucaucacucuuuuuauaccugacauucucagucuuuccaguuguccucacccugacuaauuuauugauaaaaauuuuauauuuacuuucagaguuacaaguauaaauauauuguuuaucucccccuuuuaaauacguaaacaucaucacuucucacaguauuuuuuuuuaaagauuuauuuauuauuauaucuaaguacacuguagcugucuucagaugcaccagaagaggacuucagaucucauuacaggugguucugagccaccauaugguugcugggacuugaacucaggaccuucagaagagcagucggugcucuuaaccacugagccaucucuccagccccacuucucacaguauuaauguuagaaaucauuuuguucagcucuguuuggaauuaugcaggcuccuacaugaaacacgagccugcugggcuucucccucugccacccuaugacggaggcauugcuccugugugcaagaacacacuggaggcagacagcuuagcuaccuagucauggacuguugaugccaugagcuacagacagugcugcagggggaccuggucaccaaagaaucgagcagcacuggagucuucagagaacagaaguguugcaaggauuguguuguacuguucgugagaggccugacugaaaauguuuccuuggaaguugggauuuuuucccagcaccuuggaggcagaggcaggcggauuucugagaggacagccuggucuacagagugaguuccaggauagccagggcuacacagaaaaacccugucucaaaaaaaccauuuaaaaaaaguugggauuuugucuguugugcuguugguuggugcccuugccugcuggagguugccuguuugagggcuuaguugucucugaccgugcuuaggcucauccucgguagaugucuguguguuugaucaaauggaucaaaccuuuuuuuaugacucuguguucagguuaagaauguuguuuuauacuuagaaaugaaugcgugaucucaugcuuucuucuagaaugcucgugacuucuuucccccaguccauugcugcugguucucugacuuccucugcaaacccugucuagacacaguggcccuuccuaguucuugcgaauugcagagcaugcuuuuuuucugggacuagcagccucagcuuccucuuuccaggauaggcucauguuucagcucugucuacccucuucucagagcaccguguagcuggguagaaucccugcuuucucagguuacuggagugacguguguccuaccagacuauagguuccuccggucacuuaaaacuaccaguggucucugguucuccaguuccucacagcuucaccuucuggugaaguguagaagacuaaaagcuaccuugcuuucuaaacauuuccuccucuguguuccuugguaaaguggaaacuuagcugaugccucuguaaccuggaacacggaaggaggagaggaccuuacagcccuggcucagagacgucuacagacaguuuucuauuuuguacuagucauaaagauugaauagcauguaaggggcaacuguuccugugaagagaauaugugauauguguacuuuuggguugguugagauuuuuuaagcacuuuucagagcccuuccaauuucuaauuaacuggggaagauuagaugaaucuugcgucugaaaaaauauggcuguguggcauguagagugaguuacugaggucaaauguuaaccccccagguuucagaaggauccaaccuggucagagacuggagacagauaccuguugaaacucuuuagagaucaucuuuuucaucaggugacagaagcaggugcucccuggaucgaccucagucacaucauuucuugucuuaacaagguacuuguaaggaaaagaaucguguuuaauagguucuuacuaugucugugugugugcgugugugugcacgugugugugugugugugugugugugugugugugugugugugugcgugcgugugcgugcgugcgcgcgcgcgcgcuccugcccugugugcacauacaaggucagaggacacuuuggaguuccucugcuuugugcuggugugucaugcuugguggcaagcacuugggccacugggaacucaccugccuuguagauuuuugagaucacaggauagcuauuacagcuuaaagagccaucuuguguacaagugcuaggauccugaagaagacaggauguauguuugcuggacauuuucuaaagugggaauuuuuugucugggcacgguggcucaugccuuuaaucccaacacucagaagcaaaagcaggagcgucuacagcaguguucucaacccuccucaugcugugacccuuuaaugccguugcucguguuguggggacuauaacguugcuacuguuaugaauuguaauguaaauauuugauaugcaggauauuuaauaugugauucuuaagugacucaaagggauaucugaucugugacccaaagggguuuugacccacagguugagaacugcugauguagaguuuucauaugcgaaccuuuuaaugugauaaagcaucauaagaugaccaugguccuucuuuuauacuuuguuuuguagacaugucauuuuguuuuauuaaguaguaugauugcaugcauucaguauguuugcauauauguagauacauguguaaguaugauaaaagagaccaaaggggaaagggaagggcugacacccaagguuguccucugaccuccaccacaugcacccacauggggugggguggucugcagugaaucacagccuucguauaaagucaggguuaaacagggaccugcuccacacacuugauuuuuuguuuguuuacuuauauuuuaaaucgcuugcaaacugacacuuuuuuguuuuuaaaaugugggaggagaguguauuuauguugcucccccucagaucuguggaaauauuuucugccucagcacacugugccuacccuugaaguagcggaagagcagguaaaccgugcacggcagaccugcugacucccaggcucggcucugcugcucagugcugugggccucucauccaccuugugugccuuacuuucccaacucucuaacuucucuuaaagggagaacaguggggggauccauaaguaggaaacauuccuaacagaucucauagcuugguauuguuaguaucaguuaguaauuaaaacuuuuguuuuguuuuuuuuuaaauguagauacugacagugguacuuacaguaagcuacagacagucgucuugagaagacuggauuucauauccuaaaaaaguaaaucuuauuucaaaucugaagugccaauuccccaaauuuaaugaguauaguaaaaaggaagcuaaccauauugauuaaggucuaaaaaucugcaaaaggccauuuuuauggaaaugaugacagaaauuguugguaaaauauuuugaaaguuuuaggccucaagugaaauguaaagcuuuuuaaugaaucaauuagugggauacugaaagaagaagcuuaaaaaaaaaaugaaaaccauauccuaaauauuguuaccaaaccccaguaauggaauacguagacagagaucauaagcuggaacccauaaaggaagcuacagagauggauuacgguggugcacacccuuaaugccagcacucaggacaccgaggcaggaggaucuuugaguugugaggccagccugaucuacagagagaguucugggacagcuaggacuacacagagaaacccgucucaacaaacaagcaaacagaaaaauaggaagguacucguuugacauggagcggcugguaguuguuauaacucauugguaacauguaauugacguucuuuggagagcagcuuggcuguggguaccacgcugugaagacauucaugcucacauuugauagugcccugaagguugccuccuaaguuguacacugcaagugcauucugcucuguacugguauuuauaauauagaaaguggaaacuauugaguaaauaauuagugucaaguuggcagaagauaggaaucaaacacauucuaaacacuagggcaggcagaggaaacauagcaauguuucuuugaauucuuaugaauuuugacccaugguguaagcuguuuauggaaaucugaaagggacugugauagaaauaacuuuaauuuauuauaguauuucauucaucaucgucaaaaauguuguccuaaaauagauuaaucuuccucacaguacguacugcauauuuuuuauacuuuaccucuuucagcuagaugcuggugugccagaaaaaaucagccugauuuccagagacgagaagagcgugcugguggugacauacagugaccuaaaacgcugcuuugaaaauaccuuucaagaacugauugcggcugcaaauggucaguuguaguauuugcuaaaaauguugagagggcauggugaaggaccaagccucuagccaguuugcacuacggcugaacuguccuccaucuccugccaccagggggaggagcaggaaggagcgaagcuucucacacgugggucuaacaggugcacuguuacuugagaggaagacugucucacuuugugcgcacucuggcugccucaggccuccgaggaauuugugcagacucaggucaccuucggugaaugacgcgccugcuuacgguuuuccacuuguguaugcacuaauugucauuuuuuaaagacuuuuuuccugaucuuugaccucuugccacauuguauacuuacuaagggaacuauuugcaaggacauugggaaacaaagggggcagcuguucgccacugagagaugcagaauuugcucuugggggaugggccaggucaguacauuaguucauagaaaugccguguagugcauaguccuuaugaguauugugugcaagcuccacaugccacccacuguuagcucaaguugaggcuuguauuguguuuaagaacacgcagagagaaauaucauugagcugucagauaugaauuuccguuuguugauuuaaauccuuuuccagguaacgaucggaacaguaacugaaggagcaggcgcugcucuucuccagguucaucuagaggcuucuucaaagaggcgucugucugccagucacauacacuuaucuugacguaauuuuuaauagcaaaaugaaauugugcugaaggccuaaaaguggaggaguuauauuaccuuagggucuuuccaguuuauuuguuuuuuguuuuuuuuuuuguuuuuguuuuuuguuuuuugucuuugaacuacagcuuuauaaugguacuuuacacuggauagacucagacacugucgaggaggugagcugagcacagcaguggccugaugcuuugcggccugacucuggagggacacuuuucugcugugccuuugcacucacugcuuaacccaaaggaacaggacuuuugauaaaacucacccuguagggucggucaucugagaaggccauuucaaaaguuggaguuuuccuccauggaacuuacuauuuggacaugcaguugucgccaaacucaaguauugugggauuuguggucacuucgauacugaagacugccaaauacauugggauuuucucuuaaacagccgccaugaagacuucaucuccuucccggugcuguguguugagcgcgcacugggugugcaccccauaccugggaagaaauguggggauuuggaggucaggacagacuccaagcacuugcaacugauguuacugucuucauuuuuaacaaguaugcguauuuguauauuucagagaaguuuuuaacauuucucuguccacuuuuuauaagcuuuaaaaugauuuuucucugccuugaaauuugcaucaagaaaaagcaccucucuucacugaaagcuuugaggacuagagacacacuucccaugucuaacaagcacgucuguaucugagagcgcuagcaucaguuguuaaugagaaaaucaauuacugcauuugaucuggauggauuuuagaagaacauaauguucaauauuccaaggauaaugaacauuugccaccaugauguuccuuguguuuaaagggaacgagaacuuucgguguaccacgcagaagucuuuaucauuagcucauguauuugaggaagagcagcugucuuuuuauauguuuuuugacaaaucauauuguaauucuuuuguacaaaaaagaacuacuuguauucuagaagaaauaugaaaugcuuaauuuauaagcgggcuggagauuuuuuuccaauauuguuuucuuugaaaaugaaaggggaucaucuauuuuaguuuugggggccugggaacuuuuugaaaauuuucauuuguggaccaauguuaugugaaugcuaaggaagggcagggguaacauagggcuuggaccucuaguccugcauagaccagcaaacuccccucugcaaggcagguucacaucacaaccccgagugucugcaucagaaaugcuagucugcuuccgccccagcaaccucaggacuuggguuggguauaaaagguagucagcugaaaguaccuaaguaaauagugucagccagaaaacagucggugucaggugauacguauuuuuuagcuuuguuuuauauuuauuuuucauuucauuuucauugggaaugguuuucaaaagaacucuugaguucugcuuugauggguuucuuuuuuuuuuuuuucuguuuuguuuugcuuugcuuuuuuuuuuuuuuuuuuuuuuuucugggagcccucuuuuccacaguguaaacccauauagaagguugucugaaaguuacuauuuagugcauaggaagaguuuaauaucugagaguaucgaaugaaggaugugaacucaucauaacuuccuguuaugacagacacaacacggaaaggacaacccuugaaaucaugucgcgucgcucacuucagcaguguacccaucuccaguccuguuaguguauucacuucacugcagauaccuuugagggugcccuuguguucugcuuugaccuugguucugucauuggauagcaacauugucucuagaaagcaccaguacguuuaaguucuaaugucacaaucccaguaccuguugcucaucuuuaacccuguuuucagucucuacguguauagcaguauuuuuuaauaaagaauugcagaaauaaacuuguau

SEQ ID NO: 2810 - RNA, 5120 nt, Mus musculus
caccacaccacccuggacaccccugagcgcaucuucuacuacaugacuggggggucuuguuucacguguaccaacacauugagcccuucagucaucauaucuucucaccagccgagccagggaagagagggccugucuucuagaaguuuccaucuuguuucuuagccccaaccacaaagagaccgguuuccaguauuccaccccaggaccccagcucuccacaaccugaccugacaacauggaagagugucgauuggaaggugagagcucuucccccuucucuagaaugucucugcuuaggaauuacaguacauuuuccauuggaaaaaaaaauucuacauuuaccaagacuugcuuuacguuuuuaugaaaaagaugcacauuuuguuacuucucuguugcugugauaaaacacccggaccaaggugccuuagagaaggaaggauuuauuuguacuuaugguuccagagguguaagauccaucaucaacacagcagggaagauuggcagugggcagacauggacacuggagcugagagcucacagcuuaaaccacaggcaggaaacagagagcucagugggaauggaucaaggcuuuugaaaccuuaaagcuggccuucagugacauucuuccuccagcaaggacaaaccucuccaaaucuaccagaacaucucuuccgacuagggaccacacguucaaauacugaacccauggagggcguucuccgucaaaccaccacagggagugccccuguugauacugugugaauuguucauccuauggaaacuuuggggucucuaucacggcaaaugaaaugauuaaaauuuuuuccaaaagucauaagaggacaaggaggguggcucagcagguugggugcuugcccuagaaguauuggggaccagaguucaaauaccuagaguccacagaaaagcuacaugggguggccaccucacccggggaaagcaagguggccagcuggacuacccucaauagugaacuacagguucagugagagcccucaccucaauauauaaggaagagagagugauagauggagauauaugccaaucccagccuccacagacaugcacacacaagcacacacacacugcauauacauauauguaaaaacacauguaagaacaagaugguuuauuuagugccauuucuguugauggaggggugggacauuugugacaucaacaguacugucacagacaccugccuuacaugcucuuauggaaaguuccagaaucaucucuggcaguagaauuucuggguuacuuggacuuaaagauuuauuuauuuauuuuaauauauauauauuucuggguuacauauauauauauguauauauauauauaauuucuggguuacuuggacuuaaagauuuauuuauuuuaauauauauauaauauauauuuuaauauauacauauacauacaaauauauauauauauauguauauauauauauauauauauacacuguagcuguacagaugguugugaguccucauguaguuguugaaaauugaauuuuuagggccucugcuugcuccagucaacucugcucgcucagucccugcucacucugacccaaagguuuauuuauuauuauaauuaacuacacuguagccgucaucagacgcaccaugugguugcugggauuugaacucaggaccuucgguagaacagucagugcucuuaaccgcuaagcuaucuugccagcccagguuccuugcauuaaaaaaaauauuguuauacacggugguguucauuaaauguaacacugugacaagaucagcuuccaggaggaagguucuggaagcuaguucugucuacccuggagaggaagcagcagaacagcuucauggcugagguagccccuaauacucuagccaaucaggauguaaagaggagacugaucuagauccaaaagcugagcuugccuucaaggacccacaucagugcucuaggcugcugugaaagaguccacaagcucuuaacauuugccucucaaacucacacaggcaacaagcuuagacagcugcgagucaccgguccagucaccacugccauuugccgccuccacacacuguccugaauuccaguuagugucauggcgguggcagaguaaagaccaaaacaggguagagaucuggcuuccaaagcucagcagguagagaaagccccgcuccagcuugcucacagguaccaaacuucacagagcuugcaugcguccgccacugacccaggcucaccagcaaugaagugucgugaaacuucacaauucugccagcuggacagacaggcaugauguuuugcuuugaugggagaaaggaucagaggcucucuguagucuccuggucccuggggcuucuuuguccuguucugccauuucagaugucugccugggaucuacugggauauaugcgucucugguauucggggccuuuacaaacugaggcauugguaagugcucguuggaguuccagauagacuccguguuuacgaucucucuucaccagucuaugagugcauuuguuuaucuguacuggcuuuugcuuucuucuauuuuaaggugguuuuuaaaauuuuuaaauccuuggauuguggggcuguggguguaggggaagaggggaguaggggagagagagccugcgucucaccagaguuccggugcucuagguggggggugggggggaugugggaggacugccagaugcuuuccacgcacccccccccgugggcaucuggcugugugaagccacugacccgacacggcgugggguggacaaggggcagcccccguaccagguucucagucucuggcaucccaugcuggauacagcagaggagcugagaacagaauaggggccgcagggcagcacuaggccucggagauaaggaaagagggcagggggagaugggggugcugggugguucccacgcaggcagaugucuuuugccuugaugaacagagacagucugaacuuuauuguagaaaggcaggaggaaagagagaagagagagagagagagagagagagagagagagagagaccggccauggccaagaggagagaagggggaagggaaagagagaaagagaguaagagaguaagaaaggugaaggcuuagagagagagagagagagagagagagagguaaaagcuuagagaaagagcaaagaaaguaaaagcuuaagacagugaggaggggccaagcagccccucuuauagugggcuguguuaucuugcuguugcuagguaacugugaggcggagucuagccagaaggccagaagcuugggacauugucuacugacuguuaaccacaugccucucuugugggggacugugggggcgguaacuucgacaggagccagggguccaggagacaugaucaaacaccuuccaucacauguagguggaaaucaccacccaccggguccaaccggaguucaagaccucagcucgacuggagaccaggcugucuguacauagcccauugccucacacuuggacuuuaugguuuuuugaaagaucugguuuuuuuuuuaacccuccagaccuuucugcccuuacaggaaauaacuaaagcacagaacacagggcuggagagacggcucagcagcagagagagcucugguuguucuuccagaggacccacaucuaucagcucauagcuaccaguaacucgguuagagggaucuggugcucucuucuggccuuugugggcacaggcacacacacacacacacacacacacacacacacacacacacacacagagagagagagagagagagagagagagagagagagagagagagagagaggccucucuccucucuuccuucuccuccuaggcaaacccagagccuugggaacgcuaagccccuucuuucccacugagcgaucagcccaggguugauauguuuuuagccccuuucaaguccacauucuuugccugucugucuaggcacaagcuucuuaaaaaaaaaaaaaagauuuuauuuauuuauuuuauguaugugaguacacuguaucugccuucagacacaccagaugaggacaucagauuccauuacagauguuugugagccaccaugugguugcugggaauugaacucaggaccucuggaagaacagucaguucucuuaaccacugagccaucucuccagcucuagcacaagcuucuuaaacuuuacccacucacacacaguucccacucacacacaguucccacucacacacaguucccacucacacacaguucccacucacacacaguucccacucacacacaguucccuauuguccaagaaauuuucaccgaaacccagaauaauauaaaaugcauacacacaaaaaucaaacacuuagcugggcaugauggcgcacaccuuuaaucccagcacucaggaggcagaggcaggcagauuucugaauuuaaggccagccuggucuacagagugaguuccaggacagccagggcuacacagagaaacccugucucgaaaaaacaaaaaaaucaaacauuuauugucaugacagauuguaaagaauuuuauuuugaaacaguucuuggacauacauaugauuuuagugguuaaauauaaaaguugcauucuaauuuggcucugcuuuuuaaacuuuuagcuauuuugagacaggauuuuuuguagccauggcuagcuucccacucacuguguagcugaggacggccuccugaccauccuguuucuaucucaggccugggacaccacccccacuuugugggugcugggcaagcccccuacccaccgagccauacccuugucucugcucacuuaguucuguguagagaauuaaaucuuagcugaacauuugguucaagacagcagauaucuucgacauuuuucagaaucauuuuuuuuuaauuguagaaacaucaaugaugagaacacugcuccucauaaauacgugauacaaaauggcagagguauggcuaagccauuccagaaauugauagaaauucuguucaaaaguccaaagguaaaauucacuuacugauuuuuaggcaaauucaagucaacaacucaaacagcaguuaaaaaaaauuauuacacagcuc

SEQ ID NO: 2811 - RNA, 1339 nt, Mus musculus
uuuuuuuuuuuucuuuucuuuuuuaacucgcugcucucucuggucacgauucucucccaggcauuuagcaacucccucuuggcacccgucuggugccgagccggauugauaacucucuccacagcuguucccuuacagccggcccuccucuuucugguaaauccauauuccauuugcuuuucugcagcagccugcuaucucuagggucuccuuaaaauagauaaacacugcucuccaagggaagucucgaggcaaaacccacagcacauaccagcccuauaaucugcuccagaaggcgggcagauaaaaagaaaggcaacaggaaccacccacccgugccggcuuuuaucauuuacuaagcacuuuugacccacauggucuuauuuaauauucacaauaagccauaaugcagguauaagggcuauuuccaccuuauaaaaaggccccuaaagaaggaaagaauucggugcaggaaguaggaccaggacuggggccuguucuuuugaaaacagcuauguaaauuguauuuggucagacacacaaggccaagaauucagcugcagggcagagagagugcuuuucuagcgaacacaagacccugcauccaauccccagcaccuugaggggggaaaagaauagacagaaggcucuuuggugcucauuuugguggauucuggcagagggcaucucccaucuaaugcgugggacgagacuguuuggaguuuaagaaucuccccaguuugagaccguuuccuuguacauaaugagcucauccugcaaagagcacccaaguccaaauaccacaucuguuuguuuccuaugcauagccugaaauaaguuuacacgguauguucagcaugccugaguauugacugugcccuguccccgugucaucaggcuuggaacuuuccgcuuguggccucucucauacaagcucaaaagguuucagcauuuccaauuuugugcuuuuuucuugugucccaugcuaugucucugcacccaacaaaauagguaccacagguucccccaaggaagaccucuucccauuuaaacaaaagcccccauuccuuuaggggcuugcagaaaguuccuacuugcuagaaggggaaucacucuccuuaucucuggcaauaggaaucuguggcccuucauuaacacaugacuaugguucuuauugaugaaugcuacuagucucugaggauccccagcccagcucacaaaccccuuccucccggucccaucuaacccugccagucuucuuuccccuguugcuucuccuugcuuucccaggagguggccucugcaguuuggaauaaacuucucccaauuuucacccacu

SEQ ID NO: 2812 - RNA, 1339 nt, Mus musculus
agugggugaaaauugggagaaguuuauuccaaacugcagaggccaccuccugggaaagcaaggagaagcaacaggggaaagaagacuggcaggguuagaugggaccgggaggaagggguuugugagcugggcuggggauccucagagacuaguagcauucaucaauaagaaccauagucauguguuaaugaagggccacagauuccuauugccagagauaaggagagugauuccccuucuagcaaguaggaacuuucugcaagccccuaaaggaaugggggcuuuuguuuaaaugggaagaggucuuccuugggggaaccugugguaccuauuuuguugggugcagagacauagcaugggacacaagaaaaaagcacaaaauuggaaaugcugaaaccuuuugagcuuguaugagagaggccacaagcggaaaguuccaagccugaugacacggggacagggcacagucaauacucaggcaugcugaacauaccguguaaacuuauuucaggcuaugcauaggaaacaaacagaugugguauuuggacuugggugcucuuugcaggaugagcucauuauguacaaggaaacggucucaaacuggggagauucuuaaacuccaaacagucucgucccacgcauuagaugggagaugcccucugccagaauccaccaaaaugagcaccaaagagccuucugucuauucuuuuccccccucaaggugcuggggauuggaugcagggucuuguguucgcuagaaaagcacucucucugcccugcagcugaauucuuggccuugugugucugaccaaauacaauuuacauagcuguuuucaaaagaacaggccccaguccugguccuacuuccugcaccgaauucuuuccuucuuuaggggccuuuuuauaagguggaaauagcccuuauaccugcauuauggcuuauugugaauauuaaauaagaccaugugggucaaaagugcuuaguaaaugauaaaagccggcacgggugggugguuccuguugccuuucuuuuuaucugcccgccuucuggagcagauuauagggcugguaugugcuguggguuuugccucgagacuucccuuggagagcaguguuuaucuauuuuaaggagacccuagagauagcaggcugcugcagaaaagcaaauggaauauggauuuaccagaaagaggagggccggcuguaagggaacagcuguggagagaguuaucaauccggcucggcaccagacgggugccaagagggaguugcuaaaugccugggagagaaucgugaccagagagagcagcgaguuaaaaaagaaaagaaaaaaaaaaaa

SEQ ID NO: 2813 - RNA, 5119 nt, Mus musculus
uaacggaugccacagagccccgagggcagcaagauugacagcaucuacagcuugaagaggagcagaagccuucgcggcguugcguuaugaugcgucucuauugaucuggugagcguccuucucugucuccagcaaucaggggaugagaagcagcggggagaucgucgugcuuaccguucugauguaguucucaaagucgcuuccgaagaagaagaugagguaaugguugaguaucccggcgaaggacaugaggaacaggaacaggaugauccgcuugccgaagauguagccaggggugcugcgagagaagggagggggccguagaugcaucacaaacgacacccaguucacccagugacgccgccacuuccagacacggggcguuaaauuauuccgcguuuacucgcucuauuuacccacuuacuucauagcaaggaugggcacgacccuccuguaauuaagcacugcgcaugcuucaaagccaggugaaggagcccgccuuccagccugccauccuuugggcucaguggcucuggcuucccugaguucucuuuuuguccuuaacuccaggugacagaaggcuggcaaggccuaacugcgcucagagagucggacugaggcucgggagcaccguggacucauuaagcccucuacaggguguucccugucaggagcgccucuaaggcucucacuggaggcugggguguaaugaacauugugcucaggagaugguuuaaauacaccggugaaggugcuuccgcccucgaggguucaaccuuucccuccugagguugccugggaagaagucagguuggcccuaaugagagacaaguacccagcgauggaaacacaucccagaggagugaaagaaguuuuaaucucccuuucucauccccuccccuccccuuccguccccucuccuccucuccccuucccuucccuccucuccccuccuuucucuccccuccccuuuccauccuaaauauuuuacacagagcaucaucauuuggagauaggaggagauuccucaugagaagugacugucuaauggcgugccaaggcuacccauguccucugucccucugcaagacccuuggcugcugggccugggcccaucugaguggcgcugacaugucuggaauagccagugaaacgguuugucaagauaagauuucaguaaugaaccagcaauggcauggggcaaucagcccugauuuggagcuuagagcaaaaccagcgggacaggugagcuccagcugacacaggcuguuucaaacugucacagagggcaccaaagccagcguccugcagucccacauugccuuaccagaaauuuuaacuaguugaaaggaaccccagaggcucucaacucucauagcaagcaaguauuugcucagcuguuggguaccaaccuccucgcuacucugucauccgcagacuaagagcaucagcguguggugggagccuagcagaagcccaaucccccaguccuucucaaagcaggaugaagcccgcugcauucaacaagcucccugugugacacacggacaauggaagccgagaagccccacucuugcuagcuggcuaacaacuuggguagaaaaugucacuaaagucccauauguugaaggguguccaguugguggcacuauuaacaaauaauugggaucacgagggcaccggccucaucaguucauagcugaacgggcuuuuaggaagugggguacaaucagaggguguaggucacuaggucucuuucucuuaaaauucuguaaugcugucuggugaugugugugugcacaugccacagugacuaugcuguccagacaauuuugacucuucccaacacgugaacugcaaggauagaaucagggagucgggaguuaggggcaacgguggggguguggggcguagccaaaggaaggcaagugcugaggaaggcugggugcagcucaacucuagacagugcaaggauugucuguuguccggggcuuggagauuucuacaucucguauccucagcacuccuggagguccaaaagaacccaugguaagaugcaaacauuagcucucauuucucuugacgaugagaugcuuaauucacaagcggccugggaagucagaccuaccuaaaaaguuauugccgccccagacuccaccacggagaacagcugggcgugcaggugcaagcaguguacagcccggugugcuaaaacaccccuaggaaucaaggcugugcgaaggaaaaauuuaacaggaaaaccaggcaacucuccagcuguauucucagacuccuuaaauuucugggacgugggaaucuuagucuguccuccuuucauccaaggaggucccgacgaaccuucaguggcagucagaggguugcuccacacccuccuacugggaaagcagaggucacaucagguucuauagcacccugggaccuaccucugaguucucucucccagauagccgacaaaguauuuuugccucacaaacagguacaucaguccggcgaaggcggcagggacuaaaguggagaaacgaaaacacacacgucagucucgcggucucccaagcaguuguucacacaacaguaccagugguuaagccauuagugucugaccacaaaauccagcagagaccuuggguucuguaaguggaggcuagcaaacugccuucguucggguuucuguugcugggaaaaacauuauaaccaaaagcaacuuggaaaagaaaggguuuucuuuggguuuacacugccacaucacacuucaacauuaaaggaagucagggcaggaacucaaagcaggaaccuugagucaggagcugacacagaggccacggaggagcaguacuuccuggcuugcuccucauggcuugcucagcucgcuuccuuacacagcccaggaccaccagcccagugaugucaccagccaugugggaggggcacucugacaccagucauuaguaaauauacuacuccacaggugugccugcaggccagucugauggagccauuuucucaauuaggagucccucuuuccagauacaucuagguuugugucauguuggcaaaaacaggcagcaugaauacaguucaaaaacgagucacaagacugggaggaagcagagccuaaagaauagauugccucagcagcucuguggcauccuacacgugcuggcuuagguaccagcaguagggcauccuucaacguguuuaucucuggauaugggaaguugaacucuggcagccugggggaguugcauggggcaucagcugggaaggaacgcagggaauguucacgccuucaaccaaagccccaauuuugagucugguuuucuugagaugauacucugugucccugggguuucugguacacaaagcacacuuuccggccucuagggaaggaguucucuuugcauuccaaucucuggguaaauaaauagcugcugacagcaccccagucacccucauaaaauccuaaauuuagcuuugggagcugaaaacaccaguauccuacgaguagggugauauacuggucaugugugugaauaaagaccuggcacagcucuccuacuauguguuaacaaagacuggucacaacugucccucuaugugaggauaaaagucugucauaguucuacuaugugagaauaaaggucugucauaacucuccuacuauguauggacaaauguuggucacaacucuccuacuaugugaggauaaaagccugucauagcucuccuacucuguguagauaaaggcuggucacagcucuccuacuauguguguagaaaggcuggucacagcucuccuauuauguauagauaaaggcuugucacaguucuccuacuaugugugacuaaaggcuggccacagcuccccuacuauguauagucaaaggcuagucuccuacuaugugugggaaaagguuggucacaacucuccuacuaugugaagauaaaagccugucacagcucuccuacuauguguguagaaagucugaucagagcucuccuauuauguuuagauaaaggcugggcacagcucuuucuacuuugugugggcaaaggcugguugcaacucuccuacuaugugaggagguugguuauagccuuucuaucuuuuaagaaagaguguuggaguaaaaauagaacuaugugagcaaaaccacuuugaaagccuccagccuuaugcaaacaccaaaguagcuuccaugagugagaacgucacacaggccaggcacuuuuggcuccaaagccaccugcugacuggggcagcuuuccagucucugucuugcaggagaaaucuaagcaaagaacaaagguccaugagagcagcugucuuucccaggucaccucugaacuuggcauaggccuggaacauauaggcuuucaauaauacuuaucaaauaaauguuuagugaaguccacaaguaucacaaagguggcucugauuucuagaucuuucugauuugauuucaaaaccuuauuaucacugccaccagcagcaucaauaacacuuacggagugcccauuguuaacuugaaccauauggaagaaacacuuuuuauuuaacauuuauuuuuauuuuaugguaccaguguuuugucugucugugcacuacaugcaugcaguaccuacaggggccaggagagggagccagauuccccgggaacuaauguuacagaugguuguaaacugccauauggaugcugggacuugaaccuggauccucugaaagagcauccagugcucuuacccacugagccaucucuccauuuugcaucuugacagaauacaaguuuucucucuugugguagguauuguucccuuucagaauuuagacugccuaggaggugagccucugggaggucauuuugaugauauuuauuugaugugggagaauccauuuuaauuuuaggcagaaccauuuccuagaugggguaccuuggcuggaucuaaguggaggaagccgacugaacccucacaugcauucacgacugcucucugucccugauuucagaugcugugugaccagcucccucaggcucuugugacaucucugcugguaaugggguguaacuuagaauugugugcugaaauaaacuuuuucuca

SEQ ID NO: 2814 - RNA, 3312 nt, Mus musculus
ccaaugaggcaggcaggaugagaagcuggccacauggggcuucacguuccugucuauccuggaacaugcuggcuguggagaggauauucucaugcaaagggcuuccgauagauaucugagguagcugauucccuaaacugaucucacgguggcccagagugccuuucaaaauuacaacgcucugggaaacauuucuagaaaucucacuaggcucuggugguauuauguauuaaauauuuaagucccagaccaggguuucuacccugccuugguuauuaguuccuggaugaaagacacacucccaaccuuuauaguuacaauaagccucugucuuaguuaggguuuuacugcugugaacagacaccaugaccaaggcaacucuuauaaggacaacauuuaauuggggccggcuuacagguucagagguucaguccguuaucacaaggugggaacauggcagcauccaggcaggcacaggaggaauugagaguucugcaucuucauuugaagacaacuagaagaagacuggcuucccagcagcuaaaaugacaugucuuaaaguccacacccacagugacacaccuacuccaacaggaccacaccuucuaaaaguacuacucccugggccaagcguauucaaaccagcacaagagcugggcagcugcuuacccaaccccaaguuauuacuuacuauuuauuaagugccaucugggauacucuuagcucucauuggacagccuucagagccaugaucucuugauccuuaacccacagcugcuucuccuuccuccucuccugcaccuucuucaucuuauaaacccucgaaaccuaaaccccaccuaugucucuuaugcccagcuauaggcugucagaaucuuuauucaccaaucagaauuaacuugggagcagguuacacaguuacaugaagacuccaggucuugggggcccacacuuagcauugcaauagacagcaaaagacaagaccucaacagguaugauucugaagaagcuggcaggaaagaaaguagcugcaucgccaucuuccaaagaggccccagccacaccucugcuaaucagaagcacacaacacuuuuuuuuuuuuuuuuuuugagacaggguuucuauguguagcccuggcuguccuggaucucacucuguagaccaggcuggccccaaacucagaaauccaccugccccugccucccaagugcugggauuaaaggcaugugccaccaccgcccagcaacaacacuuuuucuaacgucugcuuccugacuucuagaaaggaccuaugcguuucuugugaacacaaggcaccccaagauaagaagacagauagagcaagggauggacauggucauuuccucagugauuggagaaagcuauagacuucaggugagcagggcuuuccucacgaggggucccgccccacaaagggacgacaccccuuccucccgggcaccugccacucccucucaguguuccccugcagacauugaaguugcaguagauucuauaacgcucaugaugguuuccuaccccaugccaauaaacucuuuucucuuucaguuugauuuccaggaaguagugaagaauuucuucccuccaggaacgauugugcugaauggagagaauuugagcuucaccuacgaauucaaggcagaugcccuguuugauuucuucuacugguuugggcucagcaauuccaccguaaaagugcacggaaagguucugaacuugacaaguacgaacccagaaaagaaagaaacaaucaaguuauuucuggaaaaaaugagugaaccucuaauacgaaggaguaguuucucugaucggaaauuuagcgucacaucuagagguaggucauaaacucucaggguguggggaaagugguuagcucaaaggguagaauaaaagccacuaacugaaaugccagagaccagccucuuuaccagaaagaacagugauuuauacccuggucuaugccuuugaucccaguacuuagaagcuaaggccaguuggucucugaguucaaggccagccugguuuacacagcaagucucagauagugaguuaaaaacagaaccaaaaaaccugguaccuccaacuugggaaggaaggacuaagagguguuuguuagccugaaggaggagcuggucacaguggcaugcaccuguauuccagcugggcucaguggcaugcaccuguauuccagcugggcacaggggcaugcaccuguauuccagcugggcacaggggcaugcaccuguauuccagcugggcacagaggcaugcaccuguauuccagcugguugugagacugcagcaagggugugacuggaggaugagaugaauccaggaguuugaggccagccuaggcaacacaggggggcgggggggaguccuguuuccgauaaaaaggaaagaggagaaaaggaaaaagaaaagaaaaaggaagaaaggcauagugaguuuuucuuguaagcucccuaaauuuucugauauagcaguuauauaaucagccaaagcagaggggaaccugaaauuauugugaaaaauuauuaauuuaaacgacuaugcucacuucagcacaugagguuuaaacuacuuggaagagggcuggcucccccguuaccuucacaugaacucaggaaacagagccggcagccagcuuacaugucucaguggccguggucucugucuuaacaguauauucggaaggguuccuagauacugcaaggauaacuccuaggaagguuucagauaacgaacgcacauggcauauggugggcucuaggcuuuguggcucagacagauggcuuccuccucgugagcugcucucagaggguuagcuaguccagggggccccagagcacuuccuggauuagggcucugguggcuguuugcagcaacugccagcucagggccccuguaguguucugcagagcagaugucaacggucuggauuaacuguauuuaguggcagcucuuucuuccuuugugugcagcaaaagucaggcgcuuuuuuuuuuucuucccccugaaaauugucuguguccuuuucucccuuccuccacuucugggaaugucccuucuucuuucuguugcuuuucuuucucugagucuguuucucuccuccauuucaggcucuguucugcucaccucccaaccuccucucucugccugcuacaaacaaaagcuuugugggcgggcuuaccuugcuuuggcugugcuacuguugcuggguucucagucucacccacuggccccagcuucuugaacagccuuccuguuucauugugauucccccuucug

SEQ ID NO: 2815 - RNA, 858 nt, Mus musculus
ugacuccuuuucuccuugugccucucucccacacucccuugcacugugcuugcacaccaggcugugcugguaaccuguuucuagguagguuguauaugucccuacaccaugguuaggaaggauucuugucccuuccugaaugagugcuugaguuuauuucauuucauuucaaacccguucucaagucaucauaaaauggucgguuggguuaguuagcaugaacggaucuugagaaauucuccaugucgcuugagaauuggacccuguugaauugccuccgugaacgcucagggaugguagggggcaaaaggcugucucucccugccauccggaguaggguuuuccaggaagggaaaggggaugagguucaucucuuccggccacgccauccccugucugguaccaucaucaucaaucaauuuacugauugaaaucagcucaaggggaucuuaagcaguuugcaaaacuaggaauacuggguaaguucuguguggaucggauagcuaaauuauaucuaucucgauuuggggacuucuauaagcaguuaucuuuuggacuuugugucacaagccccuucacucuccuggucccaucugcauagggcagucuccagacugugugucaagcaaccuggggaacaugaagcaccaagauucacccucgucaccccaaacaucgugggggagauuugacaccuauaaaagugaagccauaaaaaggccgcauuauaaacaaugaaaauaaaugucagcgauagggcuggggcggguggggguggggggcaugagccucuggagaaaaagaagggcagggaacgccacacaugaugacuaggaagagcuuucaguuaaaaaaaaa

SEQ ID NO: 2816 - RNA, 2664 nt, Mus musculus
ucagguacagaaaauaagcagagcauccaggauggggcuguaggucuguaguucugagcaauucaaugaccacacccuuguguucuaaugggaaccauuggagagguaacccagaagucucuucuagcccaagauagacagguacaaaccucucaguggaagugcuucugugaucguugccagguuuuugggagggguaagucuaaaaccaaaagaguuugucugaagagaccauuugggggcuguccugauuagaauauaauuuccaugucuccccagccuaggauuuaugugccagaagcuugguccccaaggugugguauugggauggugauauggaugauguuuugagagagaggaaguugcaacacuggaaacaucgccugccacggagauuaauaucguucuuguaggacccuaauuaauuccugcaaguuguuguuaaaaaauguaagccuggugccuggaucucucuuguuuccugccuuguuuggguuguuuucuuuggaagauaacuccaguguugaguaaguuagcuuaaaccuugaccuuagauggccucaagcugagcgcccaccuccacuccucccagacaccaaaccacaagucuggugaugaaaugaagcuuagcucuggugguaugggaacccccacacaugcauuguguguguucauucuaggaccacucccuaagaugcguccaauagagacuuggacuauccuguuccaguuagugugugugugugugugugugugugugugugucugugugugugucuguguguguguuugucugugugugugucugugugugucugugugugugugucugucugugucuaugugcagaguauguguccaugcaugugugugugugucugugugucuagcuggcugugucuggcuggcugugucuaugugcacaguauguguccauucgugugugugugugugugugugugugugugugugcgcgugcgugcaugugugcauauguauaugcuuguguauacguauggguguguguguguguguguguuuaugaacucaagguuauucccacauggucuucaacaggauuuccuucucccucuuagcagcuuuucccucucuaaaaacugcuaucccuccucauaacuaucuuacuuagcagcucuuuuuuuucuacauuuuuuccugucucuguuauuuacuuuuguuuuauuuccauagaaaccuagcucugaaacauaucagcaggacaaucuaauucaacacucucaucuuacagaugaggagacuaaggcccugagagcacaaucuacauuuuauuccaaugagacacagaccggugaagagaggggaugggggcgggggggggguugcucacagaaugacccagcuccugucagggcacuggcuguguuucuagaccuugacgucaauggagcuucuugggguggcaagcucucccugcaccccagagugccccagaagcccagcggugugcagaauugugaaaggcucuugguuccccaagaauaagcugucucugccucugacauuuucuucagauuuuugggucuggugaaggccagcuugcuucuuucucagcuucccagaagccuugaugucauccagaauguuuccccucgcucucaguugacccgguuccccaucguguugcauggucuuccuuuggcaagcagcccccugcuuauucagcagcaggaugucucauuuuaccucuccugggugucugaugccaccugguugucccugagcagagauucaugacaccacugcauuuggaccacccccaguggaaucuugcugcaauguuucugccuccccgggaacugggccaugacccauccacaccugcacacaaugccugccaaaacaugauguguugaggaagccaugugcagagcuuaagggcgaaggagaugugguuugggagaguacuggacauuuguagcccaggacuucucccucgcgggacaaaguaaggcagaaaaucaaguggccuuggaaccauggaauauuaaccgggaauggaaccugagagauggucuagaugaguccagugggugucagaucuaagauccaucugaaucaccuuggggugggggcuguuaaugaugcaaagccccaagcccuuccaagacacaugguggauuuacuuggauguggcaaagcucaggaaaaugacucaccugugaguccugggguucagauucauagucaucuacacauaccuccucacacaaagaugggggcuaagagugaggcugggggaaucccccacuugcuaguccucccucugccugggugauaguggcuauggcucccugcuaugcagaugggagcugauagcugcugcuacauucggccugcuuucccuuuguuuucuaggauacuuccugugugucuccuguccucacucaaugaggaggaaggagggguaccuggggugaagggaagagcauauuggcgcaggcgacgaugccacaaacuagugacuguacugauagcaagcacagcuucaaguccuucauuaacucugccauucccgagacacaacauccccucaaagucuauugaugaagagccaucagccaucugucagcccauuaaauguguguccaguccuccaccuaauaaaacaccccacaaacaucu

SEQ ID NO: 2817 - RNA, 559 nt, Mus musculus
ugacguaacaagagggcuggaaagcacagacguggaaacccgggaagauuucagagcaaggagaccaggaagacaacagagaacucggcuagaauguagacguggugggacaagggagaugcgcaaagaggaucucaccggaagugaaccuaugcagcagugacgucaucgaaugccuaccaggccacgccaacuguggucaggccacugugcuguaagacagcagaaugugccccuucuguucuggcgauuucuaucaaucuccucccuucccggauucucgucagccucuagcaacaauuauuccaccuucaaguaaauucucacaacuucuacauuagagcauguguauuauguuugucuuugcgccuggaagauaggcgcgaacacacacaccaagcgugaggagacgugaagggcagggaaauucaaaugauccuugcuuugacugguacuccacggacuccucacaccgaccccuauugaugggaacaaucaacacaugucagacguaaaacuaaggcugacaaaaaggguauuaaaggacuugcuugugaag

SEQ ID NO: 2818 - RNA, 47747 nt, Mus musculus
cgggcuuuucgcgggagcgggagccgugaggcguugccgucagucagcuaccgcugcgggagcggagcgggucggugcggccggguguggcgggcgugcgcuccggggucgugaggccgugagggacgcgccugacaccccggaggagccagucgaccuccuucacggccacccggagcagcugccccggugcagcccgcggcguccucccagagggauccggcgcguccagaguccgcgguagcugccccguucugcagucgccggauuaccuaacgugugugucucggcucccugauuagucaaugugaauaauucuaaauaacguuagguuugucuugucauugacucccaccauagccacuuucgggugcugugauguaucuaguagccacuugguuggaagcacaguuauaaacuguccccaucuucaugauaaguucugcucuugucccaaaagauaggccugagguaggauaagcuuccaagcgauucugguuuuaccugucacaagaaaccaggcuugugcagugucuguuauuuucucuuuugcagacuuccuuaccgagcaucggagaaauacuguagagaaaaugcccguugaauacaaaaggagaccaacuuuuugggaaauuuuuaaggcgagaugcagcacagcagguauugaggaauuuuauaaaaccugguaaauuaagucccauuaaaaaaauauuuucaauaaaauaagucaaggugaaugcuugcuuuaaaaacaaacaaaaaccccagcaccugggagacagaggcagguggacuucucugaguuugaggccagccuagucuaaagagagagauaaagggcuuuauagagagccucugucucagaaaaacaaacaaaaaauuacuugagcuagguuauaauccuauggaagcugaggcagaaaacugagccagguggauuaaaugaguucaaggccaacuugggcuacauagggaauuccuggaugucaggagcaacagagcuuagaccuaauuaaaaacaaaacacaaaagagggaugaaagugacccuggucucugcauuuguuccucagcaucaauuuagcaggcauuagcugauuccuguaaucucaccuuugggagguagaggcaggaggaucaggaguugaaggugauuugugcuguaaacaggucguggagucagauccaguuaacauaaucuuuuccuggucaaucagaugauguagaauaccuaaacugauggggaacuaacucuuugacuuccaguggaaagaacuguuuugaaagggcuacgagcaaaucagaagcauuggugaugcuagugaugaacacuuuucaaaccuuuuaugacuuauuuuguuuugagcuguaugaguguguuuguguauuugcucugugugugucggugccuacagaagucagaagaggacaucagguccccuggagcuggaguugcagguugguugugggcugugauguagaugcuagacugaguuugggucuucugcaagagcuucuuaacccaagagcuucuuaaccacugagucauuucuccaacccuagcuuucucuguuaaaugacaucgucuugcuccguaaccaugacugauuuacgauuugcuauguagaucaggcugguuucaaacuugcagugaccuuccugagugcugggauugcagugugaacagccacaccaggcucugaauuagauaucauaaauaaauauugacagugcaugaaaaagaucacauccauuaauauuacaacugaucugauaaguuuuugaagucuggaagaagucagcuacuguuaguucucuagaaauuguuaauuucauuuugaaagcucacaucucaucauuagcaacacacuuuugucuuuacuauaaaagcccacuucauucuagagaaaaugccugccaaacuucugucugcaaaaaugcuacaugcauuuuguuucucagaaaggauuaaaaaggcaggcuaaggaauuaaagcuuggucccaucgguggcuuagugggugaaagugugugcuacauaggucugaugaccaguuucuaagccagaagcaacaugaagguagacucuugauuccaugugcacacaucagauacacggcaaugagaagguuggagcaugagcuucauacuguuccuuuuacguuguuagugagucccuggcauucuccuguggauugcuaggcaauguuaagugcuagugcaguuggguccacugccuucugucauguaggugcaccagguguuuacauaccucauuccuuguuguacagauguugacauugugaaaaggacaaagaacaccaugcucuaauuaugaaaauauauugaaccccccuaugccguggguaacagcuauauagggugguuggguccuguuugacauuuuguuguugccauguaagaaucuuucucauguuuauuugaaacucuggcccauauucaaagauuugucauagugauggaguuuucauaaucauuucaguuuuaucuaugaaguacaugcuugcugugaguaguuuggguuuuuuuuuuuuuuaacuuugaaucaugaguauuauuaagaagguuagaaacauaauauaccuaaacucuuaucuccuuguaaguuuuguaaaauuauacaaacguuagugcacuuucaaaagauuaaacuaauaaucuuguuuaauaaaccuuuaauuacuggucacaauuuuuuuuaaggauuuauuuauuauacauaagcacacuguagcugucuucagauacaccagaagagggcaucagaucucauuacagaugacugugagccaccaugugguugcugggaauagaacucaggaccucuggaagagcaaucggugcucuuaacccuugagccaucucuccagcccccacuggucacaauucuuauuuguuuuuuguuuuuucucuucucuuucucuuuguuuuauucauuugugucuuuuguuuuguuuuguuuucuguauuuaauuuaguaugcacuagauuauggagucuuuuguuuuguucuuaguuuuuugguccucuuugagacaggguuucucugcauaucccuggccauucuggaauuugcucuguagaccaggcuggcauuuaauucagagaucugucugccucuuccuggcuucccuccauugcucccuugcucucucccucuccuucuuccucuuucuuucccuccuucucuguccuucccucucucuccccugcuccccccaccccuuucuugauuaguuuucaagauagggucucauuauauaggcaagcuagccuggaacuuauauaauccuucuguaugcucccagaugcuagaauuauacauuguaaugucauacccaagugagaaaugguguuuuguuuuaugguuuugguuuuuguuuuuuuuaagauuuauuuauuauuauaucuaaguacacuguagcagucuuuagaugcaccagaagagggcaucagaucucauuauggaugguugugacccaccaugugguugcugggauuugaacuuaggaccuucagaagagcaguuggugcucuuaaccacugagccaucucuccagcccgaagagauauuuuuguagaccucaagcgugagguuuuccugccccaacccucaagugcuagaauuacaguuguauaccaccaugcccacuuggucaacauuucaaguuccuuuuguuuaguauuaguuuguuuuauuguuuacgucuugauuuauuucgugauagggacaggguggugggucaguuagaggacaaccugcaagagucuuccaccauguggauucuacucaugaccugaggucaucaacuuugaugguaagcaccuuuaccugccaagccaucuugcuacaguguuuuguguucugagaugaagaucucaauguguugccuguaagaucuucaaaauuguaguccuagcagggcggugguggcgcacgccuuuaauuccagcacuugggaggcagaggcaggcggauuucugaguucgaggccagccuggucuacaaagugaguuccaggacagccagggcuacacagagaaacccugucucaaaacaacaacaacaacaacaaaauuguaguccuccugucucagaccuacugaaagcuggaacaacaggugaauacaacugugccucuccuuuauucuucacugugaucuuugaagcuuuuugcauuuauugauuuuacaugugugcguacacauauccccugugaugguuuguauuauccuugggccagggaguggcaccaucugaagguguggccuuguuggaauaggugugaccuaguuggaaugggugugucacuguggguguggguauaagauccucacccuaguugccuggaagucagucuucacuggcagccuuuggaugaagacauagaacucucagcucugccugcaccaugccugccuggauacugccaugcucccaccuugaugauaauggacugaaccucugaaccuguaagccagccccaauuaaauguuguuuuuauaagacuugccuuggucguggugucuguucacagcaguaaaacccugacuaagacagaaguugguacugagagugguguauugcugugauaggccugacuaugcuuuuauuugaaagaauguggauuuugggacuuuggauuuggaaagcaguggaaugcuuuaaauggggcuuaaugggucauccuaguaggaauauggaagacuuuguugcugggagugauuugaacuguguugaccuggcccaagagauuucaaaggagaaaaauuucagaauguggcauaaagacugguuuugugguauuuuggugaagaauguggcuacuuuuugcccuugucugaaaaguuugccugagacuaaggugaagaaacuuggauuaauugcauugacaaaagaaguuucaaaaaagcccagcagagacuuuguucucugguuaagucuuaugaagagaaguuugaacaagcauagcaagcuuagaaaggaaaaauauaaaauauaugguucgaguauuaaagggguaccaggaagugaaauggagcaaaaucuuguguucuaggagauaaaagauuaagggagugggaccuugggacaagauucuacccagcuuaauuagauccaggcauggugguacacaccuuuaacccaugagacaagcaugcugaucucugcauucaaggucaaucuacagagcaagaaccaggauagccaagcuuaggcagugaaggauuuagaauaauguacuaguacaaggggauuauguucuaguuccuguaagcagcagaacuuggcagcuucagccauguggcucuggcucuagaguuaagaauggaaggaacuacugggaaaauugaugcugguuagcuggagcuaaggaauuagcggugauuaagaagagaccagcaucguugagguaaaaucuucuggaaauuguuuucugggagcacaaagaagcuguguuccagagauacccaaggcuguaccucaugcuguggcuggacuugguaaugugucugcuugugaaagaaugaagggaucauggagagaagcugaggcuuagcacugugagaggccagggaaggccauuggagaaggugaagccucagcuguaguugauggcccaggacugaaggggucaagcaaaggauuugaggcuuggcacccugaagagagccuaugagaggcuguuggugaagccuagugggaguggaauaccccaguguauuggagaugucaguaccauggagugaucaccaagaacugcaacuguaguggaguggaucaaccuuagaaugcuacagagggcagagcuggaaaagugaugccagcccuuaggaggaguccaaaagaugaaguggaaucccggacacugaaacaagaagcuguaacauugaaauugccuuggagacucaaagauguuaaagaugccagagccaugggauacaugcugaggaaagcugcuaacagggaguggaaccagcccaggagaaagcaguuuguugcagucaacaaaguugaaaaaggaguggagaucugaagaccgcuuugacaucagccauggagaugcagaguuuggaguuugcccagcugguuuccugccuugcuuuggggauuacaguuaauuaaguugaaugaaucucaaaaaagaccuugaacuuuggacuuuuaacauuguugcaacugcaauagacuaugaggacuuugaaaguuggacuagaugcauuuugcauuaugcuauguuuaaguauggcccccauagacucauguuuuugaacaagucuauggggaccagggaguggaaugugaugguuuguauuauccuuggaccagggaguggcaccaucugaagguguggccuuguuggaauaggugugaccuaguuggaaugggugugucacuguggguguggguauaagauccucacccuaguugccuggaagucagucuuccacuggcagccuuugggugaagacauagaauucucagcuccuccugcgccaugccugccuggauacugccaugcucccaccuugaugauaauggacugaaccucugaaccuguaagccagccccaauuaaauguuguuuuuauaagacuugccuuggucguggugucuguucacagcaguaaaacccugacuaauacacccccaugacacaauaaugagaaaacaacuucugaguguguguuucagucuaacucagguugucaggcacagcauggagggagucaccuuuggcaacccuguucuuuauaaugaucuucauuguucacgaguuucuccgugucauucauuaaaacuaagaugagguuuuugucuuuuuugcagauuuaggaccgauaagccucaauugguuugaggagcuuuccucagaagcccccccauacaauucugaaccuccggaggaaucugaguauaagccccacgguuaugaaccacagcuguuuaaaacaccacagaggaauccccccuaccaucaguuugcuucaacuccaauaauguucaaagaacgaagucaaacucuaccacuggaccagucgccuuucagagaauuagguaacuagcuaggugugguggcacaugccuuuaauccuagcacuagagaggcagaaacaggugggucucucugaguuugaggccagucugcuuuacuuaucaaguucgagacagccagagcuacauacuggagagaugcuuucucaaaaaagaaaaaaaaagcaaagaguucaccauagauuuaacuuggguaaaucauguuaugugaugaaggguacaugaacugggacuuugggcaaaguauauaaaaucagcucugugaugaacugaguucuauugugcaaauccgucuuccucaucucuuuccugacugaaggauggagauaguggaaauacugugugauaagcuuugguucagugaaauaauuuagguauuuaauaaaugccucuucuuucuuccuaugcuuaacauaucagcaacaaagauuuucuaaauuaugacuuugauauucaaaaugacucgucuugauguuuacuaagcuguauuucuucaagucauuauaggguggagauuuuuuuguaaucaauuucuuguauuuuaauuugauaucaguuucucugaccuaugugccagguguuuauaaacacuuguuuaguaaaguugugcguucacucagucucuguaacauuuauuacuuucuugacauguaugcccuuuucuuuagaguacugcuuugugauaugcucagugaacaugucaggcauuguaauugcuguggauguagucagaagacaguaucuuuacugguugaugguggugcauugauccuagcauucaggaagcagaggcagguggaucucuaugaguucaaggcuagcccagucuacauagcaaguuucaguauagccagggcuacauagagagauucugucucaagaaaggcguguacagggaaacaaacaucuuguccacaguucugcagguuuagcaguguucguucagagaagccagaugguaggguuacaaccaaggguggaaugcaaaaggauagcaucauaacagucaagucaaaugaggccaucugcuuaccaguguaguuugguagcgugcauguucaucauugaaaagcccuaguuuuuguguccaacaccaaggaggaagaaaggaggcaggggagguugcagucacgaagccuugcuuucccaguuguauucaggagucuaaaacugaaugguugaaagcuuuucacagaaggauggucagguuggacuaggugucuuccgugaugucauauauggggugcacaccaucccuugagaugaguuucuauagcaggccccagcaccuuuuuuuucuguucuuaaguucaaaaaguaaaagcucaaaauguacagugucugcacccucacuggauuauuuuacuguuucagggaagguuguugcaaguaguaaacauaaaacucacagcaaaaagaagaccaaaguggacccugugguagauguugcuaguccgccucugaaaucuugucucagugaaagguaugaugagacugauguauauuuuauaagugcauaagacauguucuauauguuuguuuuuagggccuggucucacugcaguccaggcuggcuuugcacucagaauccucuagccuuagccucucacagggcuggggauucagucaugaaccgucaucuugcauaucuguuauuaaaauguauuuaaauaaaacauuuucuugcauguguuuauuucacagaaauaagcugucaugcagauuguuuuggccacguaccuucuggaagaacuccuauuuuuaaacaaaaaguaauagauuccuuaauuuaguaauuuuuauguuagaaacuuugaaccaggucugguaacucacuccugaaauccuagcgcaguaugaagccagcccaggcuaacuuagcaagcccuugucuccaaaaccauaaaaccaguacgcuucggugcucauugaucuccuuguugcugcuguuacccuuuuaacccaaggccacuguuucauuuugucuagcccucuuacucugcggugcacacaggcaguacuacaacgagaaaagccagguaugagcacagcaaauguucuuauuuuuguugucuuuugagaccuuauuuacaucuaauuuguacuaugaauguguugccaauguguauguguguacacuaugugcaugccuugguguccagaggccagaaaugagauccccugaaacuggaguuucgggugguugugagcugccuguauuagguucuaggaacacaggccuuuugcaaaagcagccagugcuguuaagugcugagccaugucgucagcccuauuuuuuuauuuguaggucuuagaaauguuaauaaagaucuaauaauuuucuaucuuuucacccacagugguaucuggaaguuuauuuuauacaccaaaacucaaggagguaaauguucugcuuugguaacuuaagguauaucaguugagaaugggacaguguguauuaucccuuugacuugagaaucaagaucauuacuuagcaaacuguuucccagaggcauuaaguaagugauaaaugaaaaugugaaugaaaaguuaaucgucaguguuucuguaaaauaacgaccgucuuucuuuguagggucagacaccaaaaccuauuucugagagucugggaguugaaguggauccugauaugucuuggacaagcucauuagcuacaccaccaacccuuaguuccacugugcucauagguaauagugacaaacguguacuggacaagaagagccagaggaggcugcuaaguugucaucuccagucuuauguuagaaagaaaauguggaagggcuggagggauugcucagugguuagagcacuggcugcucuuagaguauccugguucaguucucagcacccaugugguggcucacaacuguccauagcuccaguuccaggggaacuggugucuucuucuagccucuauagacuccugcaugcaugugauguacauacauauuuguagacaaaacacccauauacagaaaauaaaaguaaaggcuaaacauguaagugaacaugaaaacacauauuacugugcgauaaguguuuguagaacaauuuuuuguggguuuuuuggguuuuuuuguuuuuuguuuuuuuguuuuuuuguuacuuuuuucgagacaggguuucucuguguauuccuggcuguccuggagcucacucuguagaccaggcuggccuugaacucagaaauccgccugccucugccuccuaaguguugggauuaaaggugugugccaccaccaccuggcaauuuuuuauguuuuauuuaaaaugcaaucaaagggucacauauuuuaguagucugucaucuauauaugauaacaucauacacauuuauccacaauauauagccauguuacguaugugugcuuauucauaagauacguguaugacugugguaauccuuaaauuaugaguuuauauucaaaccauaauuuuuuuaguauuucagguuuguuuguuuuguuuuuuauucugcaugugugcaaguaugcccaugugcaggugccacagcauuaguguggaggucagaggacaauuaacaggguugguucuuuuauuccaccaugugcaauccagggauccagcuuaggguaucagacuuggcagcuagcgccuuuaccuucuaagccaucuugccagcccucaaacuagggcuugaugauuccugccaaauaacuuuaguuuugauccauuuagcuagaagugacuggacuuucuuuuguuguuguuuucuaaaagaauuauuuauuuauuuauuuaauguauaugauuaugcugccacugucuucagacacacuagaagagggcaucagaucccauuacagaugguugugagcugggaauugaacucaggaucucuggaagagcagucagugcuucuaacugcugagccaucuuucuagccucuuuuuguuguuuauaugaaauaauaaaauaaaagggcugaaggauaagaagugauuagcauuaauuaugccuuccaucuguaucauugucuuaacagaggcuaaaggcucccaaggagccuuugaagacauaacuuuacagaucuuucaucugcccuuguagagaacauaaagcuaguaucaccaaaccacauuaagaaacagugugacagacuggagagauggcuuagagguuuuaaacacacuggcugcccuucugaagguccugaguucaaaucccagcaaccacaugguggcucacaaucauccacaaugagauccaaugcccucuucuggugcucuuucuggugaaagcagcuugugagcuguuauaaauaaauaaguugccgggcaugguggcacacgccuuuaaucccagcacucggggagguggggggggggggcagaggcaggcgaauuucugaguucgaggccagccuuguuuacaaagugaguuccaggacagccagagcuacacagagaaacccugucucaaaaaacccaaaaaauacauaaauaaauaagccuauuuuaaaaaaaaacaacaggggugcuggugagauggcucaguggguaagaucacccgacugcucuuccgaagguccagaguucaaaucccagcaaccacaugguggcucacaaccaucuguaaugagaucugacucccucuucuggugugucugaagacagcuacaauguacuuacauauaauaaauaaauaaaucuuuaaaaaaaaacaaacaaaaaaaaacaacaguaugacaaguuagaccauguugguguuucucguugcuggcuuuggucacacuuucagauguguguguguguguguguguguguguugggggggguuccugaagaaguauguuuguguauuaauuuuaguguauaauauauaauccacuacagcuaaauuuaauuguuuuacagcccgagaugaagaagcacgcagcucuguaacgccugcugacucucccgcuguaagucagugucaggcugguguacucuccguacuacucacucugaaugccuucacuugauuuuguuuuguuaguggugcuuaugcuuuguaaaaaauauuuuuuuaauucucugagguggccacucauguauguaauauauuuugaucauauucacccucucuuccuccucuaacuucccccgugauccuucccaacaugaccuacucucaacuucacguauuuuguucuuuuuaaaaugauccccugaauccacuuagcgcuccuuggugcauauggguguggggcacuggagaauagggcagcugacuaguggccauaccuuccccccaggugacucucccuuccucaguagcuggaacucacucuguagaccaggcuggccucgaacucagaaauccgccugccucugccucccaagugcugggacuaaaggcgugcgccaccacgcccggcucuguuuuuuacuuuuuuugggauggguuugcuaugcaguccuaacuaacuagccugaaagucguguaaaccauuuuggucucaaacuugggauggucauccugcuuuugcuucccaagcaguaggauuauaugugugugucacugugccccagcuagccugaauuuuuaaacugcaauuuauaauuuuccuaaguguuuggagauguuucuuaacaugauccuguaugcaauuucuuccuauaaaauuuuuucugucuuucuauuugguaacacguacguaucuauguguguaaugaaagaguuauacuaauuaaugauuuugaucacaauuucugcagacuuugaaaagcuguuuuucuaaccacaaugaaaguccacaaaaaaaugauagaucuguucccucagugauugacagugaaaacaaaaaccagcaagaagcuuuuagucaggguaaguaugucuguuuaguugagcuacucaucugaacugaugacacuguccuuuucuuagggagaaauacauugcuuuucuuuuucucaaccuuugaaauauagaagauagaaacuaacuagauagauuuguuuuucauaauuguaauacagaauuuauuaacucgcuacacugggguugauaguuuuuagaauacuagauugaguacauagcacuauuaaaggugacccucaauuguauagaacaggaaaaauaaugaguuauuuaagauuaggguaugaaaaaagacuuugaauacauugggauccgauuuuaggagaagagugacuugcugaaagaacuggcauucagaauaaccucuuacugcugaccuguguauuauuuaaugugagcaauuucugaaaagaauugugagaauaauaggaagaauaugguugcauuguaaauauuauaaugugcuuuuguuuugaauuuuaacagguuuggggaaaauguuaggagauucaucuggcaaaagaaauagcuucaaagacugccuuagaaagccaauaccaaauauucuagaagauggggagacagcuguugauacuuccgaagaagauaguuucucauuauguuuuccuaagcguagaaccagaaaucuacagaaaaugagaaugggcaagacaaggaaaaaaauuuucagugaaacaagaacugaugaauuaagcgaagaagcuagaagacaaacugaugauaaaaacucauuuguauuugaaauggaacuaagagagagugauccuuuagauccagguguaacaagccagaagcccuuuuacagccagaaugaggaaaucugcaaugaagcuguacaguguucagauaguagauggucucagucaaaccuuucuggucuaaaugaaacccagacaggaaaaauaaccuuaccucauauuucuucucauagccaaaauauuucagaagacuucauagauaugaagaaagaagguacuggcucuauuacuucagaaaaaucuuuaccucauauuucuagucuuccagaaccggaaaagauguucagugaggagacugugguagauaaggaacaugaaggacagcauuuugaaucacuugaagacuccauugcagggaagcaaauggugucuagaacaagucaagcagccugucuuucuccgaguaucaggaagucuauauucaagaugagagagccacuugacgagacuuuggguacuguuuucucagauaguaugaccaacucaaccuuuacagaagaacaugaagccucugcauguggauugggaauacuuacugcaugcucacagagagaggauucuauauguccuaguucaguugacacuggaagcuggccaaccacucucacugacacuucugccacugugaaaaaugcagguuugauauccacucuaaaaaauaaaaaaagaaaguuuauuuacucuguaagugaugaugcaucucuucaaggaaaaaaacuacagacacacagacaguuagagcuuacuaaucuuucagcccagcuugaagcaagugcuuuugaaguaccauugaccuuuacaaauguaaauucagguauuauucuuuuuuucuucuaauguauauagucuuuaggaugagauuaaguuuuccuauuugaauauaaguuuuuuguuuuuugaauuuuaagagaaacacuugcuuacuuucuguaguuuuucagaucucuuuuugguuugguuugguuugguuugguuugguuugguuuggugagaacccuguguagcccuggcugucuuagaacuuaggcuggccuggaacuuagauauccgccugccucugcccccucagugcuuggauuaaauccgugggccaccucugccugauucuaggaaucauuuaaucucagagaguaccuauauagauuauugucgagauuuuggauuuggucuuucgaauuaugucauucaaacuuauuggggcaguuggcaccauauauuguugggucuuuguuuuuuguuuuuguagcauuuauugugcauaugugugugggcauaugcaugacacaugauguauguguggagcucaguggauuacuugucugagucaguuuuccuuuuucaccauguggaucuucagguccucaggcuuaauggcaagugcauuuauacccuaagccaccauaccaucguccccucuuuguauccuaugcugguuuuuaacuuagccuugagugaucauccugcuuuaaucucccaaguaguuggaaccacagauuuaccacugugucuugcucuauggcuccuaagacagcuuuuuauccaaacacguuaggaauuugacugcuuagcuccugcuuuaaaguauuuauuauguacaaauuacauagcuaaaaaugguguuuacuuggaaagcugaagcaggaggauuauuugagucuaggaauucaaggccagccuggggaacauaagagagacuuguuguuucuguuccauuccucaucuccauggugugaaaucaguuuugucucccugugagaaauuguaaauagcauggugaauagguugaugguauugguacuagauuaccaaagaguuguuugagcuccagagaccuuggaguuuauagauacuuaugcuacaucuagcauuuuauguggaugcugggggccuggauucaugucuguaugacaggcacuucacugacuaagcuagcuagcucuuuaggcucuucauguagaaauuuaguaacuucaaaauugcaauuguucaaggauuuguuuuaaaucucuaagucacccuuugcucuucuuguacuucuuuuuuuguuuguuuguuuggguuuuuuguuguuuuuuuguuuuuguuuuuuugagacaggguuucuguguauagcccuggcuguccuggaacucacucuguagaucagacuggccucgaacucacagagauccgccugcuucugccucccaagugcugggagcgccaccaccgcccagcuuucuucuuguacuucuuauuuuaaacacuauaacuugggaaaagcacugaguggaugcaauuaaucguacucuaacuuguccuaucacucuguuuucuuaugcauagguauaccagauucuucugacaaaaaacgcuguuuaccgaaugauccugaagagccauccuugaccaacucuuuugggacugcuaccaguaaagaaauuaguuauauucaugcauugauaucucaggaucuuaaugacaaagaagcaauagucauugaagaaaaaccacagccauauacagcccgagaagcugacuuucuguuaugcuugccagaaagaacaugugaaaaugaccaaaaaaguccaaaaguuuccaauggaaaagaaaaagucuuaguuucagcaugucuuccuucagcagugcaacucagcagcauuagcuuugaaucacaggaaaacccucuuggugaccacaacggaacaaguacucuuaaauuaacucccagcucaaagcuaccucugucaaaggcagacaugguuucuagagagaaaauguguaaaaugccagagaaacugcaaugugagaguuguaaaguuaauauugaacuaaguaaaaacaucuuggagguaaaugaaauauguaucuuaagugaaaauucuaaaacuccugggcuucugccaccuggugaaaauauaauagaaguggccucuucaaugaagucacaguucaaucaaaaugcaaaaauagucauacagaaggaccaaaaaggcucaccuuuuauuucagaaguagcagucaauaugaacucugaagaacuuuucccagacagugggaauaauuuugcuuuucaaguaacuaauaaaugcaauaagccugauuuaggaaguucaguggaacuccaggaagaagaccucagccacacacaagggccuagucucaagaacucucccauggcaguagaugaagauguagaugaugcgcaugcagcccaaguguugauuacaaaggacucagauucauuagcugugguccaugauuauacagagaagagcagaaauaauauagagcagcaccagaaaggaaccgaagacaaagauuucaagucaaauuccuccuugaauaugaaaucagaugggaacagugauuguucagacaaauggucagaguucuuggauccagucuugaaccauaauuuuggagguagcuucagaacagcuuccaauaaagaaauaaaacuuucagagcauaaugucaagaaaaguaaaauguucuucaaagauauugaagaacaguauccuacuagguuagcuuguauugacauuguuaauacccuuccauuagcaaaccagaagaaacuaagugaaccucauauauuugauuugaaaucaguuacuacuguaucuacacagucucacaaucaaucaucuguuucucaugaagauacugacacagcaccucagauguuaucuucaaagcaagauuuucauucaaauaauuuaacgaccagccaaaaagcagaaauuacagaacugucuacuauuuuggaagaaucaggaagucaguuugaauucacacaguucagaaagccaagccacauagcacagaauacaucugaagugccuggaaaccagaugguuguuuuaaguaccgcuucuaaggaguggaaagauacugaucuucaccucccaguggaucccucuguaggucagacagaucacagcaagcaauuugaagguucggcuggaguuaaacaaagcuuuccucaccuguuagaagacacuuguaacaaaaauacaucuuguuuuuuaccaaauauaaaugaaauggaguuuggaggauuuuguucugcucuuggcacaaaacuuagugugucuaaugaggcucugagaaaagcuaugaaacuguucagugacauugaaaauagugaggagccuucugcaaaaguaggaccaagaggauucucuucaagugcacaccaugauucuguugcuucaguguuuaagauaaagaaacaaaacacugaaaaaaguuuugaugaaaaaucuaguaagugccaaguaacauuacaaaauaauauugaaaugacuaccuguauuuuuguuggcagaaauccugaaaaauacauaaagaauacaaaacaugaagauagcuauacuagcucucaaagaaauaauuuagaaaacucugaugguaguaugucaaguacaaguggcccaguuuauauucauaaaggugacagugauuuaccugccgaucaaggcaguaaguguccugagucauguacccaauaugcgagagaggaaaacacacaaauuaaggaaaauauaucagauuuaacauguuuggaaauuaugaaagcugaggaaacauguaugaaaucuucagauaaaaaacaauuaccuucagauaagauggaacaaaauauaaaagaguuuaauauauccuuucagacugcaagugggaaaaauaccagagucuccaaagagucauuaaauaaaagugugaauauuuuuaaucgggaaacagaugaauugacugucauuucagauucuuugaauucuaaaauucuccauggcauaaauaaggacaaaaugcauacuucaugucacaagaaagcaaucaguauuaaaaagguauuugaagaccauuucccaauuguaacugucagucaauuaccagcucagcagcauccugaauaugaaauagaaaguaccaaagaaccuacucuguugaguuuucauacagcuagugggaaaaaagucaaaauuaugcaggaaucuuuggacaaagugaaaaaccuuuuugaugagacacaauauguuaggaaaacugccaguuuuagucaaggaucaaaaccccugaaggacaguaaaaaagaacuuacauuagcauaugagaaaauugaaguaacugccucaaaaugugaagaaaugcagaacuuugucucuaaggagacugaaaugcuaccucagcaaaauuaucauauguauaggcaaacugaaaaucucaaaacaucaaaugguaccucuuccaaaguacaagaaaacauagaaaauaauguagaaaagaauccuagaauuugcuguauuugucaguccucuuacccagucacugaagauucugcuuuggcauauuauacggaggacaguaggaaaacuugugucagagagucuucucuauccaaaggcagaaaauggcuuagagaacagggugauaagcuuggaacaagaaauacuaucaaaauugaguguguaaaggaacacacagaagauuuugcaggaaaugccucauaugaacauaguuuggucauuaucagaacugaaauugauacaaaucaugucucugaaaaccaagugucaacccuccuuagugacccuaaugugugucauagcuaucuaucccagucuaguuuuugucauugugaugacaugcauaaugauucaggauauuucuuaaaaaauaaaauugauucugacguuccgccagacaugaagaaugcugaaggcaauaccauuucccccagaguaucugcuacaaaagaaagaaaucuacacccacaaacuauaaaugaauauuguguucagaaacuggagacuaauacuucaccacaugcaaauaaagauguagccauugacccaucucugcuggauucaaggaauuguaagguaggcucacucguguuuauuacagcucauucacaagaaacugaaagaacaaaagagauagucacagauaacuguuauaaaauaguugagcaaaacagacagaguaaaccagacacuugccagacaagcugucauaaaguauuggaugauucaaaggauuuuauauguccuagcucuucaggugaugucugcauaaacucacguaaggauaguuuuuguccucauaaugaacaaauuuuacaacauaaccaaaguaugucuggacugaagaaagcugcaacaccaccuguugguuuggaaacuugggauacaaguaaaucuauaagagaaccuccccaggcagcccauccuucacgcacuuaugggauuuuuagcacagcaaguggaaaagcuauacaaguaucagaugcuucauuagaaaaggcaaggcaaguguuuucugagauggauggugaugcuaaacaguuaucuuccauggugucacuggaagguaaugaaaaaccacaucacucugugaaaagagaaaacucuguggugcauagcacccaggguguauugucacucccaaaaccccucccaggcaaugucaauucaucuguauucucuggauuuagcacugcagguggaaaacuggucacaguuucagaaagugccuuacacaaaguuaaaggaauguuagaggaguuugauuugaucagaacugaacauacucuccagcauucaccuauaccugaagacguaucaaaaauacuuccucaaccuugugcugaaaucagaaccccagaauacccuguaaacucaaaauugcagaaaaccuacaaugauaaauccagcuuaccaaguaauuauaaagaaagugguucuucgggcaauacucaaucuauugaaguuucucuccaacucucucagauggagagaaaccaagacacacaguugguauuaggaacaaaaguaucccauaguaaggcuaaucuuuugggaaaagaacaaacuuuaccccaaaacauaaaaguaaaaacugaugaaaugaaaacauuuucugauguuccugugaaaacaaauguaggagaguauuacuccaaagagucagagaacuauuuugaaacagaagcaguggagagugccaaagcuuuuauggaagaugaugagcugacagauucugaacagacucaugccaaaugcucacuguuuacaugcccccaaaaugagacuuuguuuaauucgagaacuaggaaaagaggaggagugacuguugacgcaguugguaaggauuuacuuuugcuuuggucuacuggucucucucaagugauucauccucaguagucuuguagguuacuaguauuaguguuaaaaacuaauuuucccccccuguggaguuuagaagacagugauuuagaacuugauaucuguaagucuguaccaacaagucauauuuuaaggaucuuuaguguauuuuuaguugauguugugaaauuaugcuaagaaguuuuauuuucaacaaagcuaguaaaauguuaauauuucccauguguguaaagaaguucuaauucuggcaguuagaagcugguuucuaguauagccccaugacuuaauuaguacuguauaugacuuaguuacuuaguuacuguacucaucauuuguugccucacuucucugagccuguucccauauccauaauguauaguuaaugccucucacaagguaauuauagauaaaauguuuaguacuaucaggcauuauauuugauaguuguaaucccagcauucaagaaccuaaggcagaaggauugcuaaguucaaggcagccugguuuaaauaucaugacccugucuccaaaaaauccaucaauuaauugauuacauauuuaaaaucacaaaauuuaaaauaaguuacucaacauugaaccugacauguuacugaccuaggcagagaaccuaguuuuugcuugcuuccuucacaaauauucuaaacacaguuuaauacuaaauaauguccuacucuuuuucagaauucuuuauauauauggaugauuuuccugcaugucugucccuauacuguguacaugccuuguauccaacaaaagagcauauuggauacucuaggacaaguguuacaaagaguagcaagcugccacauggauucugagaacaaccuaguuccucucggagaauaucagugcucuuaauacuauuggacuauauucuuauuucucauuuaaauguguaaugacuuagugaaacuauuagguuaauaaucuacagugagcauguuuugguaguguuucaggcuagaaagaaucuuuauugaaucaguugacauuggcaaucaugaucaauuucaaaacuaauauuccaacccucgugugggugauuuaaaagauauuggcucuauuuacaagcuuguggacucagaguaucggaauaauuauauaucuucuugucuagccuuaccauauaguggagugaggccuggaaguaguuuauuaucagccauccugccagaaacagauuuacuucaucaaauauuauacaggucauauucuauaugagcaaauuuaacuguguaauacuuaucugugggguuuuguuuuguuucauugcuuaccauguauaagucaguacuuuaguuauaaagggggaaaucuagucuuuuauaaggcgaaacugauacaaccacaaauauguauggaacuuucuuuuuaggacaacccccaaucaaaagaagcuuauuaaaugaauuugacaggauaauagaaaguaaaggaaaauccuuaacaccuucaaaaagcacuccagaugguaauuuguuuuuauucauaguuuuucucugaacaaguacucugcauguuauucuuacacuuuccucccuugguucauuucuguguacagaaugguuuaauuguuaaacuuuugguguauuuagaauguggaugguucauccaugaugccuacuagggcacugacaaagcuguaauugcuaauguaagaugcauuugaaauagugacuauagacuuaaugaaagugguaaaugaccugcaccauuuuaucaaagucacaugaucgaugcuaccaaaugagguguacauuucucagucaugauuugacucuauccuucaacuuacuacauauagaugaugccuugccucuuaguccauugcagucuuuugaguuuccuauuacuuuuuuuaaugcuuguuuguuugucuaucugcuuuucuuuucuuuuugguuuuuuuuguuggugguggugguggugguuuuuuuuuuuuuuuuuuuuuuuuugguuuuuuggguuuuuuuuuuuuuuuagauuuuuauuuauuuauuauauguaagugcacuguagcugucuucagaucucauuacaggugguuauaagccacuaugugguugcugggauuugaacucaggaccuuuggaagagcagucaaugcucuuaacugcugagccaucucaccagcccuuuuuuuggguuuuuuguuuguuuguuuguuuguuuguuuguuuguuuguuuuuguuuuuuggagacaggguuucucuguauagcccuggcuguccuggaacucacuuuguagaccaggcuggccucgaacucagaaaucugccugccucugccuccugagugcugggguuaaaggcgugugccaccacgccuggcuaugucugucugcuuuucaagacaaggugucucuauguagcccuugcuucauggaacucauuuuguagaccaggcugaccuggaacucacaaagauccaccugccucugccucccaguuacugggauuaaaguugugugccacuacuaucuggcuuaaauuuuuguauuuaaaauaaaacaaacuaacaaacaaacaaaacuauuuaguauccauauauaugacuucagugaggaggagcccagggccaucaggucccuagaaguauaguaacauucagcuguguguugggaauucaugugcaagagcagucacuuccuaugagccaucuccccagcuccaaguugacaaacuuuauuacccaacauuuaaccaccuuugucacugauagacuuuuuagacugaaaagccuuaaauauuaaaaaauauacagaccagacacaaacuucuuuaaauucuaauuuuuacuuaaaagcuaaauuuuaccucaggcaaaaauaauuuuacuauuguccuuguagauauaaccuuauuuuguuuauuuaagaaaaaccucaggcugcugaagugguucagcugguaaaaguaccugccacuaccuagccugauggugugaguucaaucccagcacaccacauuuuagaaagacagcacugacuucuggaaguuguccucucaccuucucugcacaccccccccacacacacaaacaugcauacaugagugcacacacaugugcacauacaugcccaauaaugaugaguaaaauuaauucuaauaaaaagacaaaaaaacugcugaauacccaaaucugaguaauuaguauuuuuuauuuucuccaguaccuaugguaauccuguagcaauaaaguagcuacuguguaucaaccaaacugugaaaauaaguugucacaggauaagugugacuucuacaggcagauaaacaagcuguacagauauucucuugaacagugaacagguguauguaacagugcugaugguggggccuguaaagaucauugugggcacuuagccucuguuccacagaucacccauagaaucaccuuccuguagaauagauauagaugguucaaauucacaguauauagagaggcauaagaauucugggucuggccaagcgugguggcauacgccuuuaaucccagcacucgggaggcagaggcaggcggauuucugaguuugaguccagccugauucuacaaagugaguuccaggacagccagggcuacacagagaaacccugucucaaaaagccaaaaaaaaaaaaaaaaaaagaaagcuauacucagagaagucuuaaauccaccccagucacacuccaggcuauucuccaauuuuccuaccucuuacuccaugguuuaucugucugcauuuucacaccuuguuugcuuuuuggggggagggaauguaugcugcuguuuuuuuuuuuuuuuuuuugacaguuuccauagaaacuaucaaaaauugccaaugccaacuauauuucaaguuauaacagcaggguauccagaaaaguuuucaguuagcuauaauugcaccucagauaaacaucacuggcuauaacacuaccaauguauaaagcuagggaaugcugcugaaugaauauguaaauguauuucuuacucauuugcaugguugcauaguaaucaaucaugugacuguaucccaguuuacucaguuaaucccuaauuaguggacaaauuguaggucuaauagccguaaguuacauguugagaaugaguacuaucuaaagcuuuucuucugaaccuucguaaaaccaaacuuuaaagauaucuacaccgacuaugagcuaacuguaaugaauacuaauaccaggacuaaauuuaaaacugauuucucugagguuugaaauguugguuauuugucuuauaguuauaagccguuugcaaguucaguauacucgauaauuauuuaucaaauaucuauaauguacaaugaaaacuucagugucuaacguuuugugaauauuuacaaugauguauauuuaauagaaauggcaacuaaaaccucuuacuuuucacuaauacuguagagugggaucuuuuuuaggcacaguaaaagacagaagcuuguucacacaccacaugucuuuagagccgguuaccuguggacccuucugguaagauuuaaaaaaaaaaagaaaaaagaaauuaguauagcauagaaaaaagauguuuguuugcuuguuuuuuuaaaguuaauaacuaacucauuuagaaugaauuagaaaugugugcuagaaaauguauaacuaucuggaagaaagaaaagcaaggcgggugggauuggaauggaagagaagacugagcuacuagcauguaagccccugcaggucggcaagagaaggugguucagagcgggaggggccacacuuguaaggaauaacgacagccuuggauguugugguaucguucugugguguaaaugcuaacaagagcaaaucagucaccugaucucugucucucaacacacaggcacacgcacacgcacacacacacacacacacacacacacacacacacacacaugcacgcacacacacaguacgugcguuuguugccagacaagcauacugaaguacucucucuccaaugcagcucaaguaaagaaaggcaaggagcccagcgcccacaucuuaccucaccugcucaagagcuucugucuaaagggcaucccuggagacacucagcuuuggaaaagucuccaagcaguccuauaguuucaaucuuaccggcucacgacguuucugccacaagaaccgaaaggaccagacauucaggcaaauccaccaaagucuucgucccgccuuucaagaugaaaucacaguuucacggagaugaacauuucaauagcaagaacguuaauuuggagggaaagaaccaaaagagcacagauggagacagggaagacgggaacgacagccauguucgucaguuuaacaaaggugacuacccucugaaggccacaggguaugauaugagaagucuuuagguacuauguaacauuuugacgugguuuuugucuuuuuuuuuuuuuuuuuuuuuuuuugguuuuugucuuuuugcaauaacuuuugaaaucuugauuucuguauguguucaggugcaugagcugccgcacacacggagggcagcuuugaggaguugguuuucuccuuccauccugcauucugggauuugaacucggaucaucaggcuugugcacaaagcacuuuuaccugcugagccaucugcugcuccugguuuucccuuuuuugguuagaguagugguucucaaccuucccagugcugugaccuuuuaauacaggucacagguacuccucaugucgcggugauccccaaccagaaaacgauucucauugcuacuugauaacuguaauuuggcuacuguuaugaauuguaaauguuuuguuuuccauggucuuaggugaccccugugaacggauccuucaagcuucaaaggggucacaacccacagguuaagaaccacuagacuagauugcuauacuauuaauguuuuccucgguauuuucucccuuuuguggugauaaguaauuucagaaccuuuuuuuaagauuuauuuaucuauguauuauauguacauaaaugcccugucuucaugcacaucagaagagggcaucagaucccauuacagaugguugugagccaccaugugguugcugggaauugaacucaggaccucuggaagagcagucaguguucuuaaccacugagccaucucuccaccccgagaccuuucauauuuucugaaggaaaagauuagguucaaauuguuguaaugauuucuuucaaagauaacuacuuagugacuuuucuucuguuuuuuuuuuuuucuuccuuuaacaaaagccaggaguuggggcuauuucaguggauaaagugcuuguuguacaagcauaaagacuugagcucagaucucuagcauccauguaaaauccaaguguguaguacacacauggaacuccgaugcuaaagaggcugaaacagaauccuaaagcugucuacccaaccagcccggucaaguuagggagaucuggguucagagacccugucucaaaguggagaacauuggauuaaaauacuccauguuaaugucuggucuucauauacaugugugugcacacacauacacacaugcacaggcacacacaagacaaauguaaugguggcgcaaggccaggcaugaugugcucaguccuguggugccaucacucgagaauuugagucagaagcauugugaguuccugaccagugugggcuacauagcaagacccuguuucaaaaaacaaaagcaaaaaaccaaaacagccuccuuugggaacuguauaaacguagcuaugaagacacuggaacagaaaaaggcuaggaguucaguguuagcuuaggcuugagugaggcaagaaggccaucaggccuaguugaagacugcugugacuacauuuauuuuuaucauguuauuuuucuuccaaaacugagcugaaaacaauuacaugugcuucuguucauuacucaaccuguagacuuaacagagauuaggcucccuguucucugcauguugaagcaaaacaaauuaauacacaucuuucauaaagcaggcugugccuuuuguggggaggaggguuucucuguguagcccuggcuguccuggaauuugcuuuguagaccaggcuggccucaaacucagucccaccugcuuuugccucugucuccugagugcugggacuaaaggugcugccaccaccccgaaguaaauacauaauuuuuguuguuguuucuuugagacagguucucucuuuguagaccaggcuggccuggaacuuacugagauccuccugccucugcccgcgcccccaguguagggcuaaagugugugccaccagcacucuguucauuucacuuuuguaaauuauccuuuaacagauuuaaugucaagccuucagagugccagagaccuacaggauaugcgaauuaaaaacaaagaaaggcgacaucuccgucugcagccaggcagucuguaucuuacaaagucauccacccugccccggaucucccugcaggcugcaguaggagacagggcuccuucugcauguucuccuaagcagguaaaccgcaauccuaagggaagccucaugcuguuagcuagaguuugcaagcugucuuguuuagagaaugaacaugauccugcuugcucaucaguccagaggggcagccucccuccucugccaggcuuguccucccguaccaaagcgaucuauacugcaaaacugcugcuugugcuccagaucucacuugucuugauggcaagugcucugagcuaggcacgaggggaaucuagucauuagccuugauuuaaagugugagugacugcuuucuggagguucugguaucuaauucuagugaagacuuuacuguuugguagaauguuccugagcagacggcuggaagugacagcaaugacgucaacagugugugcugaagcuuugugugcacuggacacuccucuuagagcuagcuucacaugccucagugaccgauggcuuuagccucacagccucucgugagaugugcauuauuguuuugucaggcaagaggacuaaggcacagagaggguuaaguagcagcugaaggauaacagccuggagucauauuccaacacacgggucugaccccagagcuacuguguaaagggaaagacacuugguuggucauguuugggugaagcaaacaccugauagggcccucugcacuuuuacgucugggcucuaaaaggaaguuauuagcaccauuauuuguacagcauaauggagcauuuugugaauuuggaugucugccuggugcaggggccgugcugaucuguguuucauucauuuuacgauauguacuacugaagaagcacagccugccacuggagaaggcagacauugcuuaucugcuuguucccacagugccuucuuguggcagauuuaaugacaggaagauacaagagaaaauaaaaaguguaaccaacucuugaauacacaagcaguuuauaaacaugcuucuaguauagagggggcuuguguuguuuugucugugcauguguaugugugugugugugcuucauacccaguguuuucugcaugcuaagcaccacuuugucacuccuuuauccuccugggccaguuaacuguucuauagugacuauuuuaguacuuaagugaacaguucuggauaaguuuaguuuuguuuauauucuaggucuguauuucacuuuuuaauuuuuuuaucacauuuuucuauuguuucuuuuguacagcucuauauauacggcguuucuaaagagugcauaaacguuaauagcaaaaaugcugaguauuuucaguuugauauucaggaucauuuugguaaagaagaucugugugcuggcaaaggcuuucaguuggcagaugguggauggcugauccccuccaaugauggcaaggcuggaaaagaagaauuuuauaggugcuguguggagaaagagauuuuguguuaacuuuguauuuucucucucucucucucuuuucuuuccuuaugacucaaguuaaaauuugcuagucauuuucuuuuuaaucuggauucuuuuguuaaaauguauuuuaguucacuagacauuguuuugaaaucuuuuaaaaauugaaugugauuuauuuugggauuuaaugaaguauauuuuuuguuuucuuuaaauugguuguauuuuuauauauuaugggagaaaguugaauuugaauuugccuuaugguauucucccauuuuugucauuuccuuuuucacuguauacuuuaauaaaauuuaaaauuauaagcacuaaaauuuaaacagaaaucuauaacugucaguaauguaaccagaaaaucucagaacauagacaugaaccacucagaagcuauacacugguguauacacacacaagcuucugcgugauugcguacgagagaauagugacgguugagggaucugauauuauucuguguuuuuauuguacuguauauuucuuugcucagggcucugugugacacuccagguguggauccaaagcuuauuucuagcaucuggguugcuaaccauuacagguggauuguauggaaacuggcagcuauggaauuugcuuuuccuaaggaauuugcuaauagaugccuaaacccagaaagagugcugcuucaacugaaauacaggcaaguugaaaggauggcaguaagugacugugucauucagucugcaguuuccuguguagcuccugacuucuauaacaaaggugguguauaaaccaguucugaguaacagccccccuccaagucccuucccccaauauccucuccccuuuuccucagagaaggggaagccuaccuuggguaccaccccauccugggacaucuaguccaagcaggacuaagugcauccucucccauugagacccagcuaggcaguccauuuaggggaaggggauccaguggcaggcaacagagucagagacagccccuguaccaauuguuaggguccaacaugaagaccaagcugcacugcacaucuacaaaugugcaggaggucuagguccagcccgugcauagucuuugguuguugguucggucuauguucuagcuaaaaucuuaagaauuaucuuuucaguauaucuuugaugaauuuuuuguuuuuugagacaggguuucucuguguggccccugacuauccuagaauugacucuguauaucaagcuggccuugaagucagagauccuuugccucugucuccuaaguacugggacuaaagccaugugucaccaugccuggcuuaauuaacugauuuuuaaaaauuuuuugcuuauuuauuugugaguguguguguguggauaugcacuccagaagagggcauuugaguccuccacuagcacacucugccuauuccuuugaggcacggucucucucucucucucucugaacuuagagcucccacuuucuuggcuaguauggaagccaauccccagcagucucucugucuccagggaccucagagcuggaguuacaggcauguacucugcucagcuuguuaugugugugcugggaucuaaccucuguccucauuguagcaccacaagcucucuugacuuuguugcauuucuagccuagugaacuagcuccacuguuucucaaguauccgcuggcuuuguuuacagugagcccccagggguacaguugcuagaaucagcaucuuggguuccuuuucagauacgauguggaaauugacaacagcaggagaucggcucuaaagaagauacuggagagggaugacacagcugcaaaaacccuuguucucuguauuucugacaucauuucaccaagcacaaaggugucugaaacuucaggcgguaaaacuaguggugaggaugccaacaaaguggacacgaucgaacucacagaugggugguacgcugucagggcccagcuagacccuccacucauggcucuuguaaagaguggcaaacugacugugggucagaagaucauuacucagggagcagagcuggugggcucuccugaugccugugcaccucuggaagccccagacucccuaaggcuaaagguaagcuacauuauuguacacucuggacaaggaccagcccguaacucccuuauauuccagagcgguaauuuauuuaaaaugauguguuuacuucgaucguaaggauagaauuucuugacaauguacuaguaauauaagaagcaaauuuuucuaacaguuucugcugguuaggggaggcagagcuauuucuugagcuagaugaacuugcaguuaaugaguaagagucagucuauaccagaauugaguuuagguaucugugccucuguccccuccucccagcaccggaauuacaaguucaugcuaccauaccuggcauuuucccagugcuuuugcggauagaacucagauccucaugcauacagggcaagaccguuaccaguuaagccaccucccaccccucaccuauuuuucuauuugaaauauuuaaauagcauugauccuuuguaguagaaguguaugugugaguuugaguaugugugugugugcaugcacauguacugcuagagaaucagaccuugcauacucugggcaggugcacuacaguagauuauaccccaagcccuacaguagaaauauucuugagaaauacauucuguugaaguaguuucccuuuuguacaguuuuugcuuacucacuuuuuuugccuuuaucagucauuuuuaugagauuuuaaaaaaaguuuuauuuuaugaguauaaguguuuuuccugccuuugcaccauaugcagccaguucccucugaggccagaagagggaauuggauccccucgaauuagaguugugagcauauguguaguugugugguugcuaggaauugaacccagauccucugcaagagcaaucagugcucuuaacugcugaaccaucucuuuagcacccucuacacacacacacacacacacacacacacacacacacacacacacacacacgaauauucucuuuuaaaaaaagaaagauuuauuuauuucauguauguggauacacugucacugucuucagacacgccagaagagggcaucggaucccauuacuacuacaugauagucuauaauauuuacagcauaccagcucauuauaugugaucuaauuuucaaggacauaauuuuuuuuaaagauuuauuuagggcuggagagauggcucagugguuaagagcaccagcugcucuuccgaaggucaugaguucaaaucccagcaaucacaugguggcucacaaccaucuguaaugagaucugacgcccucuucuggugcaucugaagacagcuauaguguacuuagauauaauaauaaaucuuuaaaaaaaagauuuauuuauaugaguacacugcagcugacuucagauacaccaaacgagggcaucagaucccauuacagaugguuguguggaauugaacucaggaccccgggaagagcagucagugcucuuaacaacugagccaucgauccagccccacaaauguucuuaaaagaucccaaaagaaugauagaaagucguaaaguagaauuuaguuuguauuuaacuuuuuuuuuucuguccuagaacucauucuguaagcuaggcuggccuugaacucagagauccauccaccugccucugccucuccagugcugagauugcacgugugcaccaccauggacuggccuguguuuaacuucuuuuuucuuuuuucuuuuuuuaagauugauugauugauugauugauuucaaaagcuuccaaauguauuuaucagaggauugucaguggagguggaggguacaggauuaucuuucuaucucaauugaaaugaugccaugcuaaguacuccguuacuuaguaacauuaaaauugcaauuaaguccccuuauaauuaaagaucuucaaacaaauaguuuugugaacaaauuacauacuucacuagaauuuuaauccuuuuuuuuuuaauuagguauuuccuucauuuacauuuccaaugcuacuccaaaagucccccaagcccuccuccccacucccacuucuuggcccugguguuccccuguacugagguauauaaaguuugcaagaccaaugggccucucuuuccacugauggacaacuaggccaucuucugauacauaugcagcuagagacacgagcucugggggaugcugguuaguucauauuguuguuccaccuauagaguugcagaucccuucagcuccuuggguacuuucucuagcuccuccauugggggcccugugauccauccaauagcugacugugagcauccacuucuguguuugcuaggccccggcauagccucacaagagacagcuauaucaggguccuuucagcaaaaucuugcuaguugaauuccucuuuccuuuuugcagauuucugcaaacagcacaaggccugcucgcuggcacagcaggcugggguucuuucgugaccccaggcccuucccucugcccuuguccucacuguucagugacggaggaaauguuggcuguguggauaucauuguucagagaguguacccuuuacagguauggugccuuuugaaacuuaucauguaaucccuuucuuuggagagaaucugaauguuccuugcuguuuuuuuacauugucaguggguggagaagacagugucuggauuguacauauuucguagugagagagaagaggagaaggaagcacugagauuugcagaggcccagcagaagaaacuagaggccuuguucaccaaaguccacacagaguuuaaagaccacgaagguaaaaugggcuucguauuacaaacuuuauuuuugguuuugguuuugguuuuucaggacaagguuucucuguguagcccuggcuguccuggaacucacucuguagaccagacuggccuugaucucagaaaucggucugccucugucucccaaguguugggauuaaaggugugcgccaccacugcccggccaagcuguuauuucuuacaguguuuuauaaauuacaugaguucucgucgaguaauugcuuuuuaaaaaaaucugcaucugcuuuuuuuuuuuuuaacuuaaaaaaauaccacauauacgaaaaaaugaaagccaggcucaugcccuuaaucccagcacuggggaggcagaggcaggcggauuucugaguucgaggccagccuggucuacaaagugaguuccaggacagccagggcuauacagagaaacccugucucaaaaaaccaaaaaaaaaaaaaaaguguucugcgcuccugcagaagaccugaguucaguuugcacugcccauaaccacccguaacuccaccuccaggggaucccaugcaccacaugccagugucacacuuucauacaagcacacguacacauuuacucagaaauggacuuuuaaaauauagacuggacuugcacuaucuagcuuauuuaaaauuaucauuagauuauaucauuuucaugaauaaaccgaucgauaugaaaaauaaguuauuuaaguuacaaguuacaaauaaaccccuauguguagugcuuuaacugugacugcaacagucguugucaccauugucgucuucugaugcugcugcuuuucuuccuccucuuccucuucuucuucuuaaaugaagcuauuaguagacagcugcuuguuuguuuuuaauguuuucuuuccugucacagcacauguacagaaggucaaggacagcuuauaaagcuuuucuguccuaccuugugggucccagggaucagaccccgcuguuaggcuuggugacuagugccacuaucagcugagcuguccugcugcucuuuguggcucuuuuuugucuaaccucccuccuuuuggugcuuuugcuugacucuaugguuuucacucccaaguuuugguucuagccgaucacuguugcuuucuucccuuccucccgcagaagacacaacacagcggugugugcugucccgcacacucacacggcagcaaguccaugcucugcaggauggagcagagcucuaugcagcagugcaguaugcaucagacccagaucaccuugaggugaggaagagccaggugacgagccucaguccccagcccacugggaagcucucuccugcuggccauuagagcaagcccauguugaaauacugcaucuuucaggaggauuucuguggcaaguccuugauucugcaucaaguagagaaugaaaaaguuugagaguuucauguaugacauucacauaguuuaaugugcagucgaaggaccagagagaaggccaguugguaaaggcuccugcugccgagccaaagccuuaguucaaucccugggacccaaaggguauaagcagagaaccagcuccuuccaguuuucuucugacuuaugcaugcucaaguuaaauacuuuuuuucaugguuuuuuugaaacagggauucuuuguguaacccuggcuguccuagaauucgcucuguagaccagacugaucuugaacucacagaaaucugccugccucugccuccucugagugcuagaacuaaagacauguaccacuacaccuagauacuauuaauuaauuaauuuguuuauuaauuaauuuauuuuuaagcaggcagagcuugcuuuuuuagccagcuguguggcaugugucugugucccacguacucuagggacuaagcagcagaauggcaaguugugugagcuggggacacagcagaauucugucuagagaaauggcuuagcaguuaagaaugucagagcucuuacucaaguucccaguacccguguuaggcagcuuacaacuaccuguagcuacagguacacauguacacguuaaauagaugaauauacaaaaagcuuuuuaaaaauuguauguuguuccacagaggaacuauuaaauuacuauuaaauuaaguuuauugggcugcagcaauuaagagcauuggcuguucuuccagaggacccguguucaauucccaucaccuacauggcagcucacaauugucuguaaucuagcuucaagugauuugucacccuuacacaugcauacaugcaggaggaacacuaaugcacauaaaaaauaaauaagucauuuuuaaauuaagcuuauuauauaggaaguaaggaaaaaagccauugagccagccuguccuaugucagcuaugcaguuauugaaguugucugugccucacucucagcagcucuaacacugagacaguaauagaacacaaauccuggccugccugugaaggucaaaugacuaggacauuuaccaggcacaaauccauccuucugucaauguucaugucagccauuugaaauguacaugugcugguuaugguuagaagauacuuaguagucaagguuuggcuuagcccuagggaaaucugucacagggacucacagagaagccguuugaggucccuagagcauugugugauagccugaguagugaucugcacccucaggucuggucugguuucacaugaggcaguccugcuaggguaggccggacugccauggugucugcucuguuucaaugcuuaaaugcccacaggcuuguuucagcgaagagcagcuaagagccuugaacaacuacagacaaaugcugaaugauaagaaacaagcgcggauccagucagaauuccggaaggcccuggaauccgcugagaaagaggaggguuuaucaagggauguuacaacuguguggaagcugcggguuacaagcuacaagaaaaaggaaaaaucagguuaguaugcaagguuuuuuggcuuuuguuuuuuuuuuuuaauucaguuuguuaaauuaaaaggugaucuuccauaugacagaguaugaaauucauguaaaauccaaugagugaaaugggcuccgagcaccacccacagagcagggaagccuugggucuuuguuuuugccauguuucagaaaauggucaccagugugucuaccuaccugucaugucccuuucucugaacagcucuguugaguaucuggcguccaucaucagacuuauccucccuguuaacagaaggaaagagauacagaaucuaucaucuugcagugucaaaaucgaagaguaaauuugaacggcccagcauccaguuaacagccacaaaaagaacucaguaucaacagcugccggucugcaccucuccuuaugcaguuuccaccuugaucaaugcagagcccuucuuagagccucaauaugcugauucuuuguucugcuuccugcagguuuccagugagacuuuacuccagguuuaccagcccagggagucccuucacuucagcagacugucagacccagccuuucagccuccuuguucugaaguggaugucguaggaguuguaguuucuguuguaaaaccgauagguaauguacagagugucuaaugucgcuuuucauugguucucuugaaccaauugccuucuuaaauuuggggguuuuuguuuugguuugguuucuuuuuuuuuuuaagauuuauuuaugcugagcagugguagcgcacgccuuuaaucccagcacuuggaaggcagaggcagguggauuuccaaguuugaggcuagccagggcuguucagagaaaaaccaaaaaaaaaaaaaaaaaaaaaaaaaacccaaaggauuuauuuauuuauuauauguaaguacacuuaagacacuccagaagagggcaucagaucucucauuacggaugguugugagccaucaugugguugcugggauuugaacucaggaccuuuggaagagcagucaguggguuuaaaggugugcgccgccacagcccagcugccuuguuucuuaauaaaaagcaauucgauaguacuucaggagaauaacuuagauucuguuuugugcuguuuaacuuuauaaagugauuuuucaguaguuaaaaucaaauaauuauaaucugaccuacugguggaacauucuaaccucugaucucucaagcuuuuaauagucuccagcaucuuggcuggcuucuccucucauguauguacuuaugcauuuauuuauuaguuuuauuuuguaucugggcaucacaccuagagcucacacugcucugcagauguugacacuaaucucugucccucccuguuuuauugugccuuuuaucuacaaggcucuuuccuuuucaccugcagugugcacaaaugugaaaguccagccaagaccccuguguaggcacaggcuuccauuucuugauuauuuauuguauauagaugccucagcauuagcuccuugcucucccucauugcacauuaaccaugugaugugcccuugcuguuccaucaguuacccucacuguucccauagacagccaugcuggcuucugugcccucauggugcuggucaaauggagccuugcaagaggcccggcaaaacagugccuacuccuuuccaaacccguguucuucuuuuagcuuugcugucuuccuuggcacucuguaaaaguagcuucuguucuccugaaguaauuguugucucugaggcuuacugccacaaucugcuaaccucgcccuaguccuggaagcuucuggccuccauacaaucuuaucuaguucuagaauguuuccaaccuuugagacuuacugcugaauaagcuuaccuuuuccaguucuuucugagcucuggcuggcugguucaacucagcuguucuggcucaagccgacugauucugucucuuucucucucagccucuucacugaauugcucuucuugaucguguacugacuuuggcaauauguucucaucuucuggcucauucugucuucugugucuagcuuguucucucucucugcaacccaucuuucuguaacuguccaaguaaaacugccccuuucucuuucucucuuuucuguggugcucucuuaaguaaccucuaggccuuuucuugugagaguugggaauagccuaucucugauucauucugucagaucuuucucggauucgucacuuugucugccccucaguuagacuuucaaacuugacugcuuccuucuacaaacuaaccuuaccuacauugcuuuggauuaaagauguauauuaaggacuuuucuauauucuagccagagggauuaaagguguguguuaaggacgaaccacacuacaacuagaaacagguguuuuucaguaaauaacacaaucucgggguucacagugugaucaaauauccugcaacagcacuccucagcaccuaacagcaccuaacagugucuccaccccacaacuggcucccuuuugggaugcaguguuguaaaggcagggcccugucuaucugcaucucccacccuaaaggagcaagugccauaggacaagcucuaccacacgugauaaauuccuuggggcacaucuuugcaguuagaguuuccccauuccucccaucucugcucacuuacuguccuuucuguugucucagucuuuugcguuguuuugagauggccaggaaccaugcguggguccucuggaagagcaguguccuagcagaaguguucacugcuccugacaccagcuucugugcagcccugggccugaaagcucuucaagcuucacacucugcuuuuuguccucauucccugucaggcaccuugccucaggaaugucacuuguaugacaguacauuuauuucugcuucuauuugcuuuuuuuguuguauuuccuaucuuuauccauuauggucacaggcaacuuugucuuuaauuuugcuuucugcacacacugugcacaucucacuuugccauuucaugcacgagucuguccuguugugguaaaauaacacaugcugucaguuucugugguccugcaggcuccuuuccaacuuacagaucuguuuguugacccugauccugagggucuaaaguuucguagcagagucaguuugaaaaaucuuaagaauuuccuuguucgcugggcggugguggugcacgccuuuaaucccagcacucaggaggcagaggcagguggauuucugaguucgaggccagccuggucuacaaagugaguuccaggacagccagggcuauacagugaaacccugucuccugucuugagaaacaaaaaaaaacccaaaaaacaaaaaacaaaagaaaagaaaaagaaaaaagaauuuccuuguucugugguguuuuccuuacagguuucguucuguccuccacugugccugcaaacccucccuuccccucccacucuccuucccugcucgccuuccuuccuucccucuuguguuuggugaguaguagcugacugaugugggguuugucucuagcuguuaaguucaucagccacauagccaugucauucccugcuaucugagucacacugaauccgcacacugccuguuauagaagguagguagcucauuuguggauuccauuaguauuuauugaguaauuguucaaugccaggugcacagcagagaagaauuccuuccugggagcacugugguggaagauggagggggaggaggagguaacaaacaaaacaauggagggccaaagggaagaagaaaggacaggguggggacagagcugaugcucagcugccauuuuagacagcauucagaaaagaccucauugauggugccagaaaaaaacugaaagagaagccugcagagccugaggagagucccgguggcuguaugcuuugguggagugugagagaggcacaaaagaaccagguguaugggugcuuggauauacuuuuacauuuuauauugauuauuauguguggcaugugugcagaggucagagggcaaggcagcuuuauggagaugguucuuucuguauaccuugauguagggucucaggauugaacuuggacuaucaggguuacacaacaguuaccuuuacccacugagccaucuugcuggcucccuuguauauauuuuaacuuuuacuucaauggugaugggaagucacaggaagguagaggagggacaggcuuugaccuuuucacauaucacuugagcuauuacauugaacauacaguacaaagggugugggcacaaacagggacuccaggaggaugccaugguaagagucuaggcaggagaggaugacaaaguagauagaagcugugaacacgauucagaacagcagacagguucugguuacccucugaagguaggggaacaguauggguguccgaagcugcggaagacugggauugccacuugcaaaagaggauuugauaacaacccaggggcaugguuugcggcuggugucucagcugcaugggaagcuucugagauguggcuucaggacugugcucacagacacaugaacuuuagaucagacagaguacuugagcgguagucagagcugcagaugcagacuuuaagagcauugguauacccgagagaugcaaaggagagagacugaauguauucccucugaguggagaagaggagacagagggcucuguuuugacacuuggguaucaggauuggggcacauauaaaggaggcagggagugcagaggagugcagagagguggagugcugaggagcacaguacgcugaaagaagagacauugcucugugugugugugugugagagagagagacagagagacagagagagagaggagacaauggcuaacuaguucaacuaagguguucugggccaaacuuuucccugagcugacugauucaaacugacagaagcuucucucugcuucugacugaauggcucugcuuggcuuccagcuaacucuggcaaucuguucuaaucuuuuggcuccucgucauucucuggcuaguucugucuucaccugugucuagcuuguucucucuguaaccuguaucuguaauacuguccugguaagacugccaugcacacacacacacacacacacacacacacacacacaccaccccuaugucuagcugcucucuguaaaacuguccucaccucuuucucucuucugccccugggcugcuccuaaguagccucucuuuccugucuguucuuaugagaguuugguguaucauaucucugcuucgucacuuguuuaaagggaaugaaaggaaaauagaaucaugaucaagagaauaguuuuuagguaaaguguugcuggcacacugaggguagagugugcugaagaagcuaaggaagagaggcaaggcugacacugggcagucagcacagaacauucuguauccagacacagaugagacaagcuguauccaucagcagagaggcaagaguacuuagauaggguacuaaugcagaaauugauggagagguagacacuugcacagaccucuuuuaauggcuuuuguuuccuugcugaacaggaaacaaagucauccauucauccacugaggucaguauguggaaggucagggaaucauuaccuaagagagugggagagccuagccuagguacgucccagggcugcccagguccaggccacccauagcucucaguaacccuccuucauuuucucaacaguuuuuuacauuuuggaagcacaaggcacugccgguucaucuaugaucugugcugcagcccuguaucaacacugcuuccccuuuagugggaagugaauggggaaacugaggucuacacaugggggaaggggguacaugccuuuaaucccagcacuuaggaggcagacacaggccaauccccaugaguucaaggccagccuggucuauagaacaaguuccaagacagccaggaguacacagagaaaccuugucucaaaaaaccaaaaauaaacaaguagagcuaaggucuguuacugauugucagagucagagccauacaaaagcugugcuuggagaaguaucuuuccucccugaggaacuaacucucccgagucugguccuccccuggcccucaaguccucaccuguccaguuuccuguucagccuuccucacucuuggcucagaacuguagaaacguguaugcguucucccugucuccuuccugcuaugucuuucuggagagcuuuuccuaguuagcacugccuugggguuuucuuccuucuuuucacaguugcccaggaaaccauuguguggguggaacacaguuacuccccugugagugagagcagaugaguugcuuccagcauuccauaguuucagacuauggagagugaccuaggugcagccacuaccauggcccuugcucacauguauuuuacuauuauuuaauggucaucagucuucagagcagagugcuagaaguaagaaccccgaguggaagguaggauggccauagcuuugcuaggcaaugccaguguuuucuucagaaggaugcaucaaauguccacucuccuggacaauuaucaguguauaugcugcccuguggccucgaaauguuuggcacugaaguucaaacaccuuaaguaaugguucauucuaggaauucuguguauaucguuauccucgcaguucuaaagauaacaaugacuggcauuuucauccuaggucuugcuccuuuggucuaccugucagacgagugccuuaauuuauuaguggugaaauucgggauagaccuuaaugaagacauaaagccacgugugcuaauugccgcaagcaaccuccagugccagccagaauccacaucaggagugccgaccuuauuugcuggccauuuuuccauauuuucugccaguccaaaggaggccuacuuucaggagaaagucaacaacuugaagcaugcuauugaggugagauuagggacuuggaagcuggaccaacaggugccuggagagugcuuucagcccagugauuccacacaugcgcacaugugcucauucacacacacacacacccaugugugcucauucacacccucccccucaccccaguacucucccccuucaccccaguacugagaauuagauuuacaucaaauuuuaagugucuuacaaggcaugguggcacaugccugcggguccagaauuucagugucagcuuuggcuauacagugaacaccagaccauaggccauauaaacacacacauacacacacauggguguauauguuguguguguaucucaagacccuagcuaaagaacaaacaaacaaaaguggguuucauucuucuguucugaauguuuuauuucugaaagaaaacacuuucugagaacauaaaugugugaauuagcaacucagcacaggcuuuuccaauuuauucucuuagaauaucgauacauuuuacaaggaggcagaaaagaagcuuauacacgugcuugagggagacagucccaagugguccacaccgaacaaagaccccacccgagagccccaugcagccuccacuugcugugcuucagaucuccuugguucaggaggucaguuccugguaaguuaguauggaaguaagguguuucguauguccuagcaaacaugauggaacuaaacugcauuuaaccugugguuaguuugcuguagcugaggcauaggcuauguggaaaucguaucuuauuuguugaaguaugaauguaaaacucugggagcagacuacacuguuggcacuuugagaacaugugcuugcaagauccuuugcuggcuccugagcugggaaagcuggcccacagcuguugcuuagucucuaagcucaggugacuccuuaaucauaggggugccuagcugccagggcuggccagacugguggcacugcuuaguaccuuaauucaaucaagcaguccucaccccauacaagaaaagugcuuguuacaguuaggagccuagcaaagaaaaacacuaaacaguugccugagacucaggacugagaaaagaaagguguuagagcuccacggaggccagccguggucucucucuggaggaaguagaucagacucccacagguaguccucugacuuccuuagguauguuguagcaugugaguacuugcauacacacauacacacaugcacaugaacaacauguacacaaaguaaguaaauguucagaaggaggaggaggaguuguugagcaguguguauccuuuuuaaaaugauuuugacaagccuguuguuuugggggguuauaacacugaaaaguuaaagcauaaaugaugucauguguuuguuucuuuuuuucucuauuuuuaaucuuauauaggaucucuucauuuuccuuuucuagccuuuuuuuuuuuuuuuuuuuuuuuuuuuuuuuugguuuuucgagacagguauagcccuggcuguccuggaacucacuuuguagaccaggcuggccuugaacucagaaaucugccugccucugccucccgagugcugggauuaaaggcaugcggcaccacgcccgacucauuucuggccauuuuuauacaucugucacuuugcaaaauuauuuccugugggugaggaauaagagcaugaauguuuggcauuauuuacccuuuagcaauuggaaaggaaagguguccuguugguguauauagguauuuucuaaugaaagguuaauucuaauuuauuuauauacaaguguuuauuaugauaggcuccucuuuuguguguuuuguuagaggauuucaccuacuggucagcaaaguuaucaaaguccuuuaucacacugcacacugaaagggaagucuaugccccuggcucacucagcccagauggcagcaaagucuuggaguggagagaacgagauugaugacccaaaaaccugucgaaaaagaagagccuuggauuuccuaagucggcugcccuuaccguccccggucagucccaucuguaccuuugucucuccagcugcacagaaggcuuuucagccgccacggagcuguggcacgaaauacgcaacaccuauuaaaaaagaacccaguuccccgcggaggagaacgccauuucagaagaccaguggcguuucucugccggacugugauucaguagcugaugaagaacuugccuugcucagcacccaggcccuuacgccugacuccgugggaggaaaugaacaagcguuucccggugauuccacaaggaacccccagccagcacagaggccagaccagcaaguagggcccagguccaggaaggagucucucagggacuguagaggcgacagcagugagaaauuagcuguugagucuuagccucccgguuuguaagauguguacaguuccaggcuacucauagguguucgugugagaaggcgggaguagcugcacucuacugaagcguguguuuacugcucagaugcucuaccuggucuguguugguguaacuaaagcugguugucaucgacugauuuaaaaagcuuuaggaguagacuggaucacuacaacuaucauuuuauauacaaaauaaacauagcuuugcuuuuaguuuagauuacuggcuaaguaugguuacuuuauauagucugguuccuguuuuugaaguuuuuucuuuuuuuaccuaggaaguccuaugaaauaguguucuuuccugcaugauugguucugcuagagcuccauccugucaggguaaacagacacaaccgugauguuuaccucuguguagccuugucacuccuuuccacugucccaguguaaucucucaaguuauucuagcuagaaauccagucaggcauaaugacacacaccugucaucccagcauguaggagauagagaggggaguuugggccacccuucauuacacagaagguucuaggcgguggguuacaaaguccuucccugaccacagccccaucggcagguggaugcucucacugaacuucagcuguaaagugcucugcucugcucuuagugauuuaaacuuuguucacuaaguaauuugguuuucauguccuaaucauuguacuagagacccaaccuagagcagaguaaauaaaucuuacauaacaggaauuaugcuauuuacaaaauuuaacuuuuuuuguuuuuugagacaggguuucuuuguguagcccuggcugugcuggaacuuguuggagaccaggcuggcc

SEQ ID NO: 2819 - RNA, 6141 nt, Mus musculus
gaaauucauguaaaauccaaugagugaaaugggcuccgagcaccacccacagagcagggaagccuugggucuuuguuuuugccauguuucagaaaauggucaccagugugucuaccuaccugucaugucccuuucucugaacagcucuguugaguaucuggcguccaucaucagacuuauccucccuguuaacagaaggaaagagauacagaaucuaucaucuugcagugucaaaaucgaagaguaaauuugaacggcccagcauccaguuaacagccacaaaaagaacucaguaucaacagcugccggucugcaccucuccuuaugcaguuuccaccuugaucaaugcagagcccuucuuagagccucaauaugcugauucuuuguucugcuuccugcagguuuccagugagacuuuacuccagguuuaccagcccagggagucccuucacuucagcagacugucagacccagccuuucagccuccuuguucugaaguggaugucguaggaguuguaguuucuguuguaaaaccgauagguaauguacagagugucuaaugucgcuuuucauugguucucuugaaccaauugccuucuuaaauuuggggguuuuuguuuugguuugguuucuuuuuuuuuuuaagauuuauuuaugcugagcagugguagcgcacgccuuuaaucccagcacuuggaaggcagaggcagguggauuuccaaguuugaggcuagccagggcuguucagagaaaaaccaaaaaaaaaaaaaaaaaaaaaaaaaacccaaaggauuuauuuauuuauuauauguaaguacacuuaagacacuccagaagagggcaucagaucucucauuacggaugguugugagccaucaugugguugcugggauuugaacucaggaccuuuggaagagcagucaguggguuuaaaggugugcgccgccacagcccagcugccuuguuucuuaauaaaaagcaauucgauaguacuucaggagaauaacuuagauucuguuuugugcuguuuaacuuuauaaagugauuuuucaguaguuaaaaucaaauaauuauaaucugaccuacugguggaacauucuaaccucugaucucucaagcuuuuaauagucuccagcaucuuggcuggcuucuccucucauguauguacuuaugcauuuauuuauuaguuuuauuuuguaucugggcaucacaccuagagcucacacugcucugcagauguugacacuaaucucugucccucccuguuuuauugugccuuuuaucuacaaggcucuuuccuuuucaccugcagugugcacaaaugugaaaguccagccaagaccccuguguaggcacaggcuuccauuucuugauuauuuauuguauauagaugccucagcauuagcuccuugcucucccucauugcacauuaaccaugugaugugcccuugcuguuccaucaguuacccucacuguucccauagacagccaugcuggcuucugugcccucauggugcuggucaaauggagccuugcaagaggcccggcaaaacagugccuacuccuuuccaaacccguguucuucuuuuagcuuugcugucuuccuuggcacucuguaaaaguagcuucuguucuccugaaguaauuguugucucugaggcuuacugccacaaucugcuaaccucgcccuaguccuggaagcuucuggccuccauacaaucuuaucuaguucuagaauguuuccaaccuuugagacuuacugcugaauaagcuuaccuuuuccaguucuuucugagcucuggcuggcugguucaacucagcuguucuggcucaagccgacugauucugucucuuucucucucagccucuucacugaauugcucuucuugaucguguacugacuuuggcaauauguucucaucuucuggcucauucugucuucugugucuagcuuguucucucucucugcaacccaucuuucuguaacuguccaaguaaaacugccccuuucucuuucucucuuuucuguggugcucucuuaaguaaccucuaggccuuuucuugugagaguugggaauagccuaucucugauucauucugucagaucuuucucggauucgucacuuugucugccccucaguuagacuuucaaacuugacugcuuccuucuacaaacuaaccuuaccuacauugcuuuggauuaaagauguauauuaaggacuuuucuauauucuagccagagggauuaaagguguguguuaaggacgaaccacacuacaacuagaaacagguguuuuucaguaaauaacacaaucucgggguucacagugugaucaaauauccugcaacagcacuccucagcaccuaacagcaccuaacagugucuccaccccacaacuggcucccuuuugggaugcaguguuguaaaggcagggcccugucuaucugcaucucccacccuaaaggagcaagugccauaggacaagcucuaccacacgugauaaauuccuuggggcacaucuuugcaguuagaguuuccccauuccucccaucucugcucacuuacuguccuuucuguugucucagucuuuugcguuguuuugagauggccaggaaccaugcguggguccucuggaagagcaguguccuagcagaaguguucacugcuccugacaccagcuucugugcagcccugggccugaaagcucuucaagcuucacacucugcuuuuuguccucauucccugucaggcaccuugccucaggaaugucacuuguaugacaguacauuuauuucugcuucuauuugcuuuuuuuguuguauuuccuaucuuuauccauuauggucacaggcaacuuugucuuuaauuuugcuuucugcacacacugugcacaucucacuuugccauuucaugcacgagucuguccuguugugguaaaauaacacaugcugucaguuucugugguccugcaggcuccuuuccaacuuacagaucuguuuguugacccugauccugagggucuaaaguuucguagcagagucaguuugaaaaaucuuaagaauuuccuuguucgcugggcggugguggugcacgccuuuaaucccagcacucaggaggcagaggcagguggauuucugaguucgaggccagccuggucuacaaagugaguuccaggacagccagggcuauacagugaaacccugucuccugucuugagaaacaaaaaaaaacccaaaaaacaaaaaacaaaagaaaagaaaaagaaaaaagaauuuccuuguucugugguguuuuccuuacagguuucguucuguccuccacugugccugcaaacccucccuuccccucccacucuccuucccugcucgccuuccuuccuucccucuuguguuuggugaguaguagcugacugaugugggguuugucucuagcuguuaaguucaucagccacauagccaugucauucccugcuaucugagucacacugaauccgcacacugccuguuauagaagguagguagcucauuuguggauuccauuaguauuuauugaguaauuguucaaugccaggugcacagcagagaagaauuccuuccugggagcacugugguggaagauggagggggaggaggagguaacaaacaaaacaauggagggccaaagggaagaagaaaggacaggguggggacagagcugaugcucagcugccauuuuagacagcauucagaaaagaccucauugauggugccagaaaaaaacugaaagagaagccugcagagccugaggagagucccgguggcuguaugcuuugguggagugugagagaggcacaaaagaaccagguguaugggugcuuggauauacuuuuacauuuuauauugauuauuauguguggcaugugugcagaggucagagggcaaggcagcuuuauggagaugguucuuucuguauaccuugauguagggucucaggauugaacuuggacuaucaggguuacacaacaguuaccuuuacccacugagccaucuugcuggcucccuuguauauauuuuaacuuuuacuucaauggugaugggaagucacaggaagguagaggagggacaggcuuugaccuuuucacauaucacuugagcuauuacauugaacauacaguacaaagggugugggcacaaacagggacuccaggaggaugccaugguaagagucuaggcaggagaggaugacaaaguagauagaagcugugaacacgauucagaacagcagacagguucugguuacccucugaagguaggggaacaguauggguguccgaagcugcggaagacugggauugccacuugcaaaagaggauuugauaacaacccaggggcaugguuugcggcuggugucucagcugcaugggaagcuucugagauguggcuucaggacugugcucacagacacaugaacuuuagaucagacagaguacuugagcgguagucagagcugcagaugcagacuuuaagagcauugguauacccgagagaugcaaaggagagagacugaauguauucccucugaguggagaagaggagacagagggcucuguuuugacacuuggguaucaggauuggggcacauauaaaggaggcagggagugcagaggagugcagagagguggagugcugaggagcacaguacgcugaaagaagagacauugcucugugugugugugugugagagagagagacagagagacagagagagagaggagacaauggcuaacuaguucaacuaagguguucugggccaaacuuuucccugagcugacugauucaaacugacagaagcuucucucugcuucugacugaauggcucugcuuggcuuccagcuaacucuggcaaucuguucuaaucuuuuggcuccucgucauucucuggcuaguucugucuucaccugugucuagcuuguucucucuguaaccuguaucuguaauacuguccugguaagacugccaugcacacacacacacacacacacacacacacacacacaccaccccuaugucuagcugcucucuguaaaacuguccucaccucuuucucucuucugccccugggcugcuccuaaguagccucucuuuccugucuguucuuaugagaguuugguguaucauaucucugcuucgucacuuguuuaaagggaaugaaaggaaaauagaaucaugaucaagagaauaguuuuuagguaaaguguugcuggcacacugaggguagagugugcugaagaagcuaaggaagagaggcaaggcugacacugggcagucagcacagaacauucuguauccagacacagaugagacaagcuguauccaucagcagagaggcaagaguacuuagauaggguacuaaugcagaaauugauggagagguagacacuugcacagaccucuuuuaauggcuuuuguuuccuugcugaacaggaaacaaagucauccauucauccacugaggucaguauguggaaggucagggaaucauuaccuaagagagugggagagccuagccuagguacgucccagggcugcccagguccaggccacccauagcucucaguaacccuccuucauuuucucaacaguuuuuuacauuuuggaagcacaaggcacugccgguucaucuaugaucugugcugcagcccuguaucaacacugcuuccccuuuagugggaagugaauggggaaacugaggucuacacaugggggaaggggguacaugccuuuaaucccagcacuuaggaggcagacacaggccaauccccaugaguucaaggccagccuggucuauagaacaaguuccaagacagccaggaguacacagagaaaccuugucucaaaaaaccaaaaauaaacaaguagagcuaaggucuguuacugauugucagagucagagccauacaaaagcugugcuuggagaaguaucuuuccucccugaggaacuaacucucccgagucugguccuccccuggcccucaaguccucaccuguccaguuuccuguucagccuuccucacucuuggcucagaacuguagaaacguguaugcguucucccugucuccuuccugcuaugucuuucuggagagcuuuuccuaguuagcacug

SEQ ID NO: 2820 - RNA, 1776 nt, Mus musculus
cuuuuuuuuuuuuuuuuuuuuuuuuuuuuuuuugguuuuucgagacagguauagcccuggcuguccuggaacucacuuuguagaccaggcuggccuugaacucagaaaucugccugccucugccucccgagugcugggauuaaaggcaugcggcaccacgcccgacucauuucuggccauuuuuauacaucugucacuuugcaaaauuauuuccugugggugaggaauaagagcaugaauguuuggcauuauuuacccuuuagcaauuggaaaggaaagguguccuguugguguauauagguauuuucuaaugaaagguuaauucuaauuuauuuauauacaaguguuuauuaugauaggcuccucuuuuguguguuuuguuagaggauuucaccuacuggucagcaaaguuaucaaaguccuuuaucacacugcacacugaaagggaagucuaugccccuggcucacucagcccagauggcagcaaagucuuggaguggagagaacgagauugaugacccaaaaaccugucgaaaaagaagagccuuggauuuccuaagucggcugcccuuaccguccccggucagucccaucuguaccuuugucucuccagcugcacagaaggcuuuucagccgccacggagcuguggcacgaaauacgcaacaccuauuaaaaaagaacccaguuccccgcggaggagaacgccauuucagaagaccaguggcguuucucugccggacugugauucaguagcugaugaagaacuugccuugcucagcacccaggcccuuacgccugacuccgugggaggaaaugaacaagcguuucccggugauuccacaaggaacccccagccagcacagaggccagaccagcaaguagggcccagguccaggaaggagucucucagggacuguagaggcgacagcagugagaaauuagcuguugagucuuagccucccgguuuguaagauguguacaguuccaggcuacucauagguguucgugugagaaggcgggaguagcugcacucuacugaagcguguguuuacugcucagaugcucuaccuggucuguguugguguaacuaaagcugguugucaucgacugauuuaaaaagcuuuaggaguagacuggaucacuacaacuaucauuuuauauacaaaauaaacauagcuuugcuuuuaguuuagauuacuggcuaaguaugguuacuuuauauagucugguuccuguuuuugaaguuuuuucuuuuuuuaccuaggaaguccuaugaaauaguguucuuuccugcaugauugguucugcuagagcuccauccugucaggguaaacagacacaaccgugauguuuaccucuguguagccuugucacuccuuuccacugucccaguguaaucucucaaguuauucuagcuagaaauccagucaggcauaaugacacacaccugucaucccagcauguaggagauagagaggggaguuugggccacccuucauuacacagaagguucuaggcgguggguuacaaaguccuucccugaccacagccccaucggcagguggaugcucucacugaacuucagcuguaaagugcucugcucugcucuuagugauuuaaacuuuguucacuaaguaauuugguuuucauguccuaaucauuguacuagagacccaaccuagagcagaguaaauaaaucuuacauaacaggaauuaugcuauuuacaaaauuuaacuuuuuuuguuuuuugagacaggguuucuuuguguagccc

SEQ ID NO: 2821 - RNA, 1003 nt, Mus musculus
gggggcgggcugccaggccaggggcgcuccggcuucuccgucccuaaggaaaacgucaagaucccuucuaagaauccggggaggucccgaaggcugacaggcuucucuuggggcuuccacgcucgcagugaggcgagagcugugucaaagccggaggugcaggcgccagccguucgcucagacgaaaccggaaauaccucccucaccuccaccgggacccaucgcucuguaagcacuuccaccaucuuccucuccaagcccucccccaccccacuccacccccuccaaaaaaaaaaaaaaagaacuuccgcgaacacacgaaccuccgggaagacgagagaccguccaaaacguagcuauuaaacggagcuggaaagagacgcgaggcuggagcaguuucauacgcaagauggccgccaccucuaggauuacccaugcagcaccgcgggcucacgcccggcauuauggggauugaaguccggcgucccgcaguccucguuuaccucaaggcaccgaaacucaguguuccagaguccauugcaagacuuacaagcuauuuuggccaccaacguagacucagucuuguuccccgcccuguaguggggggaaguuucuuaaagaaacaucaccuuuaucuauaaaggcagcgacguccucugggguucacgacucaaaaagaacaagagugcuuggcgcccccagguggauggacgcgcaagccucuguggugagugaacaguuuucaggcuuuucaggagacaaaagaaucagccuaggcuucaaaggggaaaacauuuuguguaacagaacucaguugcuaugguuucucagaaacaccauuuaguauaauuuuaagcuucugaacaacuguggcaaaauagagugccugcaccucagaaccccauaacagaugacucuuggggagaagaaauuauaaaguaucuuacuuccagauauaggaaaacugcuauauaaauauguauugaauuaaaacuaaauacca

SEQ ID NO: 2822 - RNA, 870 nt, Mus musculus
augaaggcuuccccccauggugguucuugcuuguucaaacauuuuguucauuguucaucaugggaaaugggugcauacaacuuacucgggguggaccagagauuacauaccuuuugcaggaaggaaugucuuggauggaaagcuuaaaguuaaacccuccagucagcccaucuagauaccucauugguuuggaggacucaguggucauuaugauccucaagugggauguccuggucacaugcuccaggacaggacccagguugagugcagauggaacaccuacuggucuuagauaugagaauaccggggguuucugaacccguuccacuugccccacagggguucuuuugcaguaggcaggaaggucaguagcucuagcuugucagcagaagugaaaggucacauugcauccacaguagggcuuggagaugauugcuuucucucccuuucauucagugucugacucuagccacacccagaguugagccucuuaaccuuccuggaaaugccuuccccaacgugccuagaagucucugaggugacucccugacuuuuuaacagacaacugagaguauccgugccaaaggccuaauaccuaaacuaugcugcuguguuccgguggccacccuugguguuuucagaccccagacacuugcacaugacccaggcuauaguugcucuuaccuguugauuuuauuuccgguuauauagucucuugaaacugagucuguggugguuuggauaagaauggcccucgagcggggcucggguggcgcacgccuuuauuucugaguuccaggccaaccuggucuacaaaguaaguuccaggacagccagggcuauacagagaaacccuguuucgaaaaacca

SEQ ID NO: 2823 - RNA, 2376 nt, Mus musculus
agccgggccuccccugcggucccacacuugagaggcccagucaugcaggaaaaccucagauuugcuucaucaggagaugacguuaaaauauggaaugcuugguuucugacauugguggauaaauucaacccucacaagucaccacaauggaacaguucaaucuguuggagcagcaauaauaacuuucuagugacagcgucuucuaguggugacaaaauaguggugucaaguugcaaauguaagcccguuccacuuuuggagcuugcagaaaggaaaaagcagacaugugucgauuuaaauucuacaucaauguauuuggcaaguggaggccuaaauaacacuguuaauauuugggauuuaaaguccaaacaacuucaucagucucuuaaggaucauaaacgugaaguaacuuguguggcauacaguuggaaugacuguuacauugcuucugggucucucaguggugagauuaucuuacacagcguaaccacuaacacauccagcacaccuuuggccaugggaguaagcagccugcccggcacaucaaguacucauuguuuaggaagucucucuugggcagcauuucugauaauggaguagugacucucugggauaugaacagucagaguuuauaccacagcuuugacaguauacacaaagccccagcuucaggcaucugcuucuuuccugucaaugaacugcuguuuguaaccauaggccuggauaaaagaaucauccucuaugacacuucaagucagaagcuagugaaaacuuuaguggccaacaccccucugacugcaguagauuuuaugccggauggagccacuuuagcuauuggauccucccgugggaaaauauaucgguaugacuuaagggugcugaaaucucccaugaaaaccaucaguacccacaagacaucugugcaauguauagcauuucaguacuccacaacucugacaaaggcaaguuuaaguaaaggcagcucaaauaaggccgcagcagugaacaaacggaguguuccugugagcagcagcaguggggcugcccagaauucuggaguugucagagaagcacccagcccuuccauugccacaguucucccacaacucgugacaacagcucugggcaaaggaucaggggcugcucaggaugaaacagaugcuauagucaggaaaggaggugaugaaucuguaggcaaaggagauggccuugacuuuucuaccacagcuaaacucaguguucccccugaggaagaaugcaggugccuccagcacuguggugcugcacuccagcccucuuaauguccucaugggaucuucagggaaagaaggaaacgaaagcccugagcugucagcugagucuaaaagagcauaccuagggaagcaggaaccuaaggacuccuugaagcaguuuacaaaguugaucuccucuggugcugaagcuggaauucuaaauaccuguccauugucuaaccaagcaagaaaucuugaaaaauuugaaaagccagaaaaaagauauugaagcccaguugauacaugaacccucagucaauggcuccucaacuacaguaccaaaggcagcauccucugucacugcuggcguagacaguucacucucacaaaaaauagucgauacccuugagaacaguuggccaagugcgccgcuuaccucaguccagauccgcuucauucagaacaugguacaagaaacacuggaggacuucagggaagcuugccauagagacauugugaaucugcaaguggaaaugauuaaacacuuucauaugcaacugaaugaaauguacuuuuugcuggaaagauacuuugugaaugaaggcuuaguggcugagaucugaaaggcugcgagaagaaaacaaaaggcuguaggcccauuucugaagacucugggcaccuugauuuguuaugaguuaggagauuucuggcaacuauaauacauggaaucaguauuguuugcauggccuugaaaauggauuuugcagcacacacuguuccaucucugucagacauuuauauuuuuauauuaaaacugcacagaauaccaaucuuccuagugaggaagucaacaggaucuuuauuuucugaaugccuuagcuauacacuaagugcccuuuuccuaaaagaagaaaauauucauaagaauagguuuauguuuuguaaaugacuuuaaaauagauauauuuuugauggacaaauuguauuccaaauuuuuuuuagguagccaacgguuaaaaccuugguaugccaggcgugguggugcacagcaggcggauuucugaguucgaauccagccuggucuacaaagugaguuccaggacagccagagcuacacagagaaacccuaucucgaaaacccaaa

SEQ ID NO: 2824 - RNA, 3020 nt, Mus musculus
cauugauuuuauuuuuuuaacauauauaaaaauaaauguaauaaaccaaauacauggacauaguaaagguuauguaugacaaacccauggccaauaucauccuuaaugaauaaaaccacuaauaagccccauuaaaaucaggaaugggagaggacugcccacuaucccuacugcucauccauaaugugauugaagcauuagcuggagcaauaaggcaagagaagggauacaaaugggaaaauauuaaguuaaauuauuuucgauugaagauuauauuaucuuauacccaauguugccaaaauuugacuagaaaaauuauagaaauuaucaauaauuucagcaaaguguuaugauauaugauugacuuacaaaauuuaccagucuuaauacauaugaguaacaagcauucugagaaagagaucauggguacacuucucuucccaguuucucaaaucaaauaaaauauuuagaauauaccuaaugaaagagguaaaaaaccucuacaaugaaaacuuugugugaagaaagagauuaagaaacacuagaauuugaagacaucccaagcguauagcuugguagaauuaacauuguaaaaaaagacuauccuaccaaaacaauuuacugauucaaugaaaucacaaucaacauccccaucucauucuuuacauaaauagaaagaaaauccuuaaauugauguggaacaacaaaagacccagaauagccaauuaguccuagauaaguguuuauuucuauacauucugcucauuauaagugcuaagugcaucugucuaugaccccaacuuuuauacaucuguuucuauugagucgauuuuguuugauauuagaauggcuacucuaacuuguuucuugggaccauuugcuuggaaaauuguuuuccaaccuuucacucugagguagugucugucuuugucacugaggugaguuuucuauauguagcaaaaugcuggguccugauuauuuaucuuugucuuuuuauucaggaguugaguccauugauguuaagagauauuaaagaaaagugauuguuauucccuguuauguuuguuguuagaaguggaauuaugcuugugugucuaucuucuuugggguuuguuguaagauuauuuucuugcuuuuucuaggguauaguuucccuucuuguguugguguuuuccauuauccuuuguagggcuggauuugagaaaagauacuguguaaauuugguuuugucauggaauaucuuguuuucuccaucuaugauaauugagaguugugcuggguaugguagccugggcuggcauuuguguucucuuagggucugcaugacaucugcccaggaucuucuagcuuucauagucucuggugagaagucuggugugauucugauaggucuggagggccaugucuuagacacaugaguuuuagagacaggcaacagccauaacagugacuuuauacauucuugguuuguauauaaauaaggaccaaagccaagaccuucagaaaccccagggagucaccuuuuuagaucaauagagucaaccuaauuuauaucacuuaucuuugaagauugguuauguguuuuuacaaagcaaacugaaauaaaggcaaggaugauaaauccagcagaguacaggaaauaagguugacauuuucccaugguucuggauaguuacauguauaagacuuuuccuguggccucuggugccuaucucagagcauuuuguuaugugcauuugaaauuauuucucuuaacagcaccaaaacaggcuauuuuagagauggucuauggaauauauauucuugcuuuuaaauaaaucuguugugggugccauucagguuguauuucuucaggcacaaucgauagaguguuugcugaaguucugccucugugaggacuccuaacauuuguuuauauucuuagcaguaaagggaauaaagguuuucugguaauugugaaggaaaaaaaaaaaaaagacucuucuagccuucuguagugcucauuccugaggccagcaucacuagggaguauaagggaugugagagaagaugcuagccauuguucuuguuucucguucuuuauggaauggaaagucugaguguguuauaaaugacaaguguuauagaugacaaggcuaacacaauggcuuggggcuuagcacacuguggaugucauacauguggaauucuugcuuuuuaagauaaaugauauuaacucuuagacaaaaccauacaguauuuaaaaaacaaaaaacaaacaaacaaacaaacaaacaaacaaccagacagaauagguguuuuacagacuuuuguuuuagcaucucuucagaauacccuccaucuauguggcugcuuuucauccuuaauccagaggagguaaacaugcauugcaggcucacucuugcuugugucccccuaaaaaauguucagguaacccagagagauccacagaggaacccacauugauuauucauuauccagaaugccugcaaaauggaaugucucggauguuugguuuuaaaaauauuuauaucugcacauaagauuuccuagaacucaacccaaaucuaaauacaagauucauuuauguuauauuacuugaaggucauuuuagacacuaagauuuguuuuuguguguuuugagugugacucaucacaugagugcugguauagaauuguuaacuuauggcaucacacuugauguuugaaaaguuuuagacuuuggaacauuuuggauuuucaacuucuggaucagggguacuuaaucuguauuugcauuuacaauuguguuguguuucaaggucagagaaugaugugagugucaaaaccauggccugcagccagagcagacaguagggaaaaugggagacauucccuaugccagugaaccuguauauaaucaguauguuucaaaaugacuguaucucugguuuuuauaaucacagaagccagcaaauuccuucuuuuaaagagagucucaguauguagccuugguuagcccagaacucacuaugcaguag

SEQ ID NO: 2825 - RNA, 1214 nt, Mus musculus
uaugggagggcucugguguccagacuggagguuuguaacuuuguguggccaacgcuggaaucagcccugauggucagggaggauugggaugaacucggagcugauucuuaggccccccggguggaaagagcucgggggaguggagccgggacugagaugccuggggacauggaagcgccugagcgagugcagcccagagucccacagccugccgccugcgcagccuucaagguagcugagaagcagcaacccuuuccagugcucgcaggaggacaaguggcuguggaggaacaagacaguggucacauacguggccauggccaccgagggcaugcuaggggccuccuaugucgcggugccccuuuauaggcucuacugccagaauacuggacuuggaggaucagcaguggccgggcacucaucagaucagauugaaaacagggugccuguuaaggaucgaucaguaaagucaccuuuaauguccguuuccaguggaucuucagaccucaaugaacagagaucuaugugguaccaguagagacugcacuggcauuuuauaaagcuaaaaauccuacucacaaaccaguaauuguaauuucuacauauaauguuguaccguuugaagcuggccaauauuucaauaaaauacaguguuucuguuuuaaagaacaaaggcuuaauccacaagaagaaguggauaugccaguguuuuucuacauugacccugaauuugcagaagaucugagaauggcgaaugucuaucccauuacucuuucuuaccauuuuuuuuuuuuugaagcaaaggaagggcacaaguuuccaguuccaagcuauaauuaaaguagcucccaagaccugcuuaagauuugugauuuuuggaaaaucauguauguugcuuucucagaaauacauuuugaaaccuuuuuuuuuuccacuuguuaauguuugggauuuuuuauuagauauuuucuuuauuuacauuucaaguguuauccccuuuccuaguuuccccucugaaaaucuccuauccuguccccucucccccuguuccccagcccacccacuccugcuuccugguccaggcauuccccuauacuggagcacagaaccuucacaggaccaagggccucuccucccauugauuacugacuaggccauccucugcuacauguguagcuagagucccucccuguguguuauuugauuggugauuu

SEQ ID NO: 2826 - RNA, 4544 nt, Mus musculus
gaacaaaaguaaaacuucugucuccagcccagcagcucccccgggcguggcaagaguccuguggcaguccagcccagagcugcgaccugguccuguuccugcagggucugcagccugcccagagcagccaggaggaugucccauauuuaggcagacugccuggcuacagggcugcugcggccuggagaagccgcccugaaguugguuggagucugggaaaggccaucgggagcaggcuugggcaggaagccgagcccccggggagcugggagcugcgguucccgagccagucacguccugcgcgcggggggcgguagccugggcccgcggguauuuggggaagcgucccaguucuaggcgcuuccaguggcucccuugcacaagugacuucugggcccaguucuggggcaaagaugccugcccuucacaucgaggaucugccggaaaaggaaaaacugaagauggagguugagcaacuucgcaaagaagucaaguugcagagacaacagguaagguggcuggcuauuucagaauucacucucagaaaugcgccaaggucaggauuacuggauuaaacgaugagggguaggggugggugucuuuuucugggagcuucucuuuaagggggcuccaccuucuagaugaugugggggaaucgcaaaaggugagaagagccaggaacuaauaaggaaucuaaagccaaauguuaucaagacagagucccaaacaggggagacaaccaaucccuuaaagggcagcuggcuuccauucuggaaaggacgguguaugauagaauguuucuaaaaccacauugaaaaucucccaacaauuuuagcuuuaauuuugcaaagauccugacuccauugggacuugagagcacugccugaguuucuguuauuugcaaauuguaugcaauuuccauuuugucuuggaaguguguuaaaugauuaauagacuuuacuguauugacuuauagacacauaauuacauuuauacuguaugggauauggcugcaaaguaaaauaaauaaauaaauaaauaaauaaauaaauaaauaaauaaaugcagggugugguggugcaugccuguaauuuucaaucacuuaggagguggaggcaggaggguuaggaguuccaggccacccuggccagucaaugaaaaaauacccaggaguguucacugaaacuccauggaaaacuuggaauuuuuacuucaauucuuuguugauaguaagcgccuugauuacauuaaucuucuuuucccacucugucaagcaaccagucguuuagaaaaaaaaaaaacuuuuggauagcuuguucaauuugaagaaaaguaauuuuuuccccagagcaagaaaaauuuggacugauauuauuaugacuuguacuuuuuuacagcccagucauuucccucucccaguugguccgcccucccacagaguuccacaucccauccuaucccccuaucucucccaccuucccuccccaacgaaaccuccccacucccuggggucucaagucucuugcagguuaggcacaucuucucucacugaggccagaucaagcaguucucugcuguauaugaguggggcagggauggggggcucauaccagcuacuguaugcugccuggcugguggcucagugucugaaaucucagggauccccacuaguugagacugcugggcuucauaugggguugcaguccuccucagcuucuuccagccuuucccuauggagugauguuauuuuuaagaguuugggauuacuagggcucaaacucugggcacuguguauguggucacaccugagccacaccucaggcucuuugacauuagccuucuguuucaauuauuugaaagaaugaagaaauagaaaugaagcaaauuauauaaacaggcuccaaacacauucaugauaaagcuuaauacuccugaauuguuuuugggaggugcuggaaguuuuugaguuuuacauuuuuaugaaauuuccacucugauuuagcccguugcuucauacaaauucacacucuuccucgauuuugcagugggauauucuauuuuuccuguaacuuuaagaaaucaugugauuagaggaauaagacagcugagagaacuaagggauaacauuauuucuuggagggggcuguuuugacugaugacaaaccccagaguuuggccagucucagccagagggauugcacauuaaacagcaugguguauggugugugcugaaauaauacuuagccuuugcaaagcuggaaagucagaguauuuagcaucauuguguagaauuuacaggguauaggaaaggacaaguugcaaagucgacaucaggcagcauccugggugugccgauguacaagucaaacauccuuauuuacaguuuccaggucagccaccacagcccugggguacacccuacagcacagguuuccuagaacauucuugguguuugcuaggacaagagaaagauuuagagugauucuuccaggacacaaaguggaugguggaucuccuuuccauucccaaacuuuuuauuguagcuaugacauauagacgauuauaaugaugcuggguaagcacuguggugcuugguuuucacucaaucccucacuugaaagaagaaaaacccccucagucccagaagcgauaaccaguuccucacuuaaagccacagagcauaaggcagguacuucaguagucuuuuucccugcacccuuccggucagccuguccauccuucguuaacaccugaacucuguguuaacucaggccaagcagacaaagacgcagguuauaucugccugcagauaauuaauuauucgucagguguauccucucaaucacagaaggagcaauuacccacuuuuggagauuagggaucuuuucagaaccccaaugaaagagccucugcaggaagaguggggacccggaucggaucauaccguaccgggauccgauccgucugggaccacagacuccggauuuaaacacucccuuauuagcacugagaacucccuuagaacauacacacuagaaaugcuagcaguaguuagauuuuuggaaagauaguauuuauuaucauauuuuaauuccuguaacuguuugaccuaguuuuccauuuuggaucagugggucccacacgcggccgugcaaacaguacuuuaggguauggggaggaaauaaugaaacgauaagauuccuauuucuguuuauuuuugaaugccacuuuuuaauuaguaguuuauuuuucauaauuaugcaaaaugcguuaacacugugcuaucuacacgugcuuauuacuggugcauuuuggagaugcauauguaagcacauuuagagagagucacucaaaggcuacuuuucaucagucucuaacuuuuacuuuaaacuuaccacuugcaaaacagacuguucugaagacacucagucucacucuucauuuccaauuuagucucucuuuaaaaaaaaaauaaaccugcaacuugucucuuaaggauagaauucuuagagagacaauucaauccugucccaugagaagaaaaguuuaagcagauucccuaaauuccagagucucaguuuacccugcuaagccucuagggaagcuuuuaauauaauauuuguuuacucaucagagggguuuugaggcaagacucagagugaguuggauaggaaauucuaacaucccugucagccuuucccugcugcuucuaugacucuagcugugacuccauggaauucuggaguacggcaugcccccuugcaugagacaugggguguggcacacccuuaacaccugggaacugccuuauagcugccugguauccagagauuuugaacgugguagcucuguuauauucgcgucuuagagaguaaggaaaucaugggacaaguaugaauagaagaucaugggugaacuauuaauacaaugacuuucaauuauuuguuucuugaacaauauuuuucucaaagauuauaugacauauaaauagaauaauaaucuuagaguaggaaaauauuuuuuuagaaauaugaugguuuauuaaacuauaugaaccuuacaaaaaccaguggcaaaguucaauuuccuugucauaauuuauuucuuuugauccccucucccuauacuauagguaucuaaauguucugaggaaauaaagaacuacauugaagaacguucuggagaggauccucugguaaagggaaucccagaagacaagaaucccuucaaagaaaagggcagcugugucauuucauaaguaacucugggggagggaaauucuguucuuuuguuuaauuuucccccaaaugaagccaaaguguguguugaagaacugagaaaaaauaaaaucgagaaaaagacugucauauaagcacucuccaagcaguuggggugugaaucauaccugcuucucaccuuggcuccccacacacucucucucagaggagagcaucugauugcaguuauggaaugaaggcauggcucccccacuuucaguauacuccuugcugucuccaauaaaguuuuaucuuggaaaaaucaau

SEQ ID NO: 2827 - RNA, 36732 nt, Mus musculus
ugaguguucacugaucuguuaucugauccaggcucggcaucugagucuggcugguaauccuucauggggucuguacauggggcuggaaauggggcuuaaccaaaguaaauguaauaaugcacaguuuaucucuugaugccugcuccccucaucaacgagagagagggggguacagacagagagagucagagagaggauggaggagggagggaggaagggagggaggaagggagggagggagggagggagggagggagggagggagggagggagggagagacagagagauagagagacagaggagagaggagauuaugggcacacaggcccccccaaacuggggaaauuagggggcagggguggagccaacccaugagggcagcucuagagcucgccacgcugucacccuccuccccucacaccccagcccccuccagccugcagauggcccgcagggcacagagugaagcgggacuggacagcuccugccuuuucaucuucggccuccaggucccucaacaccugccccgccgcccggagaucuguaaagagcccacguagguguccuaaagugcuuccaaacuuggcaagggcgagagagggcggguggcuggggagggcggagguaugcagacagggagucagaguucccccucgaaagccucaaaaguguccacguccucaaaaagaauggaaccaauuuaagaagccccguagccacgucccuccccccucggcucccuccccugcucccccgcagucuccucccagcacugagucccgggccccuagcccuagcccucccauugguggagacguuuuuggaggcacccuccggcuggggaaacuuuucccauauaaauaaggcaggucugggcuuuauuauuuuagcaccacggcagcaggagguuucgacuaaguuggagggaacgguccacgauugcaugccugcgcccgccaggugauaccuccgcuggugacccaggggcucugcaacacaaggagucugcaugucuaagugguagacaugcucagcuuuguggauacgcggacucuguugcugcuugcaguaacuucgugccuagcaacaugccaauguaagugucuucugcuuguuugggggagaugaaggagagaggcuggauaggugggcacccuuaucucaacagagggaaacuucacacauucauuccacauacagcuugugaggucgcccucuaaucugucggagaaaacacuaggguucacgagauacaugggaaaagaauggaaauaugaaagacuugacuguugccaagaguugggggaaguuuuucccuuaaaacuagacuguuagcccggaugccccgguuggugaagcucacaaagaggcaaagaagguugccucaagauauaaaccuggcugacagcaugaacgacugagagggcuccacucuucaauucccagaauuaugcccguggucacguugugaaacuugaggccuaguuuagaaagccccguaauagaauaauacaaaacucacaggacuccauuuucuugugggcggccgaguugcucuggaugacguugaugaagauaaugauaaaaauacgcccccuggaggggguaaagugcaggaacagggaccaggccuuaagcgcuaggaauuccaauuaaagacuucccagguccauggaguaauuuacauuucugggccauauguaaagaacccagaugguguaucuugagaagcgggcugcuucggccucagcuuuuaucuucugaauagucaaagcagcgucccaauccauuaccugaucauggaaaugguaacuuuuaacuaaaauaagcucuguucacuuacacuucaacaaguucccaccuguaaucacacacgaaaacaacagaugugagaaauaucaacuucguccugagauucaagagccuggggauucuucucaggagucucuuacucguuuaccaugugacuucaaaugaaucaauugggccuuuuucuaaaaugugggguauauacuaaaugugccaacuucgaggcuauuuuccauuucuagguuguauaacuaacuagaauuuccugaagaaagaaugaagaaaaccacuuggguuucaucuuuuaaaauggcugccuaauuuaacuggacaaagauguuggcuugaugaguauucaggagggcguggccacacccagaccuucagcuacacgccccacgucugccacagccuaauuuugaauguguauauauuccuuucauccacuuuuauauaccccucgaggauacuaagaaguaauugcauuguacaaauuaauguuacaaguuaauuuuauaugaaaccagaguaagaggggauccccacagaaaaauauaguagacuuagggaaguagagauuugaaggucaacauacauuuuauucaacauccaaccacuaagaacaauaaagguuauccaacacacauuguccaaaauggcucacaaacugaguaauuaaaaggcacguuuccaaagccuguaaggcuuacuggcuucucuuaauucaggcaaacuguucuuccuucaauggagaaaauaaacuagacauaccauuuaucuaauugaacagugauucucaucaauugcccuaaaaugugaaugcaggaggugucccacucuucugagcagugaccacuucaacagauguucucauuccaaaugacacacuuugugaccaccaaauucaagcaauuuuuaggggugaaucauccuggagcaagucugaccgcaauuauaugccacaugauccuguaauuauuauacuguaggaaugaaacucagucuuuaaagucuuaggguaauuguagcaaagaaguggguauuuauuuuucucauuauuuuucaagauuuuaauccacaguuuucucuuuauacaaagcagaacuucuuagggcacaaaugggcugcucuuuagucaaugaccuuaccucauugacaugaacuauuuauagcaaaaaucagacuccugaaucaauuugcuuucauugaugcaaauuagaccuuugggggaaagggcuaagucacuucaaugguuuacaaaaaaaacaagcucugcuucaggaugcaggcuaacguuuucucagauucuuaugcaucauuuccuugucaaucagaaggugauagccaccuauucaccuaugccacuuccuccauaauugcugagcacuggagauguccugccugcagacacagugaugcuucauggcauuuaaaaaauagugaauaauuaacuauuuaauuuaaaucuauauuuacauaucaaaacuguaaacaagucacccugcggaucccugcuauguuuuuuuuuaccugaauaauuugggggcuauuagaauauucugaaggagaaacagaaggggucuuucaaucagguaaaucuacuguauagaccuaaguaucauuuuuuuaauuaccguuauugacauauggaaugauagcaacugaugaaaugauaccaauaacuauuuccuauucucuucuucccucaacagauuugcaaucggugaguaaaacuacuuuuagaauacauaagguguuuguacuuugccuugaucacagcggugucauuucuggggagggaaguuggccaguuuggcuucccaaggaaauugugaagggacauaauaguaggcuaaaguuuucuggcuuccacugaaaguacccaccccauuuucugaaguggguggcgcuaagugagacuagucccauaaaaugcccauagggaagagaaaggaaaugggucaguggaaguuugggguuuagcaccagcuacuccgaagcacaagggcacagugagcuugagagauuuuuguuauuuccugggauucauuugcaaugaauuaugaauaaauucuuagcucacagauugaaggcacaacacaguuacagauaaguauauacaauugguuuuguagauaacauuuuauugauugguaaaauuuuacauuuuauuucaaaauauuagauuaagauaguaggaaaagaacaaugcaguuacauuuguaaauauauuuguacauaauauuguaauaaagccauuuuaauauauagguguauauauaauucuuauaaugaucauuuaucuuuucuuuccuagggaucaguacgaaagguaagaggcuauguuucuucauaaauaucugaaauuaccagaauaauuucaguuugacaaaauuuaaggugaacuacagaaagaaaauacuuuagcgagauuuuaccuauaugaauauguauucaccaaaccauaaaacagaguacuguuaauguuugauguaacaaaguuuuauuaucuuccagaagcaucuuuaauuacauuuauguuauaugaauuaaugauuuacauaguaaagacuuuguaaauaucuauuuauauucuuauaaggggugcauauuauauuaauuauagauaauaauuuaaaguuuauuuuaaaggaaugacacuguaaaugugcugugaagguauaauaaauaguuuuaucuauagcuauuaucuuauuaaaaguacaauggauaauauuaguuugaucacuacaaauuauagcauccucuaguccuucagcuugagaaaaaaauuacuuauaguuucaacaaaaaaaaaacaguucuuuguuaucuauuguuuugugccagaucuucuagcugcuguuuaguaauauuuuagucaacucagucuuaguagcuaauuauuuucaaaauuggcuugcuuguucagcaucaauuacuuagucacguggcccuuugccauuuuugucuuccuuuagggccccacuggagacagaggaccacguggacaaaggguaugugauuuuuuaaaucauuaaagggcuuuggcccauauucgaauaacuacauauuagacgcuacagaugguggacaauguguaagauuauuucauauucagauaauuauaccaccuuuuaaguagauaauguccugcagaagaaguaaaugaacauuauuauauauaaucaauauccccuuucagucaagauuacucuuucauaaaaagaaacacuauuacaggcagccacauucuuugcagggucuaucuuucuuuguuuaguuuggccugcacaauacacguguaaugggaauguacccucuaccacagaaccuucuuuguaacauguuuuguuucuuuugaaaaaaaaaaucucugcauagauuggaaauaauugugaagcagucacaugcuucucuaucuucauucagacauguacacaccgggcugcuagucuauuugcuacauuuuugcuacauuucggugauaugugucacuaaacuguuuuugcaugauuugcauuauauaauaaauaacugcaucauguaucugucgugguauguggacuuacauguguucugcucacuguauuaguuguauaauugugucgguuaguuauccuaacaacauggauaguguuaaagcaagcagucuucccaucucugugauaaaaugaucuaaccagucagccuacccuucacauaucaccaccaaagcaauuggauaccuuuacaaaagucagcuuuaauguacacagugucauuuccuacggcuggaaaccugugacacucacagaaucugcuccaucgugaauuaauacacagggucuacacuggcuuagcugccacuaguuaucuuugcacaucagccuuaaaugucuuccugaacgaagucacaggugcacaucagucagcgacagaucuuauauuucuacccuuuuacaucaacaagucuaacagacugaccuuagcauguguguucuuaggucucuuuccacauucuauacaugguuccacaagauugcucuaauccuguuccaauucccucuuuuuuguaacagggucccgcagguccccgaggcagagaugguguugauggucccaugggcccuccuggucccccuggcuccccugguccucccggcuccccugcccccccuggucuuacugggguaagauaacuuauacauucuuaucuuaggucugacuuuagugucuugcucuguuggaaaagaaauacucacugcgaaaauuaauuuuuagcaguuaagggaaaaccuucuauuuggaaaugaguauauuuuauuuaauuucuuugguuucugaguuuaagguucugcuuuuuccaucuuccucagggucuugucaauuacaguccuggucuuuuuguucacugaagguagcugcagccuucugcaccauuauuuaauuuggggauuuaauaucuuuuaucaguucggcacaaauaagagguguugcauuauuaaagagguugauuagauugaauuacauaagugaagccccuggucuuaagcaauuucacaaacaucugacccucucuauucuccuuggcuuggagucugcugaacaaacauucaaagcaguucuagguuuaauuuccuugaaacuaaauugagaaaaguacauuucccuuuuucauuaauaucuucuuuuagcuuuaugucuuugacaaugguauaagugccaaauggucucacugcaggaagaaaaacauauuugcuuaauugguuagcacuaugaaucagauuccuaauucuaauacccaacuguaugccaguaaaauaagaccuuucucucccaaagaucuuauuaugauugcuuaucuacugagugcauuaaaagcaccucuuuaauacaguuaccacucgaagagagaucuuuaacagggaaguuauuaccaugaacuauuuuuuaaaaguuuaaucuucuaagggggcauuuuaacuuuccuguaacuugaaaacucuuuauaucccuuuuugaaacuccagccaggacaaagaagucucuuagugacuucugggcuaggguagcaacugccaaugcagcacgcucccaugggcucuguuucacuugcugggguucugagggacuguaaagguguaggaagccaucuuccucagucaggagguaggugacgaguguuaggaacagauuucucaaggcagaugagucugaaggcuaagagguggagguucuccauuucagucucggugggggacucagcgcugaauucuuuuuuguguguguggggggggugggguuuuuuuuuuuuuugguuuuuggguuuuuggguuuuuuggguuuuuggguuuuuggguuuuuggguuuuuggguuuuuggguuuuuggguuuuuggguuuuuggguuuuuggguuuucgagacaggguuucucuguauagccguggcuguccuggaacucacucuguagaccaggcuguccuugaacucagaaaucugccugccucugccucccaagugcugggauuaaaggcgugugccuccacgcccggcuccagcacugaauucuaagucauuucuauugaaacauggcucuccuuuaaauaguaccaggggauuaauuaauuagaguauuaaauaugaucagauaauugauugauugacugauugauugauugauugauugaaagaagaaugaaagauguauguguaugaccacugaccuauauacucauguguguuuucuucccuccagaacuuugcugcucaguauucugacaaaggaguuucaucuggcccuggaccaaugguaggcuugucuccuuuuguccuagaggggggaaaagcagcuucuguaagggaauucaugcuaaaccucacaauacuaacuaagucaacacuccaaggcuagaucagaagaaaacaacuccuuuuucuacauuuaaauaucaaaacugaaguccaggugaggaguuucaauuuucucuaccaacgugccuccuaaaaagaauguucgauaucuaugucugaaaaauagucuuuggaaauacagacuauaacucaagcaaaugaauuuaacucaaaauauuaacaucuauacaugucucuguaucuuuccacacuccuugaaauacgaagcacggcuaaaaagcagaaggauuuccuuugcccccugaaccugauggaaguucuagcucagucccuuccuucaucauaacaggagaauccggggcuuuacuucuugcccacccccccacccccaaucacgcagguaguugagagauaauauauggcucguguauuuaguucuugaauagaacacuuucuuagucacaaggacuuaccaggugcccccucccagguuaagaacuacacuguggauuuacgcagcuagcagcaaaugacagcaguucugaauuaccuucagggacuugaauguuuccuuucucucccuucugaugaaaauuccuugucuugacuauuuauuaaaagccaauauacaagagaaugagucaaauuuagcauuugugucacuccacacacgucccgucauuucuguaaccauuuauaaagcuucccuguguaucaggaugaugaccuagcugacaaaugaagcuucuaaccagacauuacugagaugugauaaagagaaaauagacaugaucaugaaaaauguacaauagcuuauaggaaagaaugaaaaugucccagaaguaaaaacauuagauugauucacuaccacagaauuuaauaaacaugcacacaauuuggugauucuaauuaucuguuuucuaaaggcauuuaucuguuaguuaucauggucuuuaaacacaacuuuuaccugggcucuacaucagugcucuaucugcacaagacauuauucugaaacuaaugggccgaaguaaacuaauauacuacaaaggcaagacaauauuuucuguaaauuaaaacucucacuuguaaaauaauguagcuuuaauugaugauuuccaauuuccugauuuuuccuuguaauuuaaaacauucauauuugaagugaaaaauugaagcauucuuucgacauuguuugucuuagacauuugaaaugaguuguuucugcuaaugccagacauuacucacauguaaaguagaauccauuucucaagaagagccaaagugggaaauaaagcaggaguagauguccucuuauguuaaaaauuagaaugguggacauacaucugagaaauugauauggauuucagauuccccugucuuugaaacuacuuucuggggaguaucaaaaagagaauucacauuaaaauaucagugagauauaauuuaagcuucuacauacaucccaauccacagacagauguaaccaacagagauguguuuaacaaagagagaaaaugggcagcaauaaaguguuaaauaauuucccauguuggaaaaucaauagcuacaaaaucccacaggguucaucucacagucuccacaaaauaaaauauccuuuauguaaaugaaguugucacaaaaccugggaaagaugaauaaauauaauuaaaaauucaugaugucaaagaaaauuauacuuaaugcauaccuaaaaauuauuuuuauugaaaagugacagcuucuuuuaacauugaagccauuucuaaaacaaaauaaauaauccucauaauuaaaauaaugugcuuuuuaaauaaaauauguagugucucacuauagucauuuaauaagguggauaggcucaacugcagaguccucaugguugauguauuaaaagcaaauuacucaagacuugugcaugagguauuuuuagcugucugggagguagguccuacagaugagcuacacaaguguugauugcuacagaggcagaacaaaacuacacuuagcucaaaaaccuauaacauucaguuuuacuuuacauuuguguuccacgaagaagaagaagaagaagaagaagaagaagaagaagaagaagaagaagaagaagaagaagaagaagaagaaguagaaaagcuacugucauuguguuauguuuucaagauccuaugauagauuccuccagcaggcugccucaguaauacacuugagauuuucaucagucaucaauaggccucaaaagaucuuugagguuauaauaaaccucuguuuaaucauuaaguaggacuuuugaucuuuuucaauuuauggcccgguagcaauaaacauaucaauuucuuagcuacauaugacauggagaggugacauaugacaaaaggaaucuaacugauacucuuuaucagccauuauguggucuguucuugugcaaagaucaguucucuucauugccuuagaacaaucuccagaugaccaaauuugcacaucucgaggaacuuaugacuuccuccagacaauucucauugaguucaaaagauuucuuugguuaaaaaaaagaagaagaagaagaagaacugaaggucaggagagagugcaggaaauuugguucaucuguccauccaaaaacuucaggggcucagagauaucacuucuauaucuaguguauccaguccagauuaugagacucccaacaaggauaugacuuuuugguguuaacuauguguauacucuuuacaggguuuaaugggacccagaggcccuccuggugcuguuggagccccuguaaguaucaaaauccuagaaacauucuucuauaaaagcagaacauugagcaugacucucgugcacuggggaugaugauagauggccaaggacuugucuaaugugccugaccugagcuugacuccagaacuuccagauagauagauagauagauagauagauagauagauagauagauagauagauagauagguaauaaauaaaugugccuucuccucuaccuuagggcccucaagguuuccaaggaccugcuggugaaccuggugagccuggucaaacggugagaacauuuucucuguuuaaaacaagagaaagucucugaagagcgguuugugaacacagucuuaaccuccaugcaucucccauucccuuaggguccugcagguccccgugguccagcuggcucuccuggcaaggcuggugaggauguaaguguuuacucuuaagcucuucugaaacaacuuuuacauacuccuguuucaguaggaguaucuagagccaaauuaaguuccaugcugaaugcucaagaugccugagucuccccaugugggaaauauuacuuuaaugaaauacuaauuaacuugcuuaugcucaagagauuuaauuguuaauuaaacauguauucuagcccacaaaauugcguaugccuuucucucacaauaauuuacuaagugaaggaugaccuuagguugcuuuccuguuuuagggucacccuggaaaacccggaagaccuggggagagaggagucguuggaccacaggugagacuguugacaauaggaugugguccauuguuagucaugagcaugccucugaugguagacucagaugucacucacacugguggcauugauugaagacaucuggcaaaagaaagaaccaggaaaagaauguagauauuuuauucacauucauaacggaauauuggugacagcaaacagacuuugacuaacaacuguuuuuuucaacuaaugccaccaucuuaguuauucauaucauagcuaguaguuuguagcuccaugcucaaaaaacauaacacccuuugaucccaaacuugaguuuugagaauugguuuggaaagaugaaugcauuauguuauuauucaccuugcucugauucccucccaccccaccccaagggugcucgugguuuccccgggacuccuggacuuccuggcuucaaaggcgugaaagugagugacuucuuccucuaaaugagaaaaaaaaugcugcugaugggggaggggagugagaacccaagcaugugucugaauuuugaaaaugcuggaaaugaaaggagccaaugcuuaucaaacacugagauuaaugcagaaacacgauacagauuauagauuauauaaagauuguauauauuuuuaaguacuugaacuaucuaaaaccagaaaauuguuagggugagaggguuguaagaaagcuuguccagcacccuucccuucuuagcugugugcagaccaagugauuagccugggguaguggaaccagcucagcugagcuggaauacuguauuguguucuucugcaaccaugggaucuuucuagaagauguaaucauuguaaagguggaagacucuggucugacugagauuacaacaugacagcauuuuuaaaaguguucauugccuuucagggacacagugguauggauggauuaaagggacagccuggugcacagggugugaagguaaauacugaguuaggaucacuguaagcaagucauuuaaaucuuccauugcuauccaaaaggcuauuuuacuaaagacaacccacauuucaaaaaguaucuugucuccucaucuaccuuucaaaucccucaauggugggacagugaaauucuaugacaaaggccaauugcuaauguuuauuuaacuuaauguuuauguaaauaaucaaauggaaaguaauguuaaaauuucuuccuccaucuccuucccuccucuuaugucauugauucucuguagucaaaauaaaaguaaauaaacauauaaccaaauauuaggacaaagugugcuacuaaaguguaaauucuccuuugccuugcacuaauuagauggguacauucaugucacaacacacuuuucaaccucuuuccucugauuuaucugugcacacuucaaaauuuuuuuuaauuagguaauuaaagucucagaaguguauuaucucuuggcuagccucuucucugaacaacauuucgaaccauaaaaucuucucuuuccuauuaaggagauaaugugauauuaaagugaauaccaauguaauuacaaauuaaugaguaacaaaugcagacgggaccagagaugaacaugaauauggagaaucuggucuaacuucccacugccacacaaauggacauggucaaguucauucucccaugagccacaguauaauauauauauauaauauaauuauagcucggaucacugaucacaauauuuuagagcuaaaaggcacuuuguagaugucaucauuugggaaaaacuaagguuacgaagcacucaugacuuuuccaaagucaauugugcagugcuuaaaaggcaaacucagaaagcucaugccagucauucuuaaaguggauucuucaccuccagccuuagaccuagagcuguaaagauagcucagucauccagcaccugcuaaaugagcacaugccaagccuuugauuugcuccucaacaucucucucuaaacuggaaugccuugaaggaaaguguuuuaccgauaccuagcucucagaauaagaaacaaaucuggugacuccaaaaucucuugugaugcccugacuuuccauucaucuuaaugaagccaauaacauuggcauucagauaccucugaagaugguaaauuugguugcccugaagaaaauguauuauuuuuuucucuuuucaauuaauauuccuaaucuauguaguugguuccaaaugucuacaauguaaaaagaaaauuggagagguguacaauuaaauaaucacauuuaauuuaguaccuuagccuuuggcauauuuaaauaaaacccucaucauauuuuuaaaaaacauaugugccugagaucauugagaaauagucuauaaguauaaauacauguuuaaaauauacaaaaggcucaaacugauaaaauagaguaaaaauugugcaaugugaauauauauauauauauauauauauauauauauugaacaaagacucaauuuuucuucugcauauauagggugaacccggugccccuggagagaauggaacuccaggucaagcagugaguauugaccaauccacuggcaaccugaaugugcaugcuuagcauucugaaucuucuuuagagacuuugauaauugcuaucucccuugguauugcauucuugauauuuuuucuuauaucucugcauauucaacuuuuaccugguguuagaacagcacuuguauucuuagugaacucuuacauauguuagaaauugggcaaaguaagcgcugccucugacucuuuuaagaucagcauucuggacuuuauuaacaauauuucugcuucuagggagcccgagggcuuccuggugagagagggcgugucggagcuccugguccagcuguaaguagucugguuuuuuucuucccuuugaaucuuuuuugaacacugucuaaugggaguugcuugauguccaccugacuguccgucuucccuuccuucauagggugcccgaggcagugauggaagcguuggccccgucggcccugcuguaaguccugacacuggcgaguagaaagggguugaaacugugggggcaguagcucucuguuaacuuuuauaaaaugacaauauuuuggacauuuuugccaaauguuucccugggggucuuuggaaguuucccuuucuaaguaucauaggcuauuccaaaugccuagagcuacugacugaugaauagaguaagacucauccaauguugggaaccuugaacaucuucccuugauaguacucugugcuuguuuuucuaaucuacuucaaggaaauuucuuaugccuucugcuuugauuucagggucccauugggucugcuggacccccugguuucccaggugcuccuggucccaagguaaaaagcauuuuuugcuaucaccacuuggacaaauccuuuagaacuaucugaaaugucaguacugguuguagagagggagacaacugcaaagcaauucccuuaauccaccuccaccuccaaaaugccuacagaagaguuuuuucacucuacguuugcaguaaaccucucugugcacuauguauagaugagccucccccuagaaacugacucccugaaggcacuauaaaaugugcuuucccagcuagccuggacugagugggagccacucccgcagagaccaaaccacagcgacuguagggcuaauugccagaacgucagauguaggcuugcaaacuagaaagucaagcccagucuuugcgaugauaaaccagagaaacuaaaugguugcuguucugacaaaauucccuaaaaguuggugcuauggucaauaacagucucguuauuuacugcuuauucccuguccuguuacuuucauucucagggugaacuugggcccguugguaacccuggcccugcugguccugcugguccccguggugaagugggucuuccaggucuuucuggcccuguuggaccuccuguaaguagucguugacauaagacaguugaugagaaagacugaagauagggucauagaauguaagaaauauucucguucaaugaguuuuuccuucuccuuucucucacagggcaacccuggaacaaaugggcucacuggcgccaagggugcuacuguaaguacaucugaguagcugacuugugcuuaaagagggaggccucuacagccugcuuucuccugagggaccuuuuuucuucccacagggacucccuggugucgcuggggcucccggucucccuggcccccgugguauuccuggccccgcuggugcugcuggugcuacaggugccagaggacuuguuguaaguggucaccaccagaacauauuuuaucuguacuuugacuuuuucuugcaacuuuuuuugucuuccuucuguaauuugugcaaacguuuaucuuucuucuauagcugcauuaugugcuugcauagccccuccucugugcaugcacguaagcuucuuccuuagaagcuugcaaaaaaaaucaaugagguaaacucggugugugagucuuagccacacaccaauaccauuguagagaacuugagcuuaaacaacccaacagacuucucugcuggagaggcuugacccauuucugucauuugaccucuguuuccuuuggaucuuagggugagccugguccugcuggcuccaaaggagaauccgguaacaagggugagccuguaagugguuuuacagucacaguuguguuaacuuauucguaucaguuuucaauccaauuucaguaacuggauaugauguaaaaauauuuuucuacucuucuuauucuuaaaaaaaaaaacagggcucuguuggagcccaagguccuccuggucccagcggugaagaaggaaagagagggucucccggagaagcuggaucugcuggcccugcagggccuccagggcuuagaguaaguucugaauccuccagacacagcagacccugaugccaccccuuggcugggaauuggucagcauuucugcauguguuuccuagaugaaagagcaucugucuuccaucuguuuuauuacauuagcaacucucaauuuaguauguuauuaaauuggucuggaaacaguguugaccuauuuuugcaggaugcucaucugugcauucccuuggcauuuggguaaaauguuuuggcuuggugugcacccauaucuuuccucuuaggagaaauggugcccugucuuaggaaacucuaucugaugagaucuaaagauuucucuaaucuccugccaucucaugcccuuuccugcagggcagcccugguucucgaggucuuccuggagcugauggcagagcugguguaauggugagucacucaucacuuacuuuccaggaaggaccuugauaaugcuggugccagauguguccucagcauuacaugaacagccuccuuauuugaugccuauccuucuaacaggguccuccuggcaaucgugguucaaccggcccugcuggaauccgagguccuaauggagaugccggucgaccuggggaaccuggucucaugggacccagaguaaguuucagauaaguccucauaaaguccuaucaggaaucagcaccuccuuuaaaggacuguuuaacacugagggguacaacagaaagcauguaaaguaagucuguuaguagacuuguugauguuugccuuuucaacccaacuuuaugagaacuccauagaagguucuaugcaucaggcuaguccauagauuuccuccauguuguuuggaucagugacuaggagggcuuuggaaaacuauaucuauuuuaaaauauccaaauuaauuugguccucuccucagcauguauccuuuaucuuaaguuaugcauuuuauagaagguauucaugauauguauuaagucaguacauuauuaguuuauuagauucaucagugaagccauuuuuccagcaaucacaaagugcuauaaugcauucagcaccacaccagcuauagaggagugaccuuuggauccagagauacucaaauccauagcaauggagucauuuuucccuccauuaucuuuuaugggugaauaucagcuguaauuuuaugccauaaacaaguaauagggaacaacaaauauugcaauaaaaaaaauccaccugggaaauugcuuaccaauauuuuuuucuuccuaucauggauuaaacagcauaaugcauuuugcccauacaauagguugcuuaacacuuucuuaugauaccaauaaaugacucaguugcaaaaaaaugaaauacaaaagaucacacacacacacacacacacacacacacacacacacaccacaggagaaagauuucagaguuuuuuuuuauacuuuccagcaaggcugcuagcucuaaugaaucccccucagcagcaaacaaaaagugagaagagagagcugggugagauuucaauuaaugugagccuugaguguaggagcuaacacacccauaugaaaggacccucauuuauuuuacagggucuuccugggucuccuggaaauguuggcccaucugguaaagaaggcccugugguaaguauugcucauuuuccauuacguuuucaagaacacuuauugcacccuccucaagucuauuuuugaggcuuauuuauacaugaauacauugaaaauaaauaucauccaccucgacaucaucugggaacagaagguaauagauuguaauuacggagccuaaauggaugcagggcugaaagcagggaagggguaaggaaaccaugacugagaaaauugaagcaggugacaaggggacagaaaagggagagggacagauugcgugcaugcaagauugcacugucugucuguguacugacauccuauuuaaaacaggggaauggagucauaauuuauugacacuuuauacaggaagcuuuacgcauacagaaaacuaccuuguuugaucauuugacaaaauccucauccugauagcuggaaaccagggggguggggaauaaaggugaaauucugauuucagggucucccuggcauugauggcagaccuggcccaaucggcccagcuggaccaagaggugaagcuggcaacaucggauucccuggacccaaaggccccucuguaaggaucaugacucucucucucucucucucucucucucucucucucucucucucuacuuauuugcuacaucucugccacaaucaaguauuucucuccugcuccucagcacaguucgccucaaggcagguccucucaccacaagcaaacugcagugcacacauuccauuaaagcuuuaccugcacuguggccugacacacuucugaaaaccugaguuauccaccucuacacacagagucguuuuguacagagcuccacgguacuggguuaugccuugaauaagaaauuugaagcagagaaauagcagugaaauacacaaacaagcaacaaaaucaacauuucaaaauagucauagaaaauugggcauagaaccuuuucuuacauaguuuuccucuccccugaccucucucucaucacuuucuuguaucugccccgacuuuguucccucuugauauuacagucucuuuuccuuuaauauacguguguagguuuuuaaaguuuuuaaauuuuuucuauaauguaccuauuauuuuuauagggugauccuggcaaaccuggugagagaggacaccccggucuugcuggugcucggguagguguuaacgucuacagagaaauuucuuuaaaauugccacuucuuugaggcuaucuggcaucuuuguuacuuuccaaaaugucauccuaagguucuuucaccaccacgaugaaauggcuuuauauugaacuacauggaaaagacagugggcuauaacaaaucagaacaugcuaugcaaagacacagauacaucugguccuuauuuuauucauauuaugauugagagauuaugaacacgugcuaguauucuuugcuuucaaaaacugccuccuaucugugaacuucucuugaaguacaucagaagugaauagacagcuuuuagaacugggugaaacucacagugagcuucuuaaauucuaaaaugauaagcucguuuugaggaauuagcuuucagggugcuucaaagcuuuucaugcuaucugacuucuguauaaccaugagccuuucuguucuauuaaacauuuagggagcuccaggacccgauggcaacaauggagcucagggccccccuggaccccaggugcguagcucccccugcucuuuuccacagcagcguaagcuuugcucuucagggcagccaucuuucaauaguuaagggagcaaauugacaucaacuauauccacugucacuggcaucaaugcuaucucacuuucuucuaugggacuacuguuuguguguuuuuguuuuccaauuaaccucuggcuuccuacauaugcuguaacuaacacuguaauaggaauacuuugaucuaaacaaauguuggcuuuagagucucagcauggacucguaguuucaugacgucaaggggacagucacuaacaucuacuucuaucgcuuaugucacuuucaggguguucaagguggcaaaggugaacaaggcccugcugguccuccuggcuuccaggugaguuaacaggcaugcaagacucugacuuucaccacacuguuccuguccaauucacuguaacaccaccaguccccccagcagcaccaguaccaccaguacccccaguaccaucaguaccacuagagaccccagcaccaccacucagaacaugaguucagaacucaagcaaaagucacaguuauccaaagcagucuuuuucagaguuaccuaauaacacauaacaauguucguuauguuauccucucuguaugccccaguucuuagcagcaccccugaauacagccuuaagauugaaauuuuccugucuuuucaucuagggucucccuggucccucagguacuacuggagaaguuggcaagcccggagaaagggugagugggaugaccuaacuaaaucuaauaauuuaauuuuuaauuccuccuuuaaaaauguccuacugccauguaauuacaauaaaaaagugucauaucucucacacacuaaugauagcagucuaccuuguugguauugaacaaaauaaugaaacaucuuauuuauauuuuguucaaauugccuuauuuuguggaucgacagaaacaucacaauagaaagcaaaagcuauugacuguuucauguaauagccguacuuuuuguuuuguucuuugcuauauuaaaauacaaauuauuuccuucuccauagugaaaacguaaaugcaccgauuuucaaucaaaccagagccugggaaaaaaauugcuuuuaauguuuuucuuggcauucagacaugacacugcuauccacaaucagggucugaguucugagucauuuucucuaauugugaugaaugugccucaauuuaguuacauucuguggccuugucuccuuugucaacagugggccacauuaaagggacagcuggucaguaaugaaagagauacacauggguauacaauuagcuagguaacguacaggauaugaucauuccuauuaagaaggaagugguuguauagcuaagaugugaacggccuugugguguuugggacccucaucacauuaucagagaagauaggcugcuuugucaguuucauaaaagcuaaauaauggcugauuuucugauaccgggucuggcacagacacaucuuugauagcagcgguagucucuuuuugaaaucuuucuauaaagccaaagguuuuguuguacauuagaagguauacuaaagcauugguguguagagcccagacagcuuuauuuucuaaaucagaauauuuuagauaccuuaagcgcaaguaacuguagagacuacacauagaguccaugauuuguuuacucuuguguuuuuaccuagggucuuccuggugaauucggucucccugguccugcugguccaagaguaaguacuaccuaguuaaauuucacuaacacuugccauguuuaaaagaaagagcgcuugccccucauacugugggucaccuuccuuaaaaguaguuccuagccuuuuccauagacaucauccaauuucuaaguuaauaguaaaaauuucugguuagucgaugauauuuccuauucaauaaccuuaugguucaagaaacauaaagggacaaauguaugugugauaguaaauaauuuauauaaacaaaugugaugugccuauuguaguggcugguuuugagccaaguaaauuaauaccuaauaucuaaggugaauauuuauagaauguguuucuauugagaaucuaaagcuagauucauaagucuaguuuuaugaaggaauaacuacuuuuugucuaagcacauuagcauagcuagacuaugguuuuguuuuguuuuaaaucaaaguaucccauuauuuuguuaguuaccuaggaagccagagguuaauuucagaaaccaauaaugccauagaacaaaguuagaguaagacccuuugauauaauugcaauguggaacuaugauauaaauacucugggccauaaaaugcaauguugugaugagguuuagaugcaaauucagaggcauucagcuaaacagauauaaaugaauacacacgcacacacacacacacacacacacacacacacacacacacaaucucuggugaauauccuguuucaucaauauuacaugagguugugauguaacaguauaaucccauucuauccugacauagcuauucaacuaaaacuccaucauccaucuucugacuacuaaguguaucuggcaucugacuuugccuuugaauguagcacagaaaaguccauccccuugaaaguaaaaggauuccaaauguugaguauaacauucccagagcaacaaaguguggaauuucagucccagcacaugagaagcauaugacaucuuagcaguuaucucaggcccuccccccagggcacgaggagggaaaugagagaugaaaauaacaugcuaauuuugcugaaaugugguagaaccccaucuaaaacucuaagcaaguaaggcugugugacacagugucuuugugacuucuaauugcugccuuauagggagaacgugguaccccgggugagaguggagcugcuggcccuucugguccuauuggaagccgaggucccaguggagccccagggccugauggaaacaagguaaaauuauuauuuauagauugauggaaugggcccaugugcuccagaauaaagagauauaauagaagaaugaccauuuuugaaaguuuuuauuuauuuccaauuguguaauuucuaccucaguuacaagcaauaugauuccugugaauauaauuauuccaaaagguaauuuaaagaagaaaaaaaucuuugucuagaagccaagaaugaauucguaugguuuaucccuuuccugauuacacuguucauguuuuguugaaaucucggacuacccuuuacauuucuaggaaguaguuuuuguuguaucaacauccaaccccauacagucaaauuucuagaaguagucuagauuuuaauagucaaacuuauagugauuuaaauuaacuaaauauuacauuuaccccaaaggcacaugucgaaaaguuuguauuccaaaguagauuucuaguuuagggggaaaaaaaagauaagauugcacaucucugaaaaucaagcaacuuuauaugacucucaauucaggccuucaaggggaacaaauguaaagacuagauucaaaaaguuauuucauucugcagaagaugauauuagaggggggaugaaaacaacauaagagaggaaagaagaaaggaauaugaugacauucaguggggcuuuuaagggggucuauucaucucaguggcuagccaacaggcuuuccgugcagagaauuaugaggcuuauuauaaaaauggaagcuacauucuccacucuuauggagacaaucaucucccaaguugauggggucucuuucuaugucacuugccugggcuaagagacuuaucauugaaaagguuugugggcaaacauuuuucaaucucuccauuccauuguuccaccuucuucuuguccaugcuugucuuccuuaagaggacaagauacagguuguagaagaauagcaggcacccacucucuguccucuucuuuuuagccaucgugucauuaauagcaggcccccaguuccauccuucugccuuucaaugaugcuccuuugugucucuaugcagccaagaaugccaucuacuaaguguuuaaauuggaauucuucaagaguuucagucuuggcuuucuucuuuugcuacugaaauaauugauuucacaugguuuucauuccagggugaagcuggugcagucggugcuccaggcagugcuggugccucugggccuggugggcuuccaggagagaggggugcugcuggcauaccugggggcaaaggagaaaagguaccacucgguguuagaccuugauacauaauauccaugaacuccaggcaagaaggcugugcgaggaugcacaguuguuuaccauucauagcaggcggucugguagcauuuugacaucuauaugcaccucccucugccacccagcaccuacacaugucuaaacucacuaaucuggcaaaauuccuugcuaccauggaauuucaugcaagcagaugguguugaguaauacaugaggcucauuuuaaugccacuaacaauaaugccucauccugcccuaauuaauggaagaagcuauaucaaacagcuguucaccgugcuauggcauucauuauguuauaagagugaccgggcaccacagcccgucgccauguugucuugugauuccaaccucaucaauuugaaacuugcuucgugaugaaucagagggauguuuauuuuuuaguguucgguaguccucugaaaggggccagaaaagaugaacuuccgacuguuuuucucauucaacauccuacaaaguggugggaaacugaaaaacacugaaauucuaaaaggguggccagcauuauagaaauuuuugucaaagcacuuugcaguucauuuccacucagaaguugagcaggaaagcaaaauguggcucuugcuuuguacuuccagggugaaacuggucuccgaggugacacuggcaacacugguagagauggugcucgugugaguagaagcuuguuuuuaaugcuugcuuguucuuaaauuuccucuuguuuuuuaguaucuuauucccuuugaauucagccaauuuacaaaggagacuuaaaaaggaauucacuuugaguaaaaucucaauccauuaucuccuagaucgcaaacaauaucaucuuacauacuccaaaagaaaaugggagcaugacacaccuuugaaaaucacaucuugacuuagucuacguucuuuaguacugaguauggcaacacuaagcugcacaccgaaaguugcagguuuugaagaccacuccuugaaaacagagcuuuuagacaaacaauucucucauuaaaaaaaaaaaagccacagcccccaccaagguauuacuacucauugguccaccccaggaacugaucuaagggcagccucggaaauuaucugugacuaccuuaagugucacagaugaccccuagggaaaucucauugccuucaugagcugccauuacucugucaccucucccuccaagcugagaacucgcuguaaugcauucccaguauccuuugccuugagucaccugguuguuaacaguuccaaauaaggcuaugcauuugcuucccuccagggaaucuuacaagggugacccaaacccuccuccugcucuggccuuccacauuuccagaacccaguucuuucuuccugaacugacuucugagaaccuugaugacaagcaccagcaaggauuagaggcuuucucaguagugcgcucucauucacuugcacccauugaguggcuacaugccacucaauguggaggucaaaggacaagugaugaguguugcuucuuuccuucgauggaucccauacggauccuauggauccaacucgggucaucagacuuggccgcaaacaucuuuaccugcugaaucaucuagcuggcccucgggaucuuucuugaugucuuaccacaaugugcaauacaguuguccugcgcagcaggacagaguucaauuaagaugcugugcauuauuuuuaguaagaccuuuuuccuucugugguguucuagggcauuccuggugcuguaggugccccugguccugcuggggccucaggugaccggguaaguacgcauuugaaaugaguuguauagguuuucauugaguuguagcucucugaguugauagcaguauguaaaauucccugcuugcccuagucccaaagauccuuugcaauucauuuuuauggcugggucuaaaaccuguuuauuaaaaaaaaaaaaaaaaaaaaaaccuagccuuugcaggaaacaaaugcuguucucuuccccugccuauggaugugccagcugucugaucuauaccuuaagcccuaucauuuguuuuaaagacuuucccugcugcccauuaacaauauccuaaugcacugagccuccuuaaagccuucaauuguaaaaaggggaaaaaaaucaauaaaauacauagugugcccauuucacaucgaacaaacaguccuuuuaaaauagaccuuauuuauugaauugcaaagauugcagcaaauagaucaguccugcaucuaucuaaaaauuaaaauguccuccuccugguguuauggggacugauuuauaguguuucugcaagugaagaaccaauaccacuccaccuuuuaaaaugaagccagccuuaaguagaggaagaauucaccucauuuuauucucugaaauguccauuagucucuuccaagguaacugcaaagcgugaaaacaacccucuuucuaccgcucuucucucuuccuccccucaucuaugugaggcccauuaagcgacucaccacugcucuuugguaccauuacagggugaagcuggugcugccgguccuucuggcccagcugguccucgggguagcccuguaaguagaaaccacagcuuuuuggauauucauaguucaugguuuacagacaucugagaggcugugagugugaugucuuuaucucccaccuagggugaacguggugaaguuggcccugcuggccccaauggauuugcugguccugcugugaguaucauauuaagggagauuaagaugacaucacagugagucagaaggccagugcucacugcuguuucuuccaacagggugcugcuggccaacccggugcuaaaggagagaagggaaccaaagggccuaagggugaaaauggcauuguugguccaaccgggucuguuggagcugcuggcccaucuguaaguuaaauucacuguugaccaauauacccaagcauuuguauaauccaauaugugcccauuaagugccuacugucuauuaagcauuccagauaaaagauuacagauacacacacacacacacacacacacacacaaggugguuugccagacaggguuucucuguguagcccuagcuguccuagaacuuacucuguagaccaggaugggcucaaacuuagagauccgccugccucuaccuuccaagugcugggauuaaaggcaugugccaccacacccuacaagacuuuuuuuuuuuuuaaaucacauuuaaacaccauguaaaaguuuugugaauaucuuguuuucaugcuucaguaauccaugggguguuacuuguugggacagaacauuuauuucuuucaugugauguagauaacuguguuucauuucuaaauuuucuucaaggguagaggagauagcuaaggaugagucaugagaaaacaagugugccguguguaagaguuacuuguuuugugauuugaagccacccuuuuugcuuucauuuaggguccuaauggcccaccugguccuguuggaagucguggugauggagggcccccugugaguauuuacaauugacucuucuuucuuagcuuacguauuagugacaaugugaaaguuucagcauucugguggauuuggacugugaaaaguagaggcuugagaguccuguucauucgaaucuaaucagaaaaguuaugaaguucaccaguaccgagcuuaaagucgacuacacgggcauugacugaaucccagaaagaacucugggugggcaucagagguugcuacugccccacgagggaauaagcaaggucaaauucaggcgguuuaacugggaaauagaacaacucuucugacugaccaagucuccucaucucagguuuucacaccaacucccuagagacucagagguccccagaaugaaucccucuaacgguuucccuccuuaggcaauacuuaauacucugacucaauuucauacuuccuucucuagacaacacuccuuuuucuaguguccccacccucucacccagccaaguggucaauaaaaauucacauacccuaaugaaaauagcuuauauucucucaucucaccaucagauaaccugcuagccuuucaguaaguacuaacaaucuuaguguaaaauucaggcauuacaucuaguagcauacugaagauguauagacuauuagagccuucaggacccuaguuaagugcuccucuaccuugagcuaagggacggcucuucuaugguccaucuuuagucacaugauaauuuuccaaagggaaaggaucuuguuuuauccuaauucauagaguugacuugacugaguuugaaugugcuugguucuuaggguaugacuggcuucccuggugcugcuggacggacugguccccccggacccagugugaguacaucauucccaguauaacuccauuuacucucaccagaaggccaggccucugguaggaaauuaggggagaacauaucuauuuaaacaaauuauuaauauuugcuaguacucuccugaguuaaaauuaucuuugaugaaugauuaagacaaaagucauugcaaauuuuauuuuaaaauaucaaucuaaguacuguuauucauauaaauaccagcacccuuuggaauccacaaucgcuuuuuacaaagaaaaaugcaacaggaauuuuggucacauaucugguauuucucugccuaauuacccuuuauagcuaacauucugccuccauucuaaagcuauaauuguuccugaauuuaaagguauuauggucucuaacuuaauucucauucagacccuccugucaggaauuuaauuaauuaucaaggauuaaguauuccaguugagguuucaggggaaaagaaauagcaaagauguugauuucuuggaaucuuuuacacauucauaacagaaaaaaaaucuucauuccuuguaggcauuuaauuaaaccuagucaggagcacaugaguuccucaguuaugaacagaaugccaggguuggcuuugcuuaagaagaaaugggcagaaucugcaagaauccaaagucccuuucaacuaagacuuaaaucaccaaacuuaaaucucuuccugguucugaccccaacaugccagaguaccagugauaugacaugucuugccuucaucacuaaaacuucccacuaauucugccucaucaauuagcuuuacuacaggcaggaagaagaauuuucaaaguuccaaaaaugucugggauauuauuuuucagagugauguuguucaaauccuauuaucaaggagcaaggcagcuccccuccagaucugcaacaacuaauagaaaacaaaugaccuuauacauuugaucacaggguauugcuggccccccuggccccccuggugcugcuggaaaggaagggauucgugguccccguggcgaccaagguccaguuggccgaacuggagaaacaggugcaucuggacccccuggauuuguuggugaaaagggucccucuggagaaccugguaccgcaguaagugauuucaaacuccuuucucuccauacuuauguugaguuagaauaaagccccuuuacaaauccucaagugguauauaucuauuagugaguaaugcaggcucuccaguugagcucaguugagccaggaaaucuguccagcacgcaauaagguguuguggugguagcagaugcacagaaagcagauaauaagaaugacagaggacgagggaaugcggcuucacugcaauggcccuuucugcucuugagggacggaagaaugaacacagaauccuacugcuguggccagccuucuguaaauuaaucaagcuucauaaccugccgucccuuaaacacuccugguucagaguuccugcaguucugcaaagcacccauguuagaccuucgaagucaaggccaaaauuuucuucccugcauagagucuauaaagaauaaauccacacccccaaugauauuaaugauauuaaucucaacuacauauauacauauauacauaccaaaguguaaauuuauugucauccucagaaagaaagacauucaaggaugugucccaccaauuagaagucacuggucuguuccugaauccaggagcccuccuuuucacaauccuugagcuaaucuguauuaugagauagggucuuaccaguaauaaucaguauuuuuucucucaucuagggagccccugguaccgcagguccucagggucuucuuggugcucccgguauucugggucucccuggcucuagaggugaacguggucugccagguauugcuggugcucuggugaguuugacgccauucugauucucauuaccauaauaaaagauuuuaaaagcugccacuucaaaugugacagauugaucgcugaauaacuccacuuaagauuuucuacucauggcauuuucuuuauacagauugcaugucaccuauccaggaagcuucaauacugccuuacuuagacacaugcuauaaagacccagcuuaacauuaugcagaugauuuuuguucuuucuacauacuuaagaaugacauaagcuuuaauugcauuuccuucucugugaugugaaauccuggcaucauuuauccccucaagaagaauggaacuguucauaggaaguucaugaaucguuucguuuaacccuauacaugacaacagcuugaaaccgucuuuuacccaggaacuaucagcuuuaugaauuaauuuuauuuguggugcauuggaucccaucagaccuuccucucacucccagacacagccacauccacagaacugauccacagaacagaucccuggaguguagggaagacagagaaaggccaucuugcaggggugauucuuaaucauguugugauccaucugcauuccacuugccuucucucuuuuaacuagaauuuucugggaguuguuuuugcuaugugagaucagcauucugccugaagauagugaugucauuuuauguucucugccacucuagggugaaccugguccucugggcaucucaggcccuccuggugcccguggucccccuggugcugugggcagcccuggaguuaauggugccccuggugaagcuggucgugaugugagugcaguacuugguuuguaaaauaaaaccaagcaggauuucauguguggaaaugagguuucaugccccgaguuuccaaacuagaucaucuacuucuccauauaaugagccugcuuugcaguaaagcuggcaggauugcuuggguaggaaaauugucuuuuacuggcagacuguaaauuggggcuccaauauuuaaaauaccucuaaaauaauuaggagguuuuugcuccccuuuuuuuuaacugaacccugggaauaagggcagaguagcauagacagcgaggcuaauggaucacagaaccucaccaacgugucuucauuugcaugguauucucauaggguaacccuggcagcgauggucccccaggucgugauggucagccuggacacaagguuaguagacuuuuucaccuuucucuaguuuaagacugaucaaacuacccgacaaauugauuaaugcuaagcuuuacuucugccuugguagggagagcgugguuacccuggcagcauugguccgacuggugcugcaggugccccugguccucacgguucuguggguccugcugggaaacauggaaaccgaggugaaccuguaaguauguaaauguugucacccuuguggacuuuccugugaccucaugcuugagcacugaggccauuaagaggaugaccuuggccuugacugaugacaucuccuuuucuuuucuaauucacaggguccugccgguucuguugguccuguuggugcuguugguccaagagguccuaguguacguacauggugaugauuaacacuuaagaauuaagaagaaugauucuaaaccaucuacuuauacaauagauaauguagaagcuaaacuuugguacuuuaguccauggugagaagggauucagaugacuuuauugauuugaagucuauucugcuuguuuguauuuguuagucguaacuaacugcucaguuaaaggagauggcagagaagauggcagccaaguuagaccuuugcaugucucaagcuuccuuuguaaauggacuaaacacccuuugaagaggaauaagugauauuguucuaaaagaguagaaacaucucuuucucuuuguuuauaggguccucaaggcauccgaggugacaaaggagaaccuggugauaaagggcacaggggucuuccuggcuuaaaaggauacaguggauugcagggucuuccuggucuugcuguaagcaaaaagugaucuucuugcaugaauucuaaccugaauagccuucagaugcccacugucacaguguaaaacacccuaccuucuagauccauuccaauucuccagcuaacucuaccucucucagagaggauccgauuucauaguauaacacaaagagguaaggguuaaaggagccagaaacguccguguauuaacaucuccuggcaacaguguccuucaacugcacuuaaaauauauauaauuagaaggaugacuaauauggcacuguucaaauagcuuguggaagaaauaauugagcauaauagauauaauggaagaaaagagcuccacuuuacauucucaauuuucucaaucuagaguccacuggaacgaaaguuuuccauucaauuugggaagaaaaaaaaaccuauuuacugacucauguucugaaaguaugauuuuuuuuccucuguucucucuuugaagggccuacauggugaccaaggagcuccugguccuguggguccugcuggucccaggguaagugaaucacaauuaacguucaccucuugaacuaaagaauuauccaggcagugagcccuaggcuacugcuacccgugggguuuuacucauucuuaagcacucgguauccuuucuuuuuaggguccugcugggccuucuggacccguuggcaaagaugguagaucugggcaaccuggcccagucgggccugcugguguucgugguucucaggguagccaaggucccgcuguaaguaugacuuggaaggguaguuuagggccucccugaccaaagaaaugcuuccuucagacuaaacugacaagaauuugauagcacacaggaguagauccacgucaguagcucucugaaaaguuuguuaacuguauaugaugggcuucuucaaaccacugcuuugagacugugaucaaguagucuguuuacauaagguuguuucuuucucucguauuagagcacguacugauacaaagcacacuugaaacuuuccuguccuggcugccucucccacucugagccaguuuaaaauggucucucugacucuuacuucacagggucccccuggucccccuggaccuccugguccuccuggugucagcggagguggcuaugacuuugguuuugaaggagacuucuacagggcugaccagccucgcucccagccuucacucagacccaaggacuaugaaguugaugcaacucugaaaucucucaauaaccagauugagacccuucucacuccugaaggcucuagaaagaacccugcucgcacgugccgggacuuaagacucagccacccagaguggaacagcgguggguugaacauucaaaccacacuggucccucauacgccaaccuuuccaaaaaucuauguccauugaucuuuagaacaaacacguauuugggcccaaaaauucuacacuaucaaaacuuauaccgaguuaaugaaacaucacuuucuuccucugcccacauccacccuuaagucuguuuaguuguuuaucuguuuacuaccaggacuagggauuaaauaucaggccuuagacaugcuaagaaaaugucuaacacagagcuccauccucaggccacguucuacacuuuauuuuaagaccagcucucacuacacuggccuugaauucacucuagucuuagugggucucuuaaguauugauucuccugccucagguggucuaaacauccugguuggauguuucaucaaguaaaaggggacucuuaaaaauagucacccccuucucacuaacugugggauaggugauggaacagcaccaucaaaauguuuuuuaugguaaucaauauuauugagaaauuacuauuauuauuauuauuauuauaaccuacauuuugcaguaaguuuaccaacuggauuuucuuuccuaaacagauuacuacuggauugacccuaaccaaggauguacuauggaugccaucaaaguguacugugauuucucuacuggugaaaccugcauccaggcccaaccuguaaacaccccagcgaagaacucauacagccgcgcccaggccaacaagcaugucugguuaggagagacuaucaaugguggcagccagguacguaauucuccaaguauuccucaucuuccaaaauaugauuuucuuagcaucauuugcuuuuuaauuacuugggcuuuaacccuuuacccucaugagcuuauuaaaagaaacuacucuuuucacaaauuccaauucuauccuagaucacauauuaaaagauuggacucagccaccuaauucaacacuauuauucaaauuugacuuaugggucaucauuggagacauagcuaaugcgauuucauguaaaggugcaccggccggcccagagccccccagcuaugcauauguauuucagaaugcgagcagcuuuucugaauuuuuaaucaaaccuucccacugaugcuaccaaaugacacuagaauccaguacacuacagagaagagaaugaggucugacuccaucucacaguuucagauucuaaugagggaaacauuugcagugaugcauaacugagucagaugcucuucuuggauggcccugcccucccuaggcagagcuuaugguccuuuaacaagugugccaaguuuccuuuaaaagcacccuucuccuaagcccgggcucugacuccauucugucuccuguaugcauguauuuauuugaguuuuaguaugaggcgucuauuuaagaguucacaccuucuucuccauaguuugaauacaacguagaagggguguccuccaaggaaauggcaacucagcucgccuucaugcgccugcuagccaaccgugcuucucagaacaucaccuaccacugcaagaacagcauugcguaccuggaugaggagacgggcagcuugaacaaggcugugcuucugcaggguuccaacgauguugaacuuguugcugagggcaacagcagguucaccuacucuguccuagucgauggcugcuccguaagucaugggaaaauggcgggagaacauuuauuuuuaggaaaugaggugagcgguucuagcuuaggcuauuaaaugaacagaugaaugagaggccuaacuuaauugaccuuucuucuucaagcacauuuaagugcauccaacaauucucugaauucuaauacagaaauucguauuagauaccaccuucuuugcaacucucacacacugagcugacuccuaugcccacacagucccugcuuuccucucagcauuuagaguuccuauguauuaacauauaccaagaauuuaaaacuuauugagguuuaaaaugcuucaguugcaccuuagaauauggcuacauucaauuuuucuguagacuuuuaccuauauaaaagaguauauguuuuauauaauaugcucuaaguuagaauaaaguuuuaaguguaaaauuacuguauaccuacccaauucucuauacauacacagacauacacacaagaugcauacacacaacauacagaaacacacaccacacacauacaagauaugcaaacacaccauacacacauacacacaccauacacucaccuugaaaagaauauguauccaaacauauuugaaacuuauccuaaagaaguuaucauucccugaaagacauccuugacacugucugucuacagugaacgucuuaaucaggaaccccuaucuucagaaaguguuggcugccgagaaauggcuuuccuagaccccgaugcuuagauauaagucaggugcagcuauacuggucugauguauuuuccuuuuuucccauuuuuuucuauuauacagaaaaagacaaaugaauggggcaagacaaucauugaauacaaaacaaauaagccaucucgccugccguuccuugacauugcaccucuggacauugguggugcugaccaagaauuccguguggagguuggccccgucuguuucaaauaagugaacucaaccuaaauuaaaaaccaaaaaccccugaaaaaacuuucucuuugccguuuccuccuuuaaaaaaaaaaacaaaaaacaaaaacugaaagcugaauccuuccaugucuucuaugcaucuacaucuuaaacugugggcaaaagagaaggauuggucagagcagugugcaauaugauccaacuaagucuccucccuuggccccuccccaaaauguuugcaguguuauuuuuguggguuuuuuuuuaacacccugacaccuguuguggacauugucaaccuuuguaagaaaacccaaauaaaaauugaaaaauaaaauaaaaagaaacccaugaacauucgcaccacuuguggcuucugacuaucuuccacagagggaaguuuaaaacccaaacuuccaaagguuugaacuaccucaagacacuuugcagugaguguagaccaucccaaugagaguugaccaaggcugacacgaacugagguacuuguuuuguuuugcuugcaacacaaaggugcuaauuaguaguauuucagauacuugaagaauaugaacggugcuggaagaauuacagaagaaacaauccuccacauugaugugcauugugugugauuuuuaaauuugacuuagcaguccucuuucucaucuuauccccaacuacaggaaugcaggccacuugccccagguucucucuucauuagauucagcauucauucuuuaacagccucauuuuccuucuugcccaugguuccaaagaagucuuguuucuuggacaagcagaaaaauugaauuguaccuauuuuguauaugugagauguuuaaauaaauugugaaaaauaaaauaaagcauuuuugguuuuccaaaagaaaauauugagua

SEQ ID NO: 2828 - RNA, 36732 nt, Mus musculus
uacucaauauuuucuuuuggaaaaccaaaaaugcuuuauuuuauuuuucacaauuuauuuaaacaucucacauauacaaaauagguacaauucaauuuuucugcuuguccaagaaacaagacuucuuuggaaccaugggcaagaaggaaaaugaggcuguuaaagaaugaaugcugaaucuaaugaagagagaaccuggggcaaguggccugcauuccuguaguuggggauaagaugagaaagaggacugcuaagucaaauuuaaaaaucacacacaaugcacaucaauguggaggauuguuucuucuguaauucuuccagcaccguucauauucuucaaguaucugaaauacuacuaauuagcaccuuuguguugcaagcaaaacaaaacaaguaccucaguucgugucagccuuggucaacucucauugggauggucuacacucacugcaaagugucuugagguaguucaaaccuuuggaaguuuggguuuuaaacuucccucuguggaagauagucagaagccacaaguggugcgaauguucauggguuucuuuuuauuuuauuuuucaauuuuuauuuggguuuucuuacaaagguugacaauguccacaacaggugucaggguguuaaaaaaaaacccacaaaaauaacacugcaaacauuuuggggaggggccaagggaggagacuuaguuggaucauauugcacacugcucugaccaauccuucucuuuugcccacaguuuaagauguagaugcauagaagacauggaaggauucagcuuucaguuuuuguuuuuuguuuuuuuuuuuaaaggaggaaacggcaaagagaaaguuuuuucagggguuuuugguuuuuaauuuagguugaguucacuuauuugaaacagacggggccaaccuccacacggaauucuuggucagcaccaccaauguccagaggugcaaugucaaggaacggcaggcgagauggcuuauuuguuuuguauucaaugauugucuugccccauucauuugucuuuuucuguauaauagaaaaaaaugggaaaaaaggaaaauacaucagaccaguauagcugcaccugacuuauaucuaagcaucggggucuaggaaagccauuucucggcagccaacacuuucugaagauagggguuccugauuaagacguucacuguagacagacagugucaaggaugucuuucagggaaugauaacuucuuuaggauaaguuucaaauauguuuggauacauauucuuuucaaggugaguguaugguguguguauguguguaugguguguuugcauaucuuguaugugugugguguguguuucuguauguuguguguaugcaucuuguguguaugucuguguauguauagagaauuggguagguauacaguaauuuuacacuuaaaacuuuauucuaacuuagagcauauuauauaaaacauauacucuuuuauauagguaaaagucuacagaaaaauugaauguagccauauucuaaggugcaacugaagcauuuuaaaccucaauaaguuuuaaauucuugguauauguuaauacauaggaacucuaaaugcugagaggaaagcagggacugugugggcauaggagucagcucagugugugagaguugcaaagaaggugguaucuaauacgaauuucuguauuagaauucagagaauuguuggaugcacuuaaaugugcuugaagaagaaaggucaauuaaguuaggccucucauucaucuguucauuuaauagccuaagcuagaaccgcucaccucauuuccuaaaaauaaauguucucccgccauuuucccaugacuuacggagcagccaucgacuaggacagaguaggugaaccugcuguugcccucagcaacaaguucaacaucguuggaacccugcagaagcacagccuuguucaagcugcccgucuccucauccagguacgcaaugcuguucuugcagugguaggugauguucugagaagcacgguuggcuagcaggcgcaugaaggcgagcugaguugccauuuccuuggaggacaccccuucuacguuguauucaaacuauggagaagaaggugugaacucuuaaauagacgccucauacuaaaacucaaauaaauacaugcauacaggagacagaauggagucagagcccgggcuuaggagaagggugcuuuuaaaggaaacuuggcacacuuguuaaaggaccauaagcucugccuagggagggcagggccauccaagaagagcaucugacucaguuaugcaucacugcaaauguuucccucauuagaaucugaaacugugagauggagucagaccucauucucuucucuguaguguacuggauucuagugucauuugguagcaucagugggaagguuugauuaaaaauucagaaaagcugcucgcauucugaaauacauaugcauagcuggggggcucugggccggccggugcaccuuuacaugaaaucgcauuagcuaugucuccaaugaugacccauaagucaaauuugaauaauaguguugaauuagguggcugaguccaaucuuuuaauaugugaucuaggauagaauuggaauuugugaaaagaguaguuucuuuuaauaagcucaugaggguaaaggguuaaagcccaaguaauuaaaaagcaaaugaugcuaagaaaaucauauuuuggaagaugaggaauacuuggagaauuacguaccuggcugccaccauugauagucucuccuaaccagacaugcuuguuggccugggcgcggcuguaugaguucuucgcugggguguuuacagguugggccuggaugcagguuucaccaguagagaaaucacaguacacuuugauggcauccauaguacauccuugguuagggucaauccaguaguaaucuguuuaggaaagaaaauccaguugguaaacuuacugcaaaauguagguuauaauaauaauaauaauaauaguaauuucucaauaauauugauuaccauaaaaaacauuuugauggugcuguuccaucaccuaucccacaguuagugagaagggggugacuauuuuuaagaguccccuuuuacuugaugaaacauccaaccaggauguuuagaccaccugaggcaggagaaucaauacuuaagagacccacuaagacuagagugaauucaaggccaguguagugagagcuggucuuaaaauaaaguguagaacguggccugaggauggagcucuguguuagacauuuucuuagcaugucuaaggccugauauuuaaucccuaguccugguaguaaacagauaaacaacuaaacagacuuaaggguggaugugggcagaggaagaaagugauguuucauuaacucgguauaaguuuugauaguguagaauuuuugggcccaaauacguguuuguucuaaagaucaauggacauagauuuuuggaaagguuggcguaugagggaccagugugguuugaauguucaacccaccgcuguuccacucuggguggcugagucuuaagucccggcacgugcgagcaggguucuuucuagagccuucaggagugagaagggucucaaucugguuauugagagauuucagaguugcaucaacuucauaguccuugggucugagugaaggcugggagcgaggcuggucagcccuguagaagucuccuucaaaaccaaagucauagccaccuccgcugacaccaggaggaccaggagguccagggggaccagggggacccugugaaguaagagucagagagaccauuuuaaacuggcucagagugggagaggcagccaggacaggaaaguuucaagugugcuuuguaucaguacgugcucuaauacgagagaaagaaacaaccuuauguaaacagacuacuugaucacagucucaaagcagugguuugaagaagcccaucauauacaguuaacaaacuuuucagagagcuacugacguggaucuacuccugugugcuaucaaauucuugucaguuuagucugaaggaagcauuucuuuggucagggaggcccuaaacuacccuuccaagucauacuuacagcgggaccuuggcuacccugagaaccacgaacaccagcaggcccgacugggccagguugcccagaucuaccaucuuugccaacggguccagaaggcccagcaggacccuaaaaagaaaggauaccgagugcuuaagaaugaguaaaaccccacggguagcaguagccuagggcucacugccuggauaauucuuuaguucaagaggugaacguuaauugugauucacuuacccugggaccagcaggacccacaggaccaggagcuccuuggucaccauguaggcccuucaaagagagaacagaggaaaaaaaaucauacuuucagaacaugagucaguaaauagguuuuuuuuucuucccaaauugaauggaaaacuuucguuccaguggacucuagauugagaaaauugagaauguaaaguggagcucuuuucuuccauuauaucuauuaugcucaauuauuucuuccacaagcuauuugaacagugccauauuagucauccuucuaauuauauauauuuuaagugcaguugaaggacacuguugccaggagauguuaauacacggacguuucuggcuccuuuaacccuuaccucuuuguguuauacuaugaaaucggauccucucugagagagguagaguuagcuggagaauuggaauggaucuagaagguaggguguuuuacacugugacagugggcaucugaaggcuauucagguuagaauucaugcaagaagaucacuuuuugcuuacagcaagaccaggaagacccugcaauccacuguauccuuuuaagccaggaagaccccugugcccuuuaucaccagguucuccuuugucaccucggaugccuugaggacccuauaaacaaagagaaagagauguuucuacucuuuuagaacaauaucacuuauuccucuucaaaggguguuuaguccauuuacaaaggaagcuugagacaugcaaaggucuaacuuggcugccaucuucucugccaucuccuuuaacugagcaguuaguuacgacuaacaaauacaaacaagcagaauagacuucaaaucaauaaagucaucugaaucccuucucaccauggacuaaaguaccaaaguuuagcuucuacauuaucuauuguauaaguagaugguuuagaaucauucuucuuaauucuuaaguguuaaucaucaccauguacguacacuaggaccucuuggaccaacagcaccaacaggaccaacagaaccggcaggacccugugaauuagaaaagaaaaggagaugucaucagucaaggccaaggucauccucuuaauggccucagugcucaagcaugaggucacaggaaaguccacaagggugacaacauuuacauacuuacagguucaccucgguuuccauguuucccagcaggacccacagaaccgugaggaccaggggcaccugcagcaccagucggaccaaugcugccaggguaaccacgcucucccuaccaaggcagaaguaaagcuuagcauuaaucaauuugucggguaguuugaucagucuuaaacuagagaaaggugaaaaagucuacuaaccuuguguccaggcugaccaucacgaccugggggaccaucgcugccaggguuacccuaugagaauaccaugcaaaugaagacacguuggugagguucugugauccauuagccucgcugucuaugcuacucugcccuuauucccaggguucaguuaaaaaaaaggggagcaaaaaccuccuaauuauuuuagagguauuuuaaauauuggagccccaauuuacagucugccaguaaaagacaauuuuccuacccaagcaauccugccagcuuuacugcaaagcaggcucauuauauggagaaguagaugaucuaguuuggaaacucggggcaugaaaccucauuuccacacaugaaauccugcuugguuuuauuuuacaaaccaaguacugcacucacaucacgaccagcuucaccaggggcaccauuaacuccagggcugcccacagcaccagggggaccacgggcaccaggagggccugagaugcccagaggaccagguucacccuagaguggcagagaacauaaaaugacaucacuaucuucaggcagaaugcugaucucacauagcaaaaacaacucccagaaaauucuaguuaaaagagagaaggcaaguggaaugcagauggaucacaacaugauuaagaaucaccccugcaagauggccuuucucugucuucccuacacuccagggaucuguucuguggaucaguucuguggauguggcugugucugggagugagaggaaggucugaugggauccaaugcaccacaaauaaaauuaauucauaaagcugauaguuccuggguaaaagacgguuucaagcuguugucauguauaggguuaaacgaaacgauucaugaacuuccuaugaacaguuccauucuucuugaggggauaaaugaugccaggauuucacaucacagagaaggaaaugcaauuaaagcuuaugucauucuuaaguauguagaaagaacaaaaaucaucugcauaauguuaagcugggucuuuauagcaugugucuaaguaaggcaguauugaagcuuccuggauaggugacaugcaaucuguauaaagaaaaugccaugaguagaaaaucuuaaguggaguuauucagcgaucaaucugucacauuugaaguggcagcuuuuaaaaucuuuuauuaugguaaugagaaucagaauggcgucaaacucaccagagcaccagcaauaccuggcagaccacguucaccucuagagccagggagacccagaauaccgggagcaccaagaagacccugaggaccugcgguaccaggggcucccuagaugagagaaaaaauacugauuauuacugguaagacccuaucucauaauacagauuagcucaaggauugugaaaaggagggcuccuggauucaggaacagaccagugacuucuaauuggugggacacauccuugaaugucuuucuuucugaggaugacaauaaauuuacacuuugguauguauauauguauauauguaguugagauuaauaucauuaauaucauuggggguguggauuuauucuuuauagacucuaugcagggaagaaaauuuuggccuugacuucgaaggucuaacaugggugcuuugcagaacugcaggaacucugaaccaggaguguuuaagggacggcagguuaugaagcuugauuaauuuacagaaggcuggccacagcaguaggauucuguguucauucuuccgucccucaagagcagaaagggccauugcagugaagccgcauucccucguccucugucauucuuauuaucugcuuucugugcaucugcuaccaccacaacaccuuauugcgugcuggacagauuuccuggcucaacugagcucaacuggagagccugcauuacucacuaauagauauauaccacuugaggauuuguaaaggggcuuuauucuaacucaacauaaguauggagagaaaggaguuugaaaucacuuacugcgguaccagguucuccagagggacccuuuucaccaacaaauccaggggguccagaugcaccuguuucuccaguucggccaacuggaccuuggucgccacggggaccacgaaucccuuccuuuccagcagcaccaggggggccaggggggccagcaauacccugugaucaaauguauaaggucauuuguuuucuauuaguuguugcagaucuggaggggagcugccuugcuccuugauaauaggauuugaacaacaucacucugaaaaauaauaucccagacauuuuuggaacuuugaaaauucuucuuccugccuguaguaaagcuaauugaugaggcagaauuagugggaaguuuuagugaugaaggcaagacaugucauaucacugguacucuggcauguuggggucagaaccaggaagagauuuaaguuuggugauuuaagucuuaguugaaagggacuuuggauucuugcagauucugcccauuucuucuuaagcaaagccaacccuggcauucuguucauaacugaggaacucaugugcuccugacuagguuuaauuaaaugccuacaaggaaugaagauuuuuuuucuguuaugaauguguaaaagauuccaagaaaucaacaucuuugcuauuucuuuuccccugaaaccucaacuggaauacuuaauccuugauaauuaauuaaauuccugacaggagggucugaaugagaauuaaguuagagaccauaauaccuuuaaauucaggaacaauuauagcuuuagaauggaggcagaauguuagcuauaaaggguaauuaggcagagaaauaccagauaugugaccaaaauuccuguugcauuuuucuuuguaaaaagcgauuguggauuccaaagggugcugguauuuauaugaauaacaguacuuagauugauauuuuaaaauaaaauuugcaaugacuuuugucuuaaucauucaucaaagauaauuuuaacucaggagaguacuagcaaauauuaauaauuuguuuaaauagauauguucuccccuaauuuccuaccagaggccuggccuucuggugagaguaaauggaguuauacugggaaugauguacucacacuggguccggggggaccaguccguccagcagcaccagggaagccagucauacccuaagaaccaagcacauucaaacucagucaagucaacucuaugaauuaggauaaaacaagauccuuucccuuuggaaaauuaucaugugacuaaagauggaccauagaagagccgucccuuagcucaagguagaggagcacuuaacuaggguccugaaggcucuaauagucuauacaucuucaguaugcuacuagauguaaugccugaauuuuacacuaagauuguuaguacuuacugaaaggcuagcagguuaucugauggugagaugagagaauauaagcuauuuucauuaggguaugugaauuuuuauugaccacuuggcugggugagaggguggggacacuagaaaaaggaguguugucuagagaaggaaguaugaaauugagucagaguauuaaguauugccuaaggagggaaaccguuagagggauucauucuggggaccucugagucucuagggaguuggugugaaaaccugagaugaggagacuuggucagucagaagaguuguucuauuucccaguuaaaccgccugaauuugaccuugcuuauucccucguggggcaguagcaaccucugaugcccacccagaguucuuucugggauucagucaaugcccguguagucgacuuuaagcucgguacuggugaacuucauaacuuuucugauuagauucgaaugaacaggacucucaagccucuacuuuucacaguccaaauccaccagaaugcugaaacuuucacauugucacuaauacguaagcuaagaaagaagagucaauuguaaauacucacagggggcccuccaucaccacgacuuccaacaggaccaggugggccauuaggacccuaaaugaaagcaaaaaggguggcuucaaaucacaaaacaaguaacucuuacacacggcacacuuguuuucucaugacucauccuuagcuaucuccucuacccuugaagaaaauuuagaaaugaaacacaguuaucuacaucacaugaaagaaauaaauguucugucccaacaaguaacaccccauggauuacugaagcaugaaaacaagauauucacaaaacuuuuacaugguguuuaaaugugauuuaaaaaaaaaaaaagucuuguagggugugguggcacaugccuuuaaucccagcacuuggaagguagaggcaggcggaucucuaaguuugagcccauccuggucuacagaguaaguucuaggacagcuagggcuacacagagaaacccugucuggcaaaccaccuuguguguguguguguguguguguguguguaucuguaaucuuuuaucuggaaugcuuaauagacaguaggcacuuaaugggcacauauuggauuauacaaaugcuuggguauauuggucaacagugaauuuaacuuacagaugggccagcagcuccaacagacccgguuggaccaacaaugccauuuucacccuuaggcccuuugguucccuucucuccuuuagcaccggguuggccagcagcacccuguuggaagaaacagcagugagcacuggccuucugacucacugugaugucaucuuaaucucccuuaauaugauacucacagcaggaccagcaaauccauuggggccagcagggccaacuucaccacguucacccuaggugggagauaaagacaucacacucacagccucucagaugucuguaaaccaugaacuaugaauauccaaaaagcugugguuucuacuuacagggcuaccccgaggaccagcugggccagaaggaccggcagcaccagcuucacccuguaaugguaccaaagagcaguggugagucgcuuaaugggccucacauagaugaggggaggaagagagaagagcgguagaaagaggguuguuuucacgcuuugcaguuaccuuggaagagacuaauggacauuucagagaauaaaaugaggugaauucuuccucuacuuaaggcuggcuucauuuuaaaagguggagugguauugguucuucacuugcagaaacacuauaaaucaguccccauaacaccaggaggaggacauuuuaauuuuuagauagaugcaggacugaucuauuugcugcaaucuuugcaauucaauaaauaaggucuauuuuaaaaggacuguuuguucgaugugaaaugggcacacuauguauuuuauugauuuuuuuccccuuuuuacaauugaaggcuuuaaggaggcucagugcauuaggauauuguuaaugggcagcagggaaagucuuuaaaacaaaugauagggcuuaagguauagaucagacagcuggcacauccauaggcaggggaagagaacagcauuuguuuccugcaaaggcuagguuuuuuuuuuuuuuuuuuuuuuaauaaacagguuuuagacccagccauaaaaaugaauugcaaaggaucuuugggacuagggcaagcagggaauuuuacauacugcuaucaacucagagagcuacaacucaaugaaaaccuauacaacucauuucaaaugcguacuuacccggucaccugaggccccagcaggaccaggggcaccuacagcaccaggaaugcccuagaacaccacagaaggaaaaaggucuuacuaaaaauaaugcacagcaucuuaauugaacucuguccugcugcgcaggacaacuguauugcacauugugguaagacaucaagaaagaucccgagggccagcuagaugauucagcagguaaagauguuugcggccaagucugaugacccgaguuggauccauaggauccguaugggauccaucgaaggaaagaagcaacacucaucacuuguccuuugaccuccacauugaguggcauguagccacucaaugggugcaagugaaugagagcgcacuacugagaaagccucuaauccuugcuggugcuugucaucaagguucucagaagucaguucaggaagaaagaacuggguucuggaaauguggaaggccagagcaggaggaggguuugggucacccuuguaagauucccuggagggaagcaaaugcauagccuuauuuggaacuguuaacaaccaggugacucaaggcaaaggauacugggaaugcauuacagcgaguucucagcuuggagggagaggugacagaguaauggcagcucaugaaggcaaugagauuucccuaggggucaucugugacacuuaagguagucacagauaauuuccgaggcugcccuuagaucaguuccugggguggaccaaugaguaguaauaccuuggugggggcuguggcuuuuuuuuuuuuaaugagagaauuguuugucuaaaagcucuguuuucaaggaguggucuucaaaaccugcaacuuucggugugcagcuuaguguugccauacucaguacuaaagaacguagacuaagucaagaugugauuuucaaaggugugucaugcucccauuuucuuuuggaguauguaagaugauauuguuugcgaucuaggagauaauggauugagauuuuacucaaagugaauuccuuuuuaagucuccuuuguaaauuggcugaauucaaagggaauaagauacuaaaaaacaagaggaaauuuaagaacaagcaagcauuaaaaacaagcuucuacucacacgagcaccaucucuaccaguguugccagugucaccucggagaccaguuucacccuggaaguacaaagcaagagccacauuuugcuuuccugcucaacuucugaguggaaaugaacugcaaagugcuuugacaaaaauuucuauaaugcuggccacccuuuuagaauuucaguguuuuucaguuucccaccacuuuguaggauguugaaugagaaaaacagucggaaguucaucuuuucuggccccuuucagaggacuaccgaacacuaaaaaauaaacaucccucugauucaucacgaagcaaguuucaaauugaugagguuggaaucacaagacaacauggcgacgggcuguggugcccggucacucuuauaacauaaugaaugccauagcacggugaacagcuguuugauauagcuucuuccauuaauuagggcaggaugaggcauuauuguuaguggcauuaaaaugagccucauguauuacucaacaccaucugcuugcaugaaauuccaugguagcaaggaauuuugccagauuagugaguuuagacauguguaggugcuggguggcagagggaggugcauauagaugucaaaaugcuaccagaccgccugcuaugaaugguaaacaacugugcauccucgcacagccuucuugccuggaguucauggauauuauguaucaaggucuaacaccgagugguaccuuuucuccuuugcccccagguaugccagcagcaccccucucuccuggaagcccaccaggcccagaggcaccagcacugccuggagcaccgacugcaccagcuucacccuggaaugaaaaccaugugaaaucaauuauuucaguagcaaaagaagaaagccaagacugaaacucuugaagaauuccaauuuaaacacuuaguagauggcauucuuggcugcauagagacacaaaggagcaucauugaaaggcagaaggauggaacugggggccugcuauuaaugacacgauggcuaaaaagaagaggacagagagugggugccugcuauucuucuacaaccuguaucuuguccucuuaaggaagacaagcauggacaagaagaagguggaacaauggaauggagagauugaaaaauguuugcccacaaaccuuuucaaugauaagucucuuagcccaggcaagugacauagaaagagaccccaucaacuugggagaugauugucuccauaagaguggagaauguagcuuccauuuuuauaauaagccucauaauucucugcacggaaagccuguuggcuagccacugagaugaauagacccccuuaaaagccccacugaaugucaucauauuccuuucuucuuuccucucuuauguuguuuucauccccccucuaauaucaucuucugcagaaugaaauaacuuuuugaaucuagucuuuacauuuguuccccuugaaggccugaauugagagucauauaaaguugcuugauuuucagagaugugcaaucuuaucuuuuuuuucccccuaaacuagaaaucuacuuuggaauacaaacuuuucgacaugugccuuugggguaaauguaauauuuaguuaauuuaaaucacuauaaguuugacuauuaaaaucuagacuacuucuagaaauuugacuguaugggguuggauguugauacaacaaaaacuacuuccuagaaauguaaaggguaguccgagauuucaacaaaacaugaacaguguaaucaggaaagggauaaaccauacgaauucauucuuggcuucuagacaaagauuuuuuucuucuuuaaauuaccuuuuggaauaauuauauucacaggaaucauauugcuuguaacugagguagaaauuacacaauuggaaauaaauaaaaacuuucaaaaauggucauucuucuauuauaucucuuuauucuggagcacaugggcccauuccaucaaucuauaaauaauaauuuuaccuuguuuccaucaggcccuggggcuccacugggaccucggcuuccaauaggaccagaagggccagcagcuccacucucacccgggguaccacguucucccuauaaggcagcaauuagaagucacaaagacacugugucacacagccuuacuugcuuagaguuuuagaugggguucuaccacauuucagcaaaauuagcauguuauuuucaucucucauuucccuccucgugcccuggggggagggccugagauaacugcuaagaugucauaugcuucucaugugcugggacugaaauuccacacuuuguugcucugggaauguuauacucaacauuuggaauccuuuuacuuucaaggggauggacuuuucugugcuacauucaaaggcaaagucagaugccagauacacuuaguagucagaagauggaugauggaguuuuaguugaauagcuaugucaggauagaaugggauuauacuguuacaucacaaccucauguaauauugaugaaacaggauauucaccagagauugugugugugugugugugugugugugugugugugugugugcguguguauucauuuauaucuguuuagcugaaugccucugaauuugcaucuaaaccucaucacaacauugcauuuuauggcccagaguauuuauaucauaguuccacauugcaauuauaucaaagggucuuacucuaacuuuguucuauggcauuauugguuucugaaauuaaccucuggcuuccuagguaacuaacaaaauaaugggauacuuugauuuaaaacaaaacaaaaccauagucuagcuaugcuaaugugcuuagacaaaaaguaguuauuccuucauaaaacuagacuuaugaaucuagcuuuagauucucaauagaaacacauucuauaaauauucaccuuagauauuagguauuaauuuacuuggcucaaaaccagccacuacaauaggcacaucacauuuguuuauauaaauuauuuacuaucacacauacauuugucccuuuauguuucuugaaccauaagguuauugaauaggaaauaucaucgacuaaccagaaauuuuuacuauuaacuuagaaauuggaugaugucuauggaaaaggcuaggaacuacuuuuaaggaaggugacccacaguaugaggggcaagcgcucuuucuuuuaaacauggcaaguguuagugaaauuuaacuagguaguacuuacucuuggaccagcaggaccagggagaccgaauucaccaggaagacccuagguaaaaacacaagaguaaacaaaucauggacucuauguguagucucuacaguuacuugcgcuuaagguaucuaaaauauucugauuuagaaaauaaagcugucugggcucuacacaccaaugcuuuaguauaccuucuaauguacaacaaaaccuuuggcuuuauagaaagauuucaaaaagagacuaccgcugcuaucaaagaugugucugugccagacccgguaucagaaaaucagccauuauuuagcuuuuaugaaacugacaaagcagccuaucuucucugauaaugugaugagggucccaaacaccacaaggccguucacaucuuagcuauacaaccacuuccuucuuaauaggaaugaucauauccuguacguuaccuagcuaauuguauacccauguguaucucuuucauuacugaccagcugucccuuuaauguggcccacuguugacaaaggagacaaggccacagaauguaacuaaauugaggcacauucaucacaauuagagaaaaugacucagaacucagacccugauuguggauagcagugucaugucugaaugccaagaaaaacauuaaaagcaauuuuuuucccaggcucugguuugauugaaaaucggugcauuuacguuuucacuauggagaaggaaauaauuuguauuuuaauauagcaaagaacaaaacaaaaaguacggcuauuacaugaaacagucaauagcuuuugcuuucuauugugauguuucugucgauccacaaaauaaggcaauuugaacaaaauauaaauaagauguuucauuauuuuguucaauaccaacaagguagacugcuaucauuagugugugagagauaugacacuuuuuuauuguaauuacauggcaguaggacauuuuuaaaggaggaauuaaaaauuaaauuauuagauuuaguuaggucaucccacucacccuuucuccgggcuugccaacuucuccaguaguaccugagggaccagggagacccuagaugaaaagacaggaaaauuucaaucuuaaggcuguauucaggggugcugcuaagaacuggggcauacagagaggauaacauaacgaacauuguuauguguuauuagguaacucugaaaaagacugcuuuggauaacugugacuuuugcuugaguucugaacucauguucugagugguggugcuggggucucuagugguacugaugguacuggggguacuggugguacuggugcugcuggggggacuggugguguuacagugaauuggacaggaacaguguggugaaagucagagucuugcaugccuguuaacucaccuggaagccaggaggaccagcagggccuuguucaccuuugccaccuugaacacccugaaagugacauaagcgauagaaguagauguuagugacuguccccuugacgucaugaaacuacgaguccaugcugagacucuaaagccaacauuuguuuagaucaaaguauuccuauuacaguguuaguuacagcauauguaggaagccagagguuaauuggaaaacaaaaacacacaaacaguagucccauagaagaaagugagauagcauugaugccagugacaguggauauaguugaugucaauuugcucccuuaacuauugaaagauggcugcccugaagagcaaagcuuacgcugcuguggaaaagagcagggggagcuacgcaccugggguccaggggggcccugagcuccauuguugccaucggguccuggagcucccuaaauguuuaauagaacagaaaggcucaugguuauacagaagucagauagcaugaaaagcuuugaagcacccugaaagcuaauuccucaaaacgagcuuaucauuuuagaauuuaagaagcucacugugaguuucacccaguucuaaaagcugucuauucacuucugauguacuucaagagaaguucacagauaggaggcaguuuuugaaagcaaagaauacuagcacguguucauaaucucucaaucauaauaugaauaaaauaaggaccagauguaucugugucuuugcauagcauguucugauuuguuauagcccacugucuuuuccauguaguucaauauaaagccauuucaucgugguggugaaagaaccuuaggaugacauuuuggaaaguaacaaagaugccagauagccucaaagaaguggcaauuuuaaagaaauuucucuguagacguuaacaccuacccgagcaccagcaagaccgggguguccucucucaccagguuugccaggaucacccuauaaaaauaauagguacauuauagaaaaaauuuaaaaacuuuaaaaaccuacacacguauauuaaaggaaaagagacuguaauaucaagagggaacaaagucggggcagauacaagaaagugaugagagagaggucaggggagaggaaaacuauguaagaaaagguucuaugcccaauuuucuaugacuauuuugaaauguugauuuuguugcuuguuuguguauuucacugcuauuucucugcuucaaauuucuuauucaaggcauaacccaguaccguggagcucuguacaaaacgacucuguguguagagguggauaacucagguuuucagaagugugucaggccacagugcagguaaagcuuuaauggaaugugugcacugcaguuugcuuguggugagaggaccugccuugaggcgaacugugcugaggagcaggagagaaauacuugauuguggcagagauguagcaaauaaguagagagagagagagagagagagagagagagagagagagagagagucaugauccuuacagaggggccuuuggguccagggaauccgauguugccagcuucaccucuugguccagcugggccgauugggccaggucugccaucaaugccagggagacccugaaaucagaauuucaccuuuauuccccaccccccugguuuccagcuaucaggaugaggauuuugucaaaugaucaaacaagguaguuuucuguaugcguaaagcuuccuguauaaagugucaauaaauuaugacuccauuccccuguuuuaaauaggaugucaguacacagacagacagugcaaucuugcaugcacgcaaucugucccucucccuuuucuguccccuugucaccugcuucaauuuucucagucaugguuuccuuaccccuucccugcuuucagcccugcauccauuuaggcuccguaauuacaaucuauuaccuucuguucccagaugaugucgagguggaugauauuuauuuucaauguauucauguauaaauaagccucaaaaauagacuugaggagggugcaauaaguguucuugaaaacguaauggaaaaugagcaauacuuaccacagggccuucuuuaccagaugggccaacauuuccaggagacccaggaagacccuguaaaauaaaugaggguccuuucauauggguguguuagcuccuacacucaaggcucacauuaauugaaaucucacccagcucucucuucucacuuuuuguuugcugcugagggggauucauuagagcuagcagccuugcuggaaaguauaaaaaaaaacucugaaaucuuucuccuguggugugugugugugugugugugugugugugugugugugugaucuuuuguauuucauuuuuuugcaacugagucauuuauugguaucauaagaaaguguuaagcaaccuauuguaugggcaaaaugcauuaugcuguuuaauccaugauaggaagaaaaaaauauugguaagcaauuucccagguggauuuuuuuuauugcaauauuuguuguucccuauuacuuguuuauggcauaaaauuacagcugauauucacccauaaaagauaauggagggaaaaaugacuccauugcuauggauuugaguaucucuggauccaaaggucacuccucuauagcugguguggugcugaaugcauuauagcacuuugugauugcuggaaaaauggcuucacugaugaaucuaauaaacuaauaauguacugacuuaauacauaucaugaauaccuucuauaaaaugcauaacuuaagauaaaggauacaugcugaggagaggaccaaauuaauuuggauauuuuaaaauagauauaguuuuccaaagcccuccuagucacugauccaaacaacauggaggaaaucuauggacuagccugaugcauagaaccuucuauggaguucucauaaaguuggguugaaaaggcaaacaucaacaagucuacuaacagacuuacuuuacaugcuuucuguuguaccccucaguguuaaacaguccuuuaaaggaggugcugauuccugauaggacuuuaugaggacuuaucugaaacuuacucugggucccaugagaccagguuccccaggucgaccggcaucuccauuaggaccucggauuccagcagggccgguugaaccacgauugccaggaggacccuguuagaaggauaggcaucaaauaaggaggcuguucauguaaugcugaggacacaucuggcaccagcauuaucaagguccuuccuggaaaguaagugaugagugacucaccauuacaccagcucugccaucagcuccaggaagaccucgagaaccagggcugcccugcaggaaagggcaugagauggcaggagauuagagaaaucuuuagaucucaucagauagaguuuccuaagacagggcaccauuucuccuaagaggaaagauaugggugcacaccaagccaaaacauuuuacccaaaugccaagggaaugcacagaugagcauccugcaaaaauaggucaacacuguuuccagaccaauuuaauaacauacuaaauugagaguugcuaauguaauaaaacagauggaagacagaugcucuuucaucuaggaaacacaugcagaaaugcugaccaauucccagccaagggguggcaucagggucugcugugucuggaggauucagaacuuacucuaagcccuggaggcccugcagggccagcagauccagcuucuccgggagacccucucuuuccuucuucaccgcugggaccaggaggaccuugggcuccaacagagcccuguuuuuuuuuuuaagaauaagaagaguagaaaaauauuuuuacaucauauccaguuacugaaauuggauugaaaacugauacgaauaaguuaacacaacugugacuguaaaaccacuuacaggcucacccuuguuaccggauucuccuuuggagccagcaggaccaggcucacccuaagauccaaaggaaacagaggucaaaugacagaaaugggucaagccucuccagcagagaagucuguuggguuguuuaagcucaaguucucuacaaugguauugguguguggcuaagacucacacaccgaguuuaccucauugauuuuuuuugcaagcuucuaaggaagaagcuuacgugcaugcacagaggaggggcuaugcaagcacauaaugcagcuauagaagaaagauaaacguuugcacaaauuacagaaggaagacaaaaaaaguugcaagaaaaagucaaaguacagauaaaauauguucugguggugaccacuuacaacaaguccucuggcaccuguagcaccagcagcaccagcggggccaggaauaccacgggggccagggagaccgggagccccagcgacaccagggagucccugugggaagaaaaaaggucccucaggagaaagcaggcuguagaggccucccucuuuaagcacaagucagcuacucagauguacuuacaguagcacccuuggcgccagugagcccauuuguuccaggguugcccugugagagaaaggagaaggaaaaacucauugaacgagaauauuucuuacauucuaugacccuaucuucagucuuucucaucaacugucuuaugucaacgacuacuuacaggagguccaacagggccagaaagaccuggaagacccacuucaccacggggaccagcaggaccagcagggccaggguuaccaacgggcccaaguucacccugagaaugaaaguaacaggacagggaauaagcaguaaauaacgagacuguuauugaccauagcaccaacuuuuagggaauuuugucagaacagcaaccauuuaguuucucugguuuaucaucgcaaagacugggcuugacuuucuaguuugcaagccuacaucugacguucuggcaauuagcccuacagucgcugugguuuggucucugcgggaguggcucccacucaguccaggcuagcugggaaagcacauuuuauagugccuucagggagucaguuucuagggggaggcucaucuauacauagugcacagagagguuuacugcaaacguagagugaaaaaacucuucuguaggcauuuuggagguggagguggauuaagggaauugcuuugcaguugucucccucucuacaaccaguacugacauuucagauaguucuaaaggauuuguccaaguggugauagcaaaaaaugcuuuuuaccuugggaccaggagcaccugggaaaccaggggguccagcagacccaaugggacccugaaaucaaagcagaaggcauaagaaauuuccuugaaguagauuagaaaaacaagcacagaguacuaucaagggaagauguucaagguucccaacauuggaugagucuuacucuauucaucagucaguagcucuaggcauuuggaauagccuaugauacuuagaaagggaaacuuccaaagacccccagggaaacauuuggcaaaaauguccaaaauauugucauuuuauaaaaguuaacagagagcuacugcccccacaguuucaaccccuuucuacucgccagugucaggacuuacagcagggccgacggggccaacgcuuccaucacugccucgggcacccuaugaaggaagggaagacggacagucagguggacaucaagcaacucccauuagacaguguucaaaaaagauucaaagggaagaaaaaaaccagacuacuuacagcuggaccaggagcuccgacacgcccucucucaccaggaagcccucgggcucccuagaagcagaaauauuguuaauaaaguccagaaugcugaucuuaaaagagucagaggcagcgcuuacuuugcccaauuucuaacauauguaagaguucacuaagaauacaagugcuguucuaacaccagguaaaaguugaauaugcagagauauaagaaaaaauaucaagaaugcaauaccaagggagauagcaauuaucaaagucucuaaagaagauucagaaugcuaagcaugcacauucagguugccaguggauuggucaauacucacugcuugaccuggaguuccauucucuccaggggcaccggguucacccuauauaugcagaagaaaaauugagucuuuguucaauauauauauauauauauauauauauauauauucacauugcacaauuuuuacucuauuuuaucaguuugagccuuuuguauauuuuaaacauguauuuauacuuauagacuauuucucaaugaucucaggcacauauguuuuuuaaaaauaugaugaggguuuuauuuaaauaugccaaaggcuaagguacuaaauuaaaugugauuauuuaauuguacaccucuccaauuuucuuuuuacauuguagacauuuggaaccaacuacauagauuaggaauauuaauugaaaagagaaaaaaauaauacauuuucuucagggcaaccaaauuuaccaucuucagagguaucugaaugccaauguuauuggcuucauuaagaugaauggaaagucagggcaucacaagagauuuuggagucaccagauuuguuucuuauucugagagcuagguaucgguaaaacacuuuccuucaaggcauuccaguuuagagagagauguugaggagcaaaucaaaggcuuggcaugugcucauuuagcaggugcuggaugacugagcuaucuuuacagcucuaggucuaaggcuggaggugaagaauccacuuuaagaaugacuggcaugagcuuucugaguuugccuuuuaagcacugcacaauugacuuuggaaaagucaugagugcuucguaaccuuaguuuuucccaaaugaugacaucuacaaagugccuuuuagcucuaaaauauugugaucagugauccgagcuauaauuauauuauauauauauauuauacuguggcucaugggagaaugaacuugaccauguccauuuguguggcagugggaaguuagaccagauucuccauauucauguucaucucuggucccgucugcauuuguuacucauuaauuuguaauuacauugguauucacuuuaauaucacauuaucuccuuaauaggaaagagaagauuuuaugguucgaaauguuguucagagaagaggcuagccaagagauaauacacuucugagacuuuaauuaccuaauuaaaaaaaauuuugaagugugcacagauaaaucagaggaaagagguugaaaaguguguugugacaugaauguacccaucuaauuagugcaaggcaaaggagaauuuacacuuuaguagcacacuuuguccuaauauuugguuauauguuuauuuacuuuuauuuugacuacagagaaucaaugacauaagaggagggaaggagauggaggaagaaauuuuaacauuacuuuccauuugauuauuuacauaaacauuaaguuaaauaaacauuagcaauuggccuuugucauagaauuucacugucccaccauugagggauuugaaagguagaugaggagacaagauacuuuuugaaauguggguugucuuuaguaaaauagccuuuuggauagcaauggaagauuuaaaugacuugcuuacagugauccuaacucaguauuuaccuucacacccugugcaccaggcugucccuuuaauccauccauaccacugugucccugaaaggcaaugaacacuuuuaaaaaugcugucauguuguaaucucagucagaccagagucuuccaccuuuacaaugauuacaucuucuagaaagaucccaugguugcagaagaacacaauacaguauuccagcucagcugagcugguuccacuaccccaggcuaaucacuuggucugcacacagcuaagaagggaagggugcuggacaagcuuucuuacaacccucucacccuaacaauuuucugguuuuagauaguucaaguacuuaaaaauauauacaaucuuuauauaaucuauaaucuguaucguguuucugcauuaaucucaguguuugauaagcauuggcuccuuucauuuccagcauuuucaaaauucagacacaugcuuggguucucacuccccucccccaucagcagcauuuuuuuucucauuuagaggaagaagucacucacuuucacgccuuugaagccaggaaguccaggagucccggggaaaccacgagcacccuugggguggggugggagggaaucagagcaaggugaauaauaacauaaugcauucaucuuuccaaaccaauucucaaaacucaaguuugggaucaaaggguguuauguuuuuugagcauggagcuacaaacuacuagcuaugauaugaauaacuaagaugguggcauuaguugaaaaaaacaguuguuagucaaagucuguuugcugucaccaauauuccguuaugaaugugaauaaaauaucuacauucuuuuccugguucuuucuuuugccagaugucuucaaucaaugccaccagugugagugacaucugagucuaccaucagaggcaugcucaugacuaacaauggaccacauccuauugucaacagucucaccugugguccaacgacuccucucuccccaggucuuccggguuuuccagggugacccuaaaacaggaaagcaaccuaaggucauccuucacuuaguaaauuauugugagagaaaggcauacgcaauuuugugggcuagaauacauguuuaauuaacaauuaaaucucuugagcauaagcaaguuaauuaguauuucauuaaaguaauauuucccacauggggagacucaggcaucuugagcauucagcauggaacuuaauuuggcucuagauacuccuacugaaacaggaguauguaaaaguuguuucagaagagcuuaagaguaaacacuuacauccucaccagccuugccaggagagccagcuggaccacggggaccugcaggacccuaagggaaugggagaugcauggagguuaagacuguguucacaaaccgcucuucagagacuuucucuuguuuuaaacagagaaaauguucucaccguuugaccaggcucaccagguucaccagcagguccuuggaaaccuugagggcccuaagguagaggagaaggcacauuuauuuauuaccuaucuaucuaucuaucuaucuaucuaucuaucuaucuaucuaucuaucuaucuaucuggaaguucuggagucaagcucaggucaggcacauuagacaaguccuuggccaucuaucaucauccccagugcacgagagucaugcucaauguucugcuuuuauagaagaauguuucuaggauuuugauacuuacaggggcuccaacagcaccaggagggccucugggucccauuaaacccuguaaagaguauacacauaguuaacaccaaaaagucauauccuuguugggagucucauaaucuggacuggauacacuagauauagaagugauaucucugagccccugaaguuuuuggauggacagaugaaccaaauuuccugcacucucuccugaccuucaguucuucuucuucuucuucuuuuuuuuaaccaaagaaaucuuuugaacucaaugagaauugucuggaggaagucauaaguuccucgagaugugcaaauuuggucaucuggagauuguucuaaggcaaugaagagaacugaucuuugcacaagaacagaccacauaauggcugauaaagaguaucaguuagauuccuuuugucauaugucaccucuccaugucauauguagcuaagaaauugauauguuuauugcuaccgggccauaaauugaaaaagaucaaaaguccuacuuaaugauuaaacagagguuuauuauaaccucaaagaucuuuugaggccuauugaugacugaugaaaaucucaaguguauuacugaggcagccugcuggaggaaucuaucauaggaucuugaaaacauaacacaaugacaguagcuuuucuacuucuucuucuucuucuucuucuucuucuucuucuucuucuucuucuucuucuucuucuucuucuucuucuucguggaacacaaauguaaaguaaaacugaauguuauagguuuuugagcuaaguguaguuuuguucugccucuguagcaaucaacacuuguguagcucaucuguaggaccuaccucccagacagcuaaaaauaccucaugcacaagucuugaguaauuugcuuuuaauacaucaaccaugaggacucugcaguugagccuauccaccuuauuaaaugacuauagugagacacuacauauuuuauuuaaaaagcacauuauuuuaauuaugaggauuauuuauuuuguuuuagaaauggcuucaauguuaaaagaagcugucacuuuucaauaaaaauaauuuuuagguaugcauuaaguauaauuuucuuugacaucaugaauuuuuaauuauauuuauucaucuuucccagguuuugugacaacuucauuuacauaaaggauauuuuauuuuguggagacugugagaugaacccugugggauuuuguagcuauugauuuuccaacaugggaaauuauuuaacacuuuauugcugcccauuuucucucuuuguuaaacacaucucuguugguuacaucugucuguggauugggauguauguagaagcuuaaauuauaucucacugauauuuuaaugugaauucucuuuuugauacuccccagaaaguaguuucaaagacaggggaaucugaaauccauaucaauuucucagauguauguccaccauucuaauuuuuaacauaagaggacaucuacuccugcuuuauuucccacuuuggcucuucuugagaaauggauucuacuuuacaugugaguaaugucuggcauuagcagaaacaacucauuucaaaugucuaagacaaacaaugucgaaagaaugcuucaauuuuucacuucaaauaugaauguuuuaaauuacaaggaaaaaucaggaaauuggaaaucaucaauuaaagcuacauuauuuuacaagugagaguuuuaauuuacagaaaauauugucuugccuuuguaguauauuaguuuacuucggcccauuaguuucagaauaaugucuugugcagauagagcacugauguagagcccagguaaaaguuguguuuaaagaccaugauaacuaacagauaaaugccuuuagaaaacagauaauuagaaucaccaaauugugugcauguuuauuaaauucugugguagugaaucaaucuaauguuuuuacuucugggacauuuucauucuuuccuauaagcuauuguacauuuuucaugaucaugucuauuuucucuuuaucacaucucaguaaugucugguuagaagcuucauuugucagcuaggucaucauccugauacacagggaagcuuuauaaaugguuacagaaaugacgggacguguguggagugacacaaaugcuaaauuugacucauucucuuguauauuggcuuuuaauaaauagucaagacaaggaauuuucaucagaagggagagaaaggaaacauucaagucccugaagguaauucagaacugcugucauuugcugcuagcugcguaaauccacaguguaguucuuaaccugggagggggcaccugguaaguccuugugacuaagaaaguguucuauucaagaacuaaauacacgagccauauauuaucucucaacuaccugcgugauugggggugggggggugggcaagaaguaaagccccggauucuccuguuaugaugaaggaagggacugagcuagaacuuccaucagguucagggggcaaaggaaauccuucugcuuuuuagccgugcuucguauuucaaggaguguggaaagauacagagacauguauagauguuaauauuuugaguuaaauucauuugcuugaguuauagucuguauuuccaaagacuauuuuucagacauagauaucgaacauucuuuuuaggaggcacguugguagagaaaauugaaacuccucaccuggacuucaguuuugauauuuaaauguagaaaaaggaguuguuuucuucugaucuagccuuggaguguugacuuaguuaguauugugagguuuagcaugaauucccuuacagaagcugcuuuuccccccucuaggacaaaaggagacaagccuaccauugguccagggccagaugaaacuccuuugucagaauacugagcagcaaaguucuggagggaagaaaacacacaugaguauauaggucaguggucauacacauacaucuuucauucuucuuucaaucaaucaaucaaucaaucagucaaucaaucaauuaucugaucauauuuaauacucuaauuaauuaauccccugguacuauuuaaaggagagccauguuucaauagaaaugacuuagaauucagugcuggagccgggcguggaggcacacgccuuuaaucccagcacuugggaggcagaggcaggcagauuucugaguucaaggacagccuggucuacagagugaguuccaggacagccacggcuauacagagaaacccugucucgaaaacccaaaaacccaaaaacccaaaaacccaaaaacccaaaaacccaaaaacccaaaaacccaaaaacccaaaaacccaaaaaacccaaaaacccaaaaaccaaaaaaaaaaaaaaccccaccccccccacacacacaaaaaagaauucagcgcugagucccccaccgagacugaaauggagaaccuccaccucuuagccuucagacucaucugccuugagaaaucuguuccuaacacucgucaccuaccuccugacugaggaagauggcuuccuacaccuuuacagucccucagaaccccagcaagugaaacagagcccaugggagcgugcugcauuggcaguugcuacccuagcccagaagucacuaagagacuucuuuguccuggcuggaguuucaaaaagggauauaaagaguuuucaaguuacaggaaaguuaaaaugcccccuuagaagauuaaacuuuuaaaaaauaguucaugguaauaacuucccuguuaaagaucucucuucgagugguaacuguauuaaagaggugcuuuuaaugcacucaguagauaagcaaucauaauaagaucuuugggagagaaaggucuuauuuuacuggcauacaguuggguauuagaauuaggaaucugauucauagugcuaaccaauuaagcaaauauguuuuucuuccugcagugagaccauuuggcacuuauaccauugucaaagacauaaagcuaaaagaagauauuaaugaaaaagggaaauguacuuuucucaauuuaguuucaaggaaauuaaaccuagaacugcuuugaauguuuguucagcagacuccaagccaaggagaauagagagggucagauguuugugaaauugcuuaagaccaggggcuucacuuauguaauucaaucuaaucaaccucuuuaauaaugcaacaccucuuauuugugccgaacugauaaaagauauuaaauccccaaauuaaauaauggugcagaaggcugcagcuaccuucagugaacaaaaagaccaggacuguaauugacaagacccugaggaagauggaaaaagcagaaccuuaaacucagaaaccaaagaaauuaaauaaaauauacucauuuccaaauagaagguuuucccuuaacugcuaaaaauuaauuuucgcagugaguauuucuuuuccaacagagcaagacacuaaagucagaccuaagauaagaauguauaaguuaucuuaccccaguaagaccagggggggcaggggagccgggaggaccaggggagccagggggaccaggagggcccaugggaccaucaacaccaucucugccucggggaccugcgggacccuguuacaaaaaagagggaauuggaacaggauuagagcaaucuuguggaaccauguauagaauguggaaagagaccuaagaacacacaugcuaaggucagucuguuagacuuguugauguaaaaggguagaaauauaagaucugucgcugacugaugugcaccugugacuucguucaggaagacauuuaaggcugaugugcaaagauaacuaguggcagcuaagccaguguagacccuguguauuaauucacgauggagcagauucugugagugucacagguuuccagccguaggaaaugacacuguguacauuaaagcugacuuuuguaaagguauccaauugcuuugguggugauaugugaaggguaggcugacugguuagaucauuuuaucacagagaugggaagacugcuugcuuuaacacuauccauguuguuaggauaacuaaccgacacaauuauacaacuaauacagugagcagaacacauguaaguccacauaccacgacagauacaugaugcaguuauuuauuauauaaugcaaaucaugcaaaaacaguuuagugacacauaucaccgaaauguagcaaaaauguagcaaauagacuagcagcccgguguguacaugucugaaugaagauagagaagcaugugacugcuucacaauuauuuccaaucuaugcagagauuuuuuuuuucaaaagaaacaaaacauguuacaaagaagguucugugguagaggguacauucccauuacacguguauugugcaggccaaacuaaacaaagaaagauagacccugcaaagaauguggcugccuguaauaguguuucuuuuuaugaaagaguaaucuugacugaaaggggauauugauuauauauaauaauguucauuuacuucuucugcaggacauuaucuacuuaaaaggugguauaauuaucugaauaugaaauaaucuuacacauuguccaccaucuguagcgucuaauauguaguuauucgaauaugggccaaagcccuuuaaugauuuaaaaaaucacauacccuuuguccacgugguccucugucuccaguggggcccuaaaggaagacaaaaauggcaaagggccacgugacuaaguaauugaugcugaacaagcaagccaauuuugaaaauaauuagcuacuaagacugaguugacuaaaauauuacuaaacagcagcuagaagaucuggcacaaaacaauagauaacaaagaacuguuuuuuuuuuguugaaacuauaaguaauuuuuuucucaagcugaaggacuagaggaugcuauaauuuguagugaucaaacuaauauuauccauuguacuuuuaauaagauaauagcuauagauaaaacuauuuauuauaccuucacagcacauuuacagugucauuccuuuaaaauaaacuuuaaauuauuaucuauaauuaauauaauaugcaccccuuauaagaauauaaauagauauuuacaaagucuuuacuauguaaaucauuaauucauauaacauaaauguaauuaaagaugcuucuggaagauaauaaaacuuuguuacaucaaacauuaacaguacucuguuuuaugguuuggugaauacauauucauauagguaaaaucucgcuaaaguauuuucuuucuguaguucaccuuaaauuuugucaaacugaaauuauucugguaauuucagauauuuaugaagaaacauagccucuuaccuuucguacugaucccuaggaaagaaaagauaaaugaucauuauaagaauuauauauacaccuauauauuaaaauggcuuuauuacaauauuauguacaaauauauuuacaaauguaacugcauuguucuuuuccuacuaucuuaaucuaauauuuugaaauaaaauguaaaauuuuaccaaucaauaaaauguuaucuacaaaaccaauuguauauacuuaucuguaacuguguugugccuucaaucugugagcuaagaauuuauucauaauucauugcaaaugaaucccaggaaauaacaaaaaucucucaagcucacugugcccuugugcuucggaguagcuggugcuaaaccccaaacuuccacugacccauuuccuuucucuucccuaugggcauuuuaugggacuagucucacuuagcgccacccacuucagaaaaugggguggguacuuucaguggaagccagaaaacuuuagccuacuauuaugucccuucacaauuuccuugggaagccaaacuggccaacuucccuccccagaaaugacaccgcugugaucaaggcaaaguacaaacaccuuauguauucuaaaaguaguuuuacucaccgauugcaaaucuguugagggaagaagagaauaggaaauaguuauugguaucauuucaucaguugcuaucauuccauaugucaauaacgguaauuaaaaaaaugauacuuaggucuauacaguagauuuaccugauugaaagaccccuucuguuucuccuucagaauauucuaauagcccccaaauuauucagguaaaaaaaaacauagcagggauccgcagggugacuuguuuacaguuuugauauguaaauauagauuuaaauuaaauaguuaauuauucacuauuuuuuaaaugccaugaagcaucacugugucugcaggcaggacaucuccagugcucagcaauuauggaggaaguggcauaggugaauagguggcuaucaccuucugauugacaaggaaaugaugcauaagaaucugagaaaacguuagccugcauccugaagcagagcuuguuuuuuuuguaaaccauugaagugacuuagcccuuucccccaaaggucuaauuugcaucaaugaaagcaaauugauucaggagucugauuuuugcuauaaauaguucaugucaaugagguaaggucauugacuaaagagcagcccauuugugcccuaagaaguucugcuuuguauaaagagaaaacuguggauuaaaaucuugaaaaauaaugagaaaaauaaauacccacuucuuugcuacaauuacccuaagacuuuaaagacugaguuucauuccuacaguauaauaauuacaggaucauguggcauauaauugcggucagacuugcuccaggaugauucaccccuaaaaauugcuugaauuugguggucacaaagugugucauuuggaaugagaacaucuguugaaguggucacugcucagaagagugggacaccuccugcauucacauuuuagggcaauugaugagaaucacuguucaauuagauaaaugguaugucuaguuuauuuucuccauugaaggaagaacaguuugccugaauuaagagaagccaguaagccuuacaggcuuuggaaacgugccuuuuaauuacucaguuugugagccauuuuggacaauguguguuggauaaccuuuauuguucuuagugguuggauguugaauaaaauguauguugaccuucaaaucucuacuucccuaagucuacuauauuuuucuguggggauccccucuuacucugguuucauauaaaauuaacuuguaacauuaauuuguacaaugcaauuacuucuuaguauccucgagggguauauaaaaguggaugaaaggaauauauacacauucaaaauuaggcuguggcagacguggggcguguagcugaaggucuggguguggccacgcccuccugaauacucaucaagccaacaucuuuguccaguuaaauuaggcagccauuuuaaaagaugaaacccaagugguuuucuucauucuuucuucaggaaauucuaguuaguuauacaaccuagaaauggaaaauagccucgaaguuggcacauuuaguauauaccccacauuuuagaaaaaggcccaauugauucauuugaagucacaugguaaacgaguaagagacuccugagaagaauccccaggcucuugaaucucaggacgaaguugauauuucucacaucuguuguuuucgugugugauuacaggugggaacuuguugaaguguaagugaacagagcuuauuuuaguuaaaaguuaccauuuccaugaucagguaauggauugggacgcugcuuugacuauucagaagauaaaagcugaggccgaagcagcccgcuucucaagauacaccaucuggguucuuuacauauggcccagaaauguaaauuacuccauggaccugggaagucuuuaauuggaauuccuagcgcuuaaggccuggucccuguuccugcacuuuacccccuccagggggcguauuuuuaucauuaucuucaucaacgucauccagagcaacucggccgcccacaagaaaauggaguccugugaguuuuguauuauucuauuacggggcuuucuaaacuaggccucaaguuucacaacgugaccacgggcauaauucugggaauugaagaguggagcccucucagucguucaugcugucagccagguuuauaucuugaggcaaccuucuuugccucuuugugagcuucaccaaccggggcauccgggcuaacagucuaguuuuaagggaaaaacuucccccaacucuuggcaacagucaagucuuucauauuuccauucuuuucccauguaucucgugaacccuaguguuuucuccgacagauuagagggcgaccucacaagcuguauguggaaugaaugugugaaguuucccucuguugagauaagggugcccaccuauccagccucucuccuucaucucccccaaacaagcagaagacacuuacauuggcauguugcuaggcacgaaguuacugcaagcagcaacagaguccgcguauccacaaagcugagcaugucuaccacuuagacaugcagacuccuuguguugcagagccccugggucaccagcggagguaucaccuggcgggcgcaggcaugcaaucguggaccguucccuccaacuuagucgaaaccuccugcugccguggugcuaaaauaauaaagcccagaccugccuuauuuauaugggaaaaguuuccccagccggagggugccuccaaaaacgucuccaccaaugggagggcuagggcuaggggcccgggacucagugcugggaggagacugcgggggagcaggggagggagccgaggggggagggacguggcuacggggcuucuuaaauugguuccauucuuuuugaggacguggacacuuuugaggcuuucgagggggaacucugacucccugucugcauaccuccgcccuccccagccacccgcccucucucgcccuugccaaguuuggaagcacuuuaggacaccuacgugggcucuuuacagaucuccgggcggcggggcagguguugagggaccuggaggccgaagaugaaaaggcaggagcuguccagucccgcuucacucugugcccugcgggccaucugcaggcuggagggggcuggggugugaggggaggagggugacagcguggcgagcucuagagcugcccucauggguuggcuccaccccugcccccuaauuuccccaguuugggggggccugugugcccauaaucuccucucuccucugucucucuaucucucugucucucccucccucccucccucccucccucccucccucccucccucccucccuuccucccucccuuccucccucccuccuccauccucucucugacucucucugucuguaccccccucucucucguugaugaggggagcaggcaucaagagauaaacugugcauuauuacauuuacuuugguuaagccccauuuccagccccauguacagaccccaugaaggauuaccagccagacucagaugccgagccuggaucagauaacagaucagugaacacuca

SEQ ID NO: 2829 - RNA, 15932 nt, Mus musculus
uaugaggcuuauuauaaaaauggaagcuacauucuccacucuuauggagacaaucaucucccaaguugauggggucucuuucuaugucacuugccugggcuaagagacuuaucauugaaaagguuugugggcaaacauuuuucaaucucuccauuccauuguuccaccuucuucuuguccaugcuugucuuccuuaagaggacaagauacagguuguagaagaauagcaggcacccacucucuguccucuucuuuuuagccaucgugucauuaauagcaggcccccaguuccauccuucugccuuucaaugaugcuccuuugugucucuaugcagccaagaaugccaucuacuaaguguuuaaauuggaauucuucaagaguuucagucuuggcuuucuucuuuugcuacugaaauaauugauuucacaugguuuucauuccagggugaagcuggugcagucggugcuccaggcagugcuggugccucugggccuggugggcuuccaggagagaggggugcugcuggcauaccugggggcaaaggagaaaagguaccacucgguguuagaccuugauacauaauauccaugaacuccaggcaagaaggcugugcgaggaugcacaguuguuuaccauucauagcaggcggucugguagcauuuugacaucuauaugcaccucccucugccacccagcaccuacacaugucuaaacucacuaaucuggcaaaauuccuugcuaccauggaauuucaugcaagcagaugguguugaguaauacaugaggcucauuuuaaugccacuaacaauaaugccucauccugcccuaauuaauggaagaagcuauaucaaacagcuguucaccgugcuauggcauucauuauguuauaagagugaccgggcaccacagcccgucgccauguugucuugugauuccaaccucaucaauuugaaacuugcuucgugaugaaucagagggauguuuauuuuuuaguguucgguaguccucugaaaggggccagaaaagaugaacuuccgacuguuuuucucauucaacauccuacaaaguggugggaaacugaaaaacacugaaauucuaaaaggguggccagcauuauagaaauuuuugucaaagcacuuugcaguucauuuccacucagaaguugagcaggaaagcaaaauguggcucuugcuuuguacuuccagggugaaacuggucuccgaggugacacuggcaacacugguagagauggugcucgugugaguagaagcuuguuuuuaaugcuugcuuguucuuaaauuuccucuuguuuuuuaguaucuuauucccuuugaauucagccaauuuacaaaggagacuuaaaaaggaauucacuuugaguaaaaucucaauccauuaucuccuagaucgcaaacaauaucaucuuacauacuccaaaagaaaaugggagcaugacacaccuuugaaaaucacaucuugacuuagucuacguucuuuaguacugaguauggcaacacuaagcugcacaccgaaaguugcagguuuugaagaccacuccuugaaaacagagcuuuuagacaaacaauucucucauuaaaaaaaaaaaagccacagcccccaccaagguauuacuacucauugguccaccccaggaacugaucuaagggcagccucggaaauuaucugugacuaccuuaagugucacagaugaccccuagggaaaucucauugccuucaugagcugccauuacucugucaccucucccuccaagcugagaacucgcuguaaugcauucccaguauccuuugccuugagucaccugguuguuaacaguuccaaauaaggcuaugcauuugcuucccuccagggaaucuuacaagggugacccaaacccuccuccugcucuggccuuccacauuuccagaacccaguucuuucuuccugaacugacuucugagaaccuugaugacaagcaccagcaaggauuagaggcuuucucaguagugcgcucucauucacuugcacccauugaguggcuacaugccacucaauguggaggucaaaggacaagugaugaguguugcuucuuuccuucgauggaucccauacggauccuauggauccaacucgggucaucagacuuggccgcaaacaucuuuaccugcugaaucaucuagcuggcccucgggaucuuucuugaugucuuaccacaaugugcaauacaguuguccugcgcagcaggacagaguucaauuaagaugcugugcauuauuuuuaguaagaccuuuuuccuucugugguguucuagggcauuccuggugcuguaggugccccugguccugcuggggccucaggugaccggguaaguacgcauuugaaaugaguuguauagguuuucauugaguuguagcucucugaguugauagcaguauguaaaauucccugcuugcccuagucccaaagauccuuugcaauucauuuuuauggcugggucuaaaaccuguuuauuaaaaaaaaaaaaaaaaaaaaaaccuagccuuugcaggaaacaaaugcuguucucuuccccugccuauggaugugccagcugucugaucuauaccuuaagcccuaucauuuguuuuaaagacuuucccugcugcccauuaacaauauccuaaugcacugagccuccuuaaagccuucaauuguaaaaaggggaaaaaaaucaauaaaauacauagugugcccauuucacaucgaacaaacaguccuuuuaaaauagaccuuauuuauugaauugcaaagauugcagcaaauagaucaguccugcaucuaucuaaaaauuaaaauguccuccuccugguguuauggggacugauuuauaguguuucugcaagugaagaaccaauaccacuccaccuuuuaaaaugaagccagccuuaaguagaggaagaauucaccucauuuuauucucugaaauguccauuagucucuuccaagguaacugcaaagcgugaaaacaacccucuuucuaccgcucuucucucuuccuccccucaucuaugugaggcccauuaagcgacucaccacugcucuuugguaccauuacagggugaagcuggugcugccgguccuucuggcccagcugguccucgggguagcccuguaaguagaaaccacagcuuuuuggauauucauaguucaugguuuacagacaucugagaggcugugagugugaugucuuuaucucccaccuagggugaacguggugaaguuggcccugcuggccccaauggauuugcugguccugcugugaguaucauauuaagggagauuaagaugacaucacagugagucagaaggccagugcucacugcuguuucuuccaacagggugcugcuggccaacccggugcuaaaggagagaagggaaccaaagggccuaagggugaaaauggcauuguugguccaaccgggucuguuggagcugcuggcccaucuguaaguuaaauucacuguugaccaauauacccaagcauuuguauaauccaauaugugcccauuaagugccuacugucuauuaagcauuccagauaaaagauuacagauacacacacacacacacacacacacacacaaggugguuugccagacaggguuucucuguguagcccuagcuguccuagaacuuacucuguagaccaggaugggcucaaacuuagagauccgccugccucuaccuuccaagugcugggauuaaaggcaugugccaccacacccuacaagacuuuuuuuuuuuuuaaaucacauuuaaacaccauguaaaaguuuugugaauaucuuguuuucaugcuucaguaauccaugggguguuacuuguugggacagaacauuuauuucuuucaugugauguagauaacuguguuucauuucuaaauuuucuucaaggguagaggagauagcuaaggaugagucaugagaaaacaagugugccguguguaagaguuacuuguuuugugauuugaagccacccuuuuugcuuucauuuaggguccuaauggcccaccugguccuguuggaagucguggugauggagggcccccugugaguauuuacaauugacucuucuuucuuagcuuacguauuagugacaaugugaaaguuucagcauucugguggauuuggacugugaaaaguagaggcuugagaguccuguucauucgaaucuaaucagaaaaguuaugaaguucaccaguaccgagcuuaaagucgacuacacgggcauugacugaaucccagaaagaacucugggugggcaucagagguugcuacugccccacgagggaauaagcaaggucaaauucaggcgguuuaacugggaaauagaacaacucuucugacugaccaagucuccucaucucagguuuucacaccaacucccuagagacucagagguccccagaaugaaucccucuaacgguuucccuccuuaggcaauacuuaauacucugacucaauuucauacuuccuucucuagacaacacuccuuuuucuaguguccccacccucucacccagccaaguggucaauaaaaauucacauacccuaaugaaaauagcuuauauucucucaucucaccaucagauaaccugcuagccuuucaguaaguacuaacaaucuuaguguaaaauucaggcauuacaucuaguagcauacugaagauguauagacuauuagagccuucaggacccuaguuaagugcuccucuaccuugagcuaagggacggcucuucuaugguccaucuuuagucacaugauaauuuuccaaagggaaaggaucuuguuuuauccuaauucauagaguugacuugacugaguuugaaugugcuugguucuuaggguaugacuggcuucccuggugcugcuggacggacugguccccccggacccagugugaguacaucauucccaguauaacuccauuuacucucaccagaaggccaggccucugguaggaaauuaggggagaacauaucuauuuaaacaaauuauuaauauuugcuaguacucuccugaguuaaaauuaucuuugaugaaugauuaagacaaaagucauugcaaauuuuauuuuaaaauaucaaucuaaguacuguuauucauauaaauaccagcacccuuuggaauccacaaucgcuuuuuacaaagaaaaaugcaacaggaauuuuggucacauaucugguauuucucugccuaauuacccuuuauagcuaacauucugccuccauucuaaagcuauaauuguuccugaauuuaaagguauuauggucucuaacuuaauucucauucagacccuccugucaggaauuuaauuaauuaucaaggauuaaguauuccaguugagguuucaggggaaaagaaauagcaaagauguugauuucuuggaaucuuuuacacauucauaacagaaaaaaaaucuucauuccuuguaggcauuuaauuaaaccuagucaggagcacaugaguuccucaguuaugaacagaaugccaggguuggcuuugcuuaagaagaaaugggcagaaucugcaagaauccaaagucccuuucaacuaagacuuaaaucaccaaacuuaaaucucuuccugguucugaccccaacaugccagaguaccagugauaugacaugucuugccuucaucacuaaaacuucccacuaauucugccucaucaauuagcuuuacuacaggcaggaagaagaauuuucaaaguuccaaaaaugucugggauauuauuuuucagagugauguuguucaaauccuauuaucaaggagcaaggcagcuccccuccagaucugcaacaacuaauagaaaacaaaugaccuuauacauuugaucacaggguauugcuggccccccuggccccccuggugcugcuggaaaggaagggauucgugguccccguggcgaccaagguccaguuggccgaacuggagaaacaggugcaucuggacccccuggauuuguuggugaaaagggucccucuggagaaccugguaccgcaguaagugauuucaaacuccuuucucuccauacuuauguugaguuagaauaaagccccuuuacaaauccucaagugguauauaucuauuagugaguaaugcaggcucuccaguugagcucaguugagccaggaaaucuguccagcacgcaauaagguguuguggugguagcagaugcacagaaagcagauaauaagaaugacagaggacgagggaaugcggcuucacugcaauggcccuuucugcucuugagggacggaagaaugaacacagaauccuacugcuguggccagccuucuguaaauuaaucaagcuucauaaccugccgucccuuaaacacuccugguucagaguuccugcaguucugcaaagcacccauguuagaccuucgaagucaaggccaaaauuuucuucccugcauagagucuauaaagaauaaauccacacccccaaugauauuaaugauauuaaucucaacuacauauauacauauauacauaccaaaguguaaauuuauugucauccucagaaagaaagacauucaaggaugugucccaccaauuagaagucacuggucuguuccugaauccaggagcccuccuuuucacaauccuugagcuaaucuguauuaugagauagggucuuaccaguaauaaucaguauuuuuucucucaucuagggagccccugguaccgcagguccucagggucuucuuggugcucccgguauucugggucucccuggcucuagaggugaacguggucugccagguauugcuggugcucuggugaguuugacgccauucugauucucauuaccauaauaaaagauuuuaaaagcugccacuucaaaugugacagauugaucgcugaauaacuccacuuaagauuuucuacucauggcauuuucuuuauacagauugcaugucaccuauccaggaagcuucaauacugccuuacuuagacacaugcuauaaagacccagcuuaacauuaugcagaugauuuuuguucuuucuacauacuuaagaaugacauaagcuuuaauugcauuuccuucucugugaugugaaauccuggcaucauuuauccccucaagaagaauggaacuguucauaggaaguucaugaaucguuucguuuaacccuauacaugacaacagcuugaaaccgucuuuuacccaggaacuaucagcuuuaugaauuaauuuuauuuguggugcauuggaucccaucagaccuuccucucacucccagacacagccacauccacagaacugauccacagaacagaucccuggaguguagggaagacagagaaaggccaucuugcaggggugauucuuaaucauguugugauccaucugcauuccacuugccuucucucuuuuaacuagaauuuucugggaguuguuuuugcuaugugagaucagcauucugccugaagauagugaugucauuuuauguucucugccacucuagggugaaccugguccucugggcaucucaggcccuccuggugcccguggucccccuggugcugugggcagcccuggaguuaauggugccccuggugaagcuggucgugaugugagugcaguacuugguuuguaaaauaaaaccaagcaggauuucauguguggaaaugagguuucaugccccgaguuuccaaacuagaucaucuacuucuccauauaaugagccugcuuugcaguaaagcuggcaggauugcuuggguaggaaaauugucuuuuacuggcagacuguaaauuggggcuccaauauuuaaaauaccucuaaaauaauuaggagguuuuugcuccccuuuuuuuuaacugaacccugggaauaagggcagaguagcauagacagcgaggcuaauggaucacagaaccucaccaacgugucuucauuugcaugguauucucauaggguaacccuggcagcgauggucccccaggucgugauggucagccuggacacaagguuaguagacuuuuucaccuuucucuaguuuaagacugaucaaacuacccgacaaauugauuaaugcuaagcuuuacuucugccuugguagggagagcgugguuacccuggcagcauugguccgacuggugcugcaggugccccugguccucacgguucuguggguccugcugggaaacauggaaaccgaggugaaccuguaaguauguaaauguugucacccuuguggacuuuccugugaccucaugcuugagcacugaggccauuaagaggaugaccuuggccuugacugaugacaucuccuuuucuuuucuaauucacaggguccugccgguucuguugguccuguuggugcuguugguccaagagguccuaguguacguacauggugaugauuaacacuuaagaauuaagaagaaugauucuaaaccaucuacuuauacaauagauaauguagaagcuaaacuuugguacuuuaguccauggugagaagggauucagaugacuuuauugauuugaagucuauucugcuuguuuguauuuguuagucguaacuaacugcucaguuaaaggagauggcagagaagauggcagccaaguuagaccuuugcaugucucaagcuuccuuuguaaauggacuaaacacccuuugaagaggaauaagugauauuguucuaaaagaguagaaacaucucuuucucuuuguuuauaggguccucaaggcauccgaggugacaaaggagaaccuggugauaaagggcacaggggucuuccuggcuuaaaaggauacaguggauugcagggucuuccuggucuugcuguaagcaaaaagugaucuucuugcaugaauucuaaccugaauagccuucagaugcccacugucacaguguaaaacacccuaccuucuagauccauuccaauucuccagcuaacucuaccucucucagagaggauccgauuucauaguauaacacaaagagguaaggguuaaaggagccagaaacguccguguauuaacaucuccuggcaacaguguccuucaacugcacuuaaaauauauauaauuagaaggaugacuaauauggcacuguucaaauagcuuguggaagaaauaauugagcauaauagauauaauggaagaaaagagcuccacuuuacauucucaauuuucucaaucuagaguccacuggaacgaaaguuuuccauucaauuugggaagaaaaaaaaaccuauuuacugacucauguucugaaaguaugauuuuuuuuccucuguucucucuuugaagggccuacauggugaccaaggagcuccugguccuguggguccugcuggucccaggguaagugaaucacaauuaacguucaccucuugaacuaaagaauuauccaggcagugagcccuaggcuacugcuacccgugggguuuuacucauucuuaagcacucgguauccuuucuuuuuaggguccugcugggccuucuggacccguuggcaaagaugguagaucugggcaaccuggcccagucgggccugcugguguucgugguucucaggguagccaaggucccgcuguaaguaugacuuggaaggguaguuuagggccucccugaccaaagaaaugcuuccuucagacuaaacugacaagaauuugauagcacacaggaguagauccacgucaguagcucucugaaaaguuuguuaacuguauaugaugggcuucuucaaaccacugcuuugagacugugaucaaguagucuguuuacauaagguuguuucuuucucucguauuagagcacguacugauacaaagcacacuugaaacuuuccuguccuggcugccucucccacucugagccaguuuaaaauggucucucugacucuuacuucacagggucccccuggucccccuggaccuccugguccuccuggugucagcggagguggcuaugacuuugguuuugaaggagacuucuacagggcugaccagccucgcucccagccuucacucagacccaaggacuaugaaguugaugcaacucugaaaucucucaauaaccagauugagacccuucucacuccugaaggcucuagaaagaacccugcucgcacgugccgggacuuaagacucagccacccagaguggaacagcgguggguugaacauucaaaccacacuggucccucauacgccaaccuuuccaaaaaucuauguccauugaucuuuagaacaaacacguauuugggcccaaaaauucuacacuaucaaaacuuauaccgaguuaaugaaacaucacuuucuuccucugcccacauccacccuuaagucuguuuaguuguuuaucuguuuacuaccaggacuagggauuaaauaucaggccuuagacaugcuaagaaaaugucuaacacagagcuccauccucaggccacguucuacacuuuauuuuaagaccagcucucacuacacuggccuugaauucacucuagucuuagugggucucuuaaguauugauucuccugccucagguggucuaaacauccugguuggauguuucaucaaguaaaaggggacucuuaaaaauagucacccccuucucacuaacugugggauaggugauggaacagcaccaucaaaauguuuuuuaugguaaucaauauuauugagaaauuacuauuauuauuauuauuauuauaaccuacauuuugcaguaaguuuaccaacuggauuuucuuuccuaaacagauuacuacuggauugacccuaaccaaggauguacuauggaugccaucaaaguguacugugauuucucuacuggugaaaccugcauccaggcccaaccuguaaacaccccagcgaagaacucauacagccgcgcccaggccaacaagcaugucugguuaggagagacuaucaaugguggcagccagguacguaauucuccaaguauuccucaucuuccaaaauaugauuuucuuagcaucauuugcuuuuuaauuacuugggcuuuaacccuuuacccucaugagcuuauuaaaagaaacuacucuuuucacaaauuccaauucuauccuagaucacauauuaaaagauuggacucagccaccuaauucaacacuauuauucaaauuugacuuaugggucaucauuggagacauagcuaaugcgauuucauguaaaggugcaccggccggcccagagccccccagcuaugcauauguauuucagaaugcgagcagcuuuucugaauuuuuaaucaaaccuucccacugaugcuaccaaaugacacuagaauccaguacacuacagagaagagaaugaggucugacuccaucucacaguuucagauucuaaugagggaaacauuugcagugaugcauaacugagucagaugcucuucuuggauggcccugcccucccuaggcagagcuuaugguccuuuaacaagugugccaaguuuccuuuaaaagcacccuucuccuaagcccgggcucugacuccauucugucuccuguaugcauguauuuauuugaguuuuaguaugaggcgucuauuuaagaguucacaccuucuucuccauaguuugaauacaacguagaagggguguccuccaaggaaauggcaacucagcucgccuucaugcgccugcuagccaaccgugcuucucagaacaucaccuaccacugcaagaacagcauugcguaccuggaugaggagacgggcagcuugaacaaggcugugcuucugcaggguuccaacgauguugaacuuguugcugagggcaacagcagguucaccuacucuguccuagucgauggcugcuccguaagucaugggaaaauggcgggagaacauuuauuuuuaggaaaugaggugagcgguucuagcuuaggcuauuaaaugaacagaugaaugagaggccuaacuuaauugaccuuucuucuucaagcacauuuaagugcauccaacaauucucugaauucuaauacagaaauucguauuagauaccaccuucuuugcaacucucacacacugagcugacuccuaugcccacacagucccugcuuuccucucagcauuuagaguuccuauguauuaacauauaccaagaauuuaaaacuuauugagguuuaaaaugcuucaguugcaccuuagaauauggcuacauucaauuuuucuguagacuuuuaccuauauaaaagaguauauguuuuauauaauaugcucuaaguuagaauaaaguuuuaaguguaaaauuacuguauaccuacccaauucucuauacauacacagacauacacacaagaugcauacacacaacauacagaaacacacaccacacacauacaagauaugcaaacacaccauacacacauacacacaccauacacucaccuugaaaagaauauguauccaaacauauuugaaacuuauccuaaagaaguuaucauucccugaaagacauccuugacacugucugucuacagugaacgucuuaaucaggaaccccuaucuucagaaaguguuggcugccgagaaauggcuuuccuagaccccgaugcuuagauauaagucaggugcagcuauacuggucugauguauuuuccuuuuuucccauuuuuuucuauuauacagaaaaagacaaaugaauggggcaagacaaucauugaauacaaaacaaauaagccaucucgccugccguuccuugacauugcaccucuggacauugguggugcugaccaagaauuccguguggagguuggccccgucuguuucaaauaagugaacucaaccuaaauuaaaaaccaaaaaccccugaaaaaacuuucucuuugccguuuccuccuuuaaaaaaaaaaacaaaaaacaaaaacugaaagcugaauccuuccaugucuucuaugcaucuacaucuuaaacugugggcaaaagagaaggauuggucagagcagugugcaauaugauccaacuaagucuccucccuuggccccuccccaaaauguuugcaguguuauuuuuguggguuuuuuuuuaacacccugacaccuguuguggacauugucaaccuuuguaagaaaacccaaauaaaaauugaaaaauaaaauaaaaagaaacccaugaacauucgcaccacuuguggcuucugacuaucuuccacagagggaaguuuaaaacccaaacuuccaaagguuugaacuaccucaagacacuuugcagugaguguagaccaucccaaugagaguugaccaaggcugacacgaacugagguacuuguuuuguuuugcuugcaacacaaaggugcuaauuaguaguauuucagauacuugaagaauaugaacggugcuggaagaauuacagaagaaacaauccuccacauugaugugcauugugugugauuuuuaaauuugacuuagcaguccucuuucucaucuuauccccaacuacaggaaugcaggccacuugccccagguucucucuucauuagauucagcauucauucuuuaacagccucauuuuccuucuugcccaugguuccaaagaagucuuguuucuuggacaagcagaaaaauugaauuguaccuauuuuguauaugugagauguuuaaauaaauugugaaaaauaaaauaaagcauuuuugguuuuccaaaagaaaauauugaguaaaauuccuugcuuugaugcucauugccauaugaaucugcaucucuaccagccauuagaacaaguaaaccucaguggaaagaaauuauacaguaauaauaauuaauaauaauaauaauaauaauaauaauaauaauaauaauguagaaagaucucagaacaaggaaggacucaggaagaaacucagcuccaguuucugccauguuccuuggagcuaagugaccuucagccucugugccuggguuucugcuuccaaccugguaacauggagaggaauucuauucuucacugugacgcaucugugacuccucagaaugcauaguaccuaagcaacaugauacucuugaucucuguuuucucuaagcaaagguccacagaaacuuuugccucauuauccaucaagcacuuuguaacuauggcugaaaguuggucuaugcacaauuaauauuauuaacuaaaacaguuucaaauagucaguaaaaaugccacacaguuaaauaugcugcaacugaguacaaugccuguuaagagguaaugugugugcugucaaucagcacagacaguuguggauaauaguaccaagaacaccuaccugccaaaucaaguucauuuuccuccccugcaccuuucaaugacaucuuuaacacacuuaaacauaguaaugugucaaguaaaauguuaagauucauuuagaacuuauccccuguugcagaacguaauuguuauuguaauauuugccuccuguuauaagucaucucaagauucaauuaguuuaaaagcaaaagaccgaacaugaggaaaaauuuaacacuaacucuaaaaaguuagcaaggucuacuaaccaaacaguacuaucaggucaggucuuccucccacuagaaucugagcacugggauacucagaugggagcacaaguacacagccauugccccucguccagauccccuguggagucggugauuguacugccugugcaauucugauuccuguaccaaggagguaacucaagucucugcaugcccuugaugucucuaacauuccaugucugacaagcuugagucgauguagccaaucacacaauauaaagaaaacucaaacucugucaucaaaacgcuguaacgcccucaaauuaaucauuggaauagcaauggcaaaguuauaaagugauaaaauuguuagaagucucugggcugaauauaaguauggcuucuggcuugugauaugaggaagagaaccagcauuuugugaggacaaacuguggcucaaauacacauuagaauaguuacaucugagucucuucugccaacagauuuccaagcuaacagucucaauaaucacucuaucuccacugcaucaucacuacauaaaaggaggaaauaaauaacauuuaauagaaaacaguguuauguucaaaauacuaauaaaaaaauuaaaguuuugauucccaaauaacaauuaugaggaugguuaaacaaaagaaaaccugcuuucaaaagccugucuuuacagaucuauuuaaacaugcuuauaaaaauaccaagaguuggugcuugcaggacaauuaugucaagauggguuuuuuaguccuacauuuuccaaauuuacuauaauauaauuucaugaucuguacaauuuacaacaaauugucucaaaagaaauuacuagcaaucuugauggaagaguagucaucucuaagaaugagauaucuaccaucccacucagcuucuuccugagacaacgaggagagcuuaccuggucucuagcaugugccaguucaccugagcaacacuaggaaggaugcccaaagcuggcuacaccuccucugagagcaggguccuuaagguuuauccagcucacuugcuaagacagaauaaaccuauguaugaguaguauuuuagacaaaguuccaugucaggauaacaggacaguaucaguuagagggccucauacaaaucucagucucacacaaaacagugacauuuggccaacuggccucuucuacagauuucacuccuccuacaggcccucucuggauaaaugcuucuguuuagaaaccacuuauuagaacaauccaguacuuaccaguugguccaucgugaauauuccuagagucugggcuaagaaaauggcuacagaguuauguccagaagauuugacccucccauggucugucaucuguuccaagcuaaucgcagcucuaacugauucuucgcaggacuuucucugacccuuugccaagugaaguuuuagc

SEQ ID NO: 2830 - RNA, 15932 nt, Mus musculus
gcuaaaacuucacuuggcaaagggucagagaaaguccugcgaagaaucaguuagagcugcgauuagcuuggaacagaugacagaccaugggagggucaaaucuucuggacauaacucuguagccauuuucuuagcccagacucuaggaauauucacgauggaccaacugguaaguacuggauuguucuaauaagugguuucuaaacagaagcauuuauccagagagggccuguaggaggagugaaaucuguagaagaggccaguuggccaaaugucacuguuuugugugagacugagauuuguaugaggcccucuaacugauacuguccuguuauccugacauggaacuuugucuaaaauacuacucauacauagguuuauucugucuuagcaagugagcuggauaaaccuuaaggacccugcucucagaggagguguagccagcuuugggcauccuuccuaguguugcucaggugaacuggcacaugcuagagaccagguaagcucuccucguugucucaggaagaagcugagugggaugguagauaucucauucuuagagaugacuacucuuccaucaagauugcuaguaauuucuuuugagacaauuuguuguaaauuguacagaucaugaaauuauauuauaguaaauuuggaaaauguaggacuaaaaaacccaucuugacauaauuguccugcaagcaccaacucuugguauuuuuauaagcauguuuaaauagaucuguaaagacaggcuuuugaaagcagguuuucuuuuguuuaaccauccucauaauuguuauuugggaaucaaaacuuuaauuuuuuuauuaguauuuugaacauaacacuguuuucuauuaaauguuauuuauuuccuccuuuuauguagugaugaugcaguggagauagagugauuauugagacuguuagcuuggaaaucuguuggcagaagagacucagauguaacuauucuaauguguauuugagccacaguuuguccucacaaaaugcugguucucuuccucauaucacaagccagaagccauacuuauauucagcccagagacuucuaacaauuuuaucacuuuauaacuuugccauugcuauuccaaugauuaauuugagggcguuacagcguuuugaugacagaguuugaguuuucuuuauauugugugauuggcuacaucgacucaagcuugucagacauggaauguuagagacaucaagggcaugcagagacuugaguuaccuccuugguacaggaaucagaauugcacaggcaguacaaucaccgacuccacaggggaucuggacgaggggcaauggcuguguacuugugcucccaucugaguaucccagugcucagauucuagugggaggaagaccugaccugauaguacuguuugguuaguagaccuugcuaacuuuuuagaguuaguguuaaauuuuuccucauguucggucuuuugcuuuuaaacuaauugaaucuugagaugacuuauaacaggaggcaaauauuacaauaacaauuacguucugcaacaggggauaaguucuaaaugaaucuuaacauuuuacuugacacauuacuauguuuaaguguguuaaagaugucauugaaaggugcaggggaggaaaaugaacuugauuuggcagguagguguucuugguacuauuauccacaacugucugugcugauugacagcacacacauuaccucuuaacaggcauuguacucaguugcagcauauuuaacuguguggcauuuuuacugacuauuugaaacuguuuuaguuaauaauauuaauugugcauagaccaacuuucagccauaguuacaaagugcuugauggauaaugaggcaaaaguuucuguggaccuuugcuuagagaaaacagagaucaagaguaucauguugcuuagguacuaugcauucugaggagucacagaugcgucacagugaagaauagaauuccucuccauguuaccagguuggaagcagaaacccaggcacagaggcugaaggucacuuagcuccaaggaacauggcagaaacuggagcugaguuucuuccugaguccuuccuuguucugagaucuuucuacauuauuauuauuauuauuauuauuauuauuauuauuauuaauuauuauuacuguauaauuucuuuccacugagguuuacuuguucuaauggcugguagagaugcagauucauauggcaaugagcaucaaagcaaggaauuuuacucaauauuuucuuuuggaaaaccaaaaaugcuuuauuuuauuuuucacaauuuauuuaaacaucucacauauacaaaauagguacaauucaauuuuucugcuuguccaagaaacaagacuucuuuggaaccaugggcaagaaggaaaaugaggcuguuaaagaaugaaugcugaaucuaaugaagagagaaccuggggcaaguggccugcauuccuguaguuggggauaagaugagaaagaggacugcuaagucaaauuuaaaaaucacacacaaugcacaucaauguggaggauuguuucuucuguaauucuuccagcaccguucauauucuucaaguaucugaaauacuacuaauuagcaccuuuguguugcaagcaaaacaaaacaaguaccucaguucgugucagccuuggucaacucucauugggauggucuacacucacugcaaagugucuugagguaguucaaaccuuuggaaguuuggguuuuaaacuucccucuguggaagauagucagaagccacaaguggugcgaauguucauggguuucuuuuuauuuuauuuuucaauuuuuauuuggguuuucuuacaaagguugacaauguccacaacaggugucaggguguuaaaaaaaaacccacaaaaauaacacugcaaacauuuuggggaggggccaagggaggagacuuaguuggaucauauugcacacugcucugaccaauccuucucuuuugcccacaguuuaagauguagaugcauagaagacauggaaggauucagcuuucaguuuuuguuuuuuguuuuuuuuuuuaaaggaggaaacggcaaagagaaaguuuuuucagggguuuuugguuuuuaauuuagguugaguucacuuauuugaaacagacggggccaaccuccacacggaauucuuggucagcaccaccaauguccagaggugcaaugucaaggaacggcaggcgagauggcuuauuuguuuuguauucaaugauugucuugccccauucauuugucuuuuucuguauaauagaaaaaaaugggaaaaaaggaaaauacaucagaccaguauagcugcaccugacuuauaucuaagcaucggggucuaggaaagccauuucucggcagccaacacuuucugaagauagggguuccugauuaagacguucacuguagacagacagugucaaggaugucuuucagggaaugauaacuucuuuaggauaaguuucaaauauguuuggauacauauucuuuucaaggugaguguaugguguguguauguguguaugguguguuugcauaucuuguaugugugugguguguguuucuguauguuguguguaugcaucuuguguguaugucuguguauguauagagaauuggguagguauacaguaauuuuacacuuaaaacuuuauucuaacuuagagcauauuauauaaaacauauacucuuuuauauagguaaaagucuacagaaaaauugaauguagccauauucuaaggugcaacugaagcauuuuaaaccucaauaaguuuuaaauucuugguauauguuaauacauaggaacucuaaaugcugagaggaaagcagggacugugugggcauaggagucagcucagugugugagaguugcaaagaaggugguaucuaauacgaauuucuguauuagaauucagagaauuguuggaugcacuuaaaugugcuugaagaagaaaggucaauuaaguuaggccucucauucaucuguucauuuaauagccuaagcuagaaccgcucaccucauuuccuaaaaauaaauguucucccgccauuuucccaugacuuacggagcagccaucgacuaggacagaguaggugaaccugcuguugcccucagcaacaaguucaacaucguuggaacccugcagaagcacagccuuguucaagcugcccgucuccucauccagguacgcaaugcuguucuugcagugguaggugauguucugagaagcacgguuggcuagcaggcgcaugaaggcgagcugaguugccauuuccuuggaggacaccccuucuacguuguauucaaacuauggagaagaaggugugaacucuuaaauagacgccucauacuaaaacucaaauaaauacaugcauacaggagacagaauggagucagagcccgggcuuaggagaagggugcuuuuaaaggaaacuuggcacacuuguuaaaggaccauaagcucugccuagggagggcagggccauccaagaagagcaucugacucaguuaugcaucacugcaaauguuucccucauuagaaucugaaacugugagauggagucagaccucauucucuucucuguaguguacuggauucuagugucauuugguagcaucagugggaagguuugauuaaaaauucagaaaagcugcucgcauucugaaauacauaugcauagcuggggggcucugggccggccggugcaccuuuacaugaaaucgcauuagcuaugucuccaaugaugacccauaagucaaauuugaauaauaguguugaauuagguggcugaguccaaucuuuuaauaugugaucuaggauagaauuggaauuugugaaaagaguaguuucuuuuaauaagcucaugaggguaaaggguuaaagcccaaguaauuaaaaagcaaaugaugcuaagaaaaucauauuuuggaagaugaggaauacuuggagaauuacguaccuggcugccaccauugauagucucuccuaaccagacaugcuuguuggccugggcgcggcuguaugaguucuucgcugggguguuuacagguugggccuggaugcagguuucaccaguagagaaaucacaguacacuuugauggcauccauaguacauccuugguuagggucaauccaguaguaaucuguuuaggaaagaaaauccaguugguaaacuuacugcaaaauguagguuauaauaauaauaauaauaauaguaauuucucaauaauauugauuaccauaaaaaacauuuugauggugcuguuccaucaccuaucccacaguuagugagaagggggugacuauuuuuaagaguccccuuuuacuugaugaaacauccaaccaggauguuuagaccaccugaggcaggagaaucaauacuuaagagacccacuaagacuagagugaauucaaggccaguguagugagagcuggucuuaaaauaaaguguagaacguggccugaggauggagcucuguguuagacauuuucuuagcaugucuaaggccugauauuuaaucccuaguccugguaguaaacagauaaacaacuaaacagacuuaaggguggaugugggcagaggaagaaagugauguuucauuaacucgguauaaguuuugauaguguagaauuuuugggcccaaauacguguuuguucuaaagaucaauggacauagauuuuuggaaagguuggcguaugagggaccagugugguuugaauguucaacccaccgcuguuccacucuggguggcugagucuuaagucccggcacgugcgagcaggguucuuucuagagccuucaggagugagaagggucucaaucugguuauugagagauuucagaguugcaucaacuucauaguccuugggucugagugaaggcugggagcgaggcuggucagcccuguagaagucuccuucaaaaccaaagucauagccaccuccgcugacaccaggaggaccaggagguccagggggaccagggggacccugugaaguaagagucagagagaccauuuuaaacuggcucagagugggagaggcagccaggacaggaaaguuucaagugugcuuuguaucaguacgugcucuaauacgagagaaagaaacaaccuuauguaaacagacuacuugaucacagucucaaagcagugguuugaagaagcccaucauauacaguuaacaaacuuuucagagagcuacugacguggaucuacuccugugugcuaucaaauucuugucaguuuagucugaaggaagcauuucuuuggucagggaggcccuaaacuacccuuccaagucauacuuacagcgggaccuuggcuacccugagaaccacgaacaccagcaggcccgacugggccagguugcccagaucuaccaucuuugccaacggguccagaaggcccagcaggacccuaaaaagaaaggauaccgagugcuuaagaaugaguaaaaccccacggguagcaguagccuagggcucacugccuggauaauucuuuaguucaagaggugaacguuaauugugauucacuuacccugggaccagcaggacccacaggaccaggagcuccuuggucaccauguaggcccuucaaagagagaacagaggaaaaaaaaucauacuuucagaacaugagucaguaaauagguuuuuuuuucuucccaaauugaauggaaaacuuucguuccaguggacucuagauugagaaaauugagaauguaaaguggagcucuuuucuuccauuauaucuauuaugcucaauuauuucuuccacaagcuauuugaacagugccauauuagucauccuucuaauuauauauauuuuaagugcaguugaaggacacuguugccaggagauguuaauacacggacguuucuggcuccuuuaacccuuaccucuuuguguuauacuaugaaaucggauccucucugagagagguagaguuagcuggagaauuggaauggaucuagaagguaggguguuuuacacugugacagugggcaucugaaggcuauucagguuagaauucaugcaagaagaucacuuuuugcuuacagcaagaccaggaagacccugcaauccacuguauccuuuuaagccaggaagaccccugugcccuuuaucaccagguucuccuuugucaccucggaugccuugaggacccuauaaacaaagagaaagagauguuucuacucuuuuagaacaauaucacuuauuccucuucaaaggguguuuaguccauuuacaaaggaagcuugagacaugcaaaggucuaacuuggcugccaucuucucugccaucuccuuuaacugagcaguuaguuacgacuaacaaauacaaacaagcagaauagacuucaaaucaauaaagucaucugaaucccuucucaccauggacuaaaguaccaaaguuuagcuucuacauuaucuauuguauaaguagaugguuuagaaucauucuucuuaauucuuaaguguuaaucaucaccauguacguacacuaggaccucuuggaccaacagcaccaacaggaccaacagaaccggcaggacccugugaauuagaaaagaaaaggagaugucaucagucaaggccaaggucauccucuuaauggccucagugcucaagcaugaggucacaggaaaguccacaagggugacaacauuuacauacuuacagguucaccucgguuuccauguuucccagcaggacccacagaaccgugaggaccaggggcaccugcagcaccagucggaccaaugcugccaggguaaccacgcucucccuaccaaggcagaaguaaagcuuagcauuaaucaauuugucggguaguuugaucagucuuaaacuagagaaaggugaaaaagucuacuaaccuuguguccaggcugaccaucacgaccugggggaccaucgcugccaggguuacccuaugagaauaccaugcaaaugaagacacguuggugagguucugugauccauuagccucgcugucuaugcuacucugcccuuauucccaggguucaguuaaaaaaaaggggagcaaaaaccuccuaauuauuuuagagguauuuuaaauauuggagccccaauuuacagucugccaguaaaagacaauuuuccuacccaagcaauccugccagcuuuacugcaaagcaggcucauuauauggagaaguagaugaucuaguuuggaaacucggggcaugaaaccucauuuccacacaugaaauccugcuugguuuuauuuuacaaaccaaguacugcacucacaucacgaccagcuucaccaggggcaccauuaacuccagggcugcccacagcaccagggggaccacgggcaccaggagggccugagaugcccagaggaccagguucacccuagaguggcagagaacauaaaaugacaucacuaucuucaggcagaaugcugaucucacauagcaaaaacaacucccagaaaauucuaguuaaaagagagaaggcaaguggaaugcagauggaucacaacaugauuaagaaucaccccugcaagauggccuuucucugucuucccuacacuccagggaucuguucuguggaucaguucuguggauguggcugugucugggagugagaggaaggucugaugggauccaaugcaccacaaauaaaauuaauucauaaagcugauaguuccuggguaaaagacgguuucaagcuguugucauguauaggguuaaacgaaacgauucaugaacuuccuaugaacaguuccauucuucuugaggggauaaaugaugccaggauuucacaucacagagaaggaaaugcaauuaaagcuuaugucauucuuaaguauguagaaagaacaaaaaucaucugcauaauguuaagcugggucuuuauagcaugugucuaaguaaggcaguauugaagcuuccuggauaggugacaugcaaucuguauaaagaaaaugccaugaguagaaaaucuuaaguggaguuauucagcgaucaaucugucacauuugaaguggcagcuuuuaaaaucuuuuauuaugguaaugagaaucagaauggcgucaaacucaccagagcaccagcaauaccuggcagaccacguucaccucuagagccagggagacccagaauaccgggagcaccaagaagacccugaggaccugcgguaccaggggcucccuagaugagagaaaaaauacugauuauuacugguaagacccuaucucauaauacagauuagcucaaggauugugaaaaggagggcuccuggauucaggaacagaccagugacuucuaauuggugggacacauccuugaaugucuuucuuucugaggaugacaauaaauuuacacuuugguauguauauauguauauauguaguugagauuaauaucauuaauaucauuggggguguggauuuauucuuuauagacucuaugcagggaagaaaauuuuggccuugacuucgaaggucuaacaugggugcuuugcagaacugcaggaacucugaaccaggaguguuuaagggacggcagguuaugaagcuugauuaauuuacagaaggcuggccacagcaguaggauucuguguucauucuuccgucccucaagagcagaaagggccauugcagugaagccgcauucccucguccucugucauucuuauuaucugcuuucugugcaucugcuaccaccacaacaccuuauugcgugcuggacagauuuccuggcucaacugagcucaacuggagagccugcauuacucacuaauagauauauaccacuugaggauuuguaaaggggcuuuauucuaacucaacauaaguauggagagaaaggaguuugaaaucacuuacugcgguaccagguucuccagagggacccuuuucaccaacaaauccaggggguccagaugcaccuguuucuccaguucggccaacuggaccuuggucgccacggggaccacgaaucccuuccuuuccagcagcaccaggggggccaggggggccagcaauacccugugaucaaauguauaaggucauuuguuuucuauuaguuguugcagaucuggaggggagcugccuugcuccuugauaauaggauuugaacaacaucacucugaaaaauaauaucccagacauuuuuggaacuuugaaaauucuucuuccugccuguaguaaagcuaauugaugaggcagaauuagugggaaguuuuagugaugaaggcaagacaugucauaucacugguacucuggcauguuggggucagaaccaggaagagauuuaaguuuggugauuuaagucuuaguugaaagggacuuuggauucuugcagauucugcccauuucuucuuaagcaaagccaacccuggcauucuguucauaacugaggaacucaugugcuccugacuagguuuaauuaaaugccuacaaggaaugaagauuuuuuuucuguuaugaauguguaaaagauuccaagaaaucaacaucuuugcuauuucuuuuccccugaaaccucaacuggaauacuuaauccuugauaauuaauuaaauuccugacaggagggucugaaugagaauuaaguuagagaccauaauaccuuuaaauucaggaacaauuauagcuuuagaauggaggcagaauguuagcuauaaaggguaauuaggcagagaaauaccagauaugugaccaaaauuccuguugcauuuuucuuuguaaaaagcgauuguggauuccaaagggugcugguauuuauaugaauaacaguacuuagauugauauuuuaaaauaaaauuugcaaugacuuuugucuuaaucauucaucaaagauaauuuuaacucaggagaguacuagcaaauauuaauaauuuguuuaaauagauauguucuccccuaauuuccuaccagaggccuggccuucuggugagaguaaauggaguuauacugggaaugauguacucacacuggguccggggggaccaguccguccagcagcaccagggaagccagucauacccuaagaaccaagcacauucaaacucagucaagucaacucuaugaauuaggauaaaacaagauccuuucccuuuggaaaauuaucaugugacuaaagauggaccauagaagagccgucccuuagcucaagguagaggagcacuuaacuaggguccugaaggcucuaauagucuauacaucuucaguaugcuacuagauguaaugccugaauuuuacacuaagauuguuaguacuuacugaaaggcuagcagguuaucugauggugagaugagagaauauaagcuauuuucauuaggguaugugaauuuuuauugaccacuuggcugggugagaggguggggacacuagaaaaaggaguguugucuagagaaggaaguaugaaauugagucagaguauuaaguauugccuaaggagggaaaccguuagagggauucauucuggggaccucugagucucuagggaguuggugugaaaaccugagaugaggagacuuggucagucagaagaguuguucuauuucccaguuaaaccgccugaauuugaccuugcuuauucccucguggggcaguagcaaccucugaugcccacccagaguucuuucugggauucagucaaugcccguguagucgacuuuaagcucgguacuggugaacuucauaacuuuucugauuagauucgaaugaacaggacucucaagccucuacuuuucacaguccaaauccaccagaaugcugaaacuuucacauugucacuaauacguaagcuaagaaagaagagucaauuguaaauacucacagggggcccuccaucaccacgacuuccaacaggaccaggugggccauuaggacccuaaaugaaagcaaaaaggguggcuucaaaucacaaaacaaguaacucuuacacacggcacacuuguuuucucaugacucauccuuagcuaucuccucuacccuugaagaaaauuuagaaaugaaacacaguuaucuacaucacaugaaagaaauaaauguucugucccaacaaguaacaccccauggauuacugaagcaugaaaacaagauauucacaaaacuuuuacaugguguuuaaaugugauuuaaaaaaaaaaaaagucuuguagggugugguggcacaugccuuuaaucccagcacuuggaagguagaggcaggcggaucucuaaguuugagcccauccuggucuacagaguaaguucuaggacagcuagggcuacacagagaaacccugucuggcaaaccaccuuguguguguguguguguguguguguguguaucuguaaucuuuuaucuggaaugcuuaauagacaguaggcacuuaaugggcacauauuggauuauacaaaugcuuggguauauuggucaacagugaauuuaacuuacagaugggccagcagcuccaacagacccgguuggaccaacaaugccauuuucacccuuaggcccuuugguucccuucucuccuuuagcaccggguuggccagcagcacccuguuggaagaaacagcagugagcacuggccuucugacucacugugaugucaucuuaaucucccuuaauaugauacucacagcaggaccagcaaauccauuggggccagcagggccaacuucaccacguucacccuaggugggagauaaagacaucacacucacagccucucagaugucuguaaaccaugaacuaugaauauccaaaaagcugugguuucuacuuacagggcuaccccgaggaccagcugggccagaaggaccggcagcaccagcuucacccuguaaugguaccaaagagcaguggugagucgcuuaaugggccucacauagaugaggggaggaagagagaagagcgguagaaagaggguuguuuucacgcuuugcaguuaccuuggaagagacuaauggacauuucagagaauaaaaugaggugaauucuuccucuacuuaaggcuggcuucauuuuaaaagguggagugguauugguucuucacuugcagaaacacuauaaaucaguccccauaacaccaggaggaggacauuuuaauuuuuagauagaugcaggacugaucuauuugcugcaaucuuugcaauucaauaaauaaggucuauuuuaaaaggacuguuuguucgaugugaaaugggcacacuauguauuuuauugauuuuuuuccccuuuuuacaauugaaggcuuuaaggaggcucagugcauuaggauauuguuaaugggcagcagggaaagucuuuaaaacaaaugauagggcuuaagguauagaucagacagcuggcacauccauaggcaggggaagagaacagcauuuguuuccugcaaaggcuagguuuuuuuuuuuuuuuuuuuuuuaauaaacagguuuuagacccagccauaaaaaugaauugcaaaggaucuuugggacuagggcaagcagggaauuuuacauacugcuaucaacucagagagcuacaacucaaugaaaaccuauacaacucauuucaaaugcguacuuacccggucaccugaggccccagcaggaccaggggcaccuacagcaccaggaaugcccuagaacaccacagaaggaaaaaggucuuacuaaaaauaaugcacagcaucuuaauugaacucuguccugcugcgcaggacaacuguauugcacauugugguaagacaucaagaaagaucccgagggccagcuagaugauucagcagguaaagauguuugcggccaagucugaugacccgaguuggauccauaggauccguaugggauccaucgaaggaaagaagcaacacucaucacuuguccuuugaccuccacauugaguggcauguagccacucaaugggugcaagugaaugagagcgcacuacugagaaagccucuaauccuugcuggugcuugucaucaagguucucagaagucaguucaggaagaaagaacuggguucuggaaauguggaaggccagagcaggaggaggguuugggucacccuuguaagauucccuggagggaagcaaaugcauagccuuauuuggaacuguuaacaaccaggugacucaaggcaaaggauacugggaaugcauuacagcgaguucucagcuuggagggagaggugacagaguaauggcagcucaugaaggcaaugagauuucccuaggggucaucugugacacuuaagguagucacagauaauuuccgaggcugcccuuagaucaguuccugggguggaccaaugaguaguaauaccuuggugggggcuguggcuuuuuuuuuuuuaaugagagaauuguuugucuaaaagcucuguuuucaaggaguggucuucaaaaccugcaacuuucggugugcagcuuaguguugccauacucaguacuaaagaacguagacuaagucaagaugugauuuucaaaggugugucaugcucccauuuucuuuuggaguauguaagaugauauuguuugcgaucuaggagauaauggauugagauuuuacucaaagugaauuccuuuuuaagucuccuuuguaaauuggcugaauucaaagggaauaagauacuaaaaaacaagaggaaauuuaagaacaagcaagcauuaaaaacaagcuucuacucacacgagcaccaucucuaccaguguugccagugucaccucggagaccaguuucacccuggaaguacaaagcaagagccacauuuugcuuuccugcucaacuucugaguggaaaugaacugcaaagugcuuugacaaaaauuucuauaaugcuggccacccuuuuagaauuucaguguuuuucaguuucccaccacuuuguaggauguugaaugagaaaaacagucggaaguucaucuuuucuggccccuuucagaggacuaccgaacacuaaaaaauaaacaucccucugauucaucacgaagcaaguuucaaauugaugagguuggaaucacaagacaacauggcgacgggcuguggugcccggucacucuuauaacauaaugaaugccauagcacggugaacagcuguuugauauagcuucuuccauuaauuagggcaggaugaggcauuauuguuaguggcauuaaaaugagccucauguauuacucaacaccaucugcuugcaugaaauuccaugguagcaaggaauuuugccagauuagugaguuuagacauguguaggugcuggguggcagagggaggugcauauagaugucaaaaugcuaccagaccgccugcuaugaaugguaaacaacugugcauccucgcacagccuucuugccuggaguucauggauauuauguaucaaggucuaacaccgagugguaccuuuucuccuuugcccccagguaugccagcagcaccccucucuccuggaagcccaccaggcccagaggcaccagcacugccuggagcaccgacugcaccagcuucacccuggaaugaaaaccaugugaaaucaauuauuucaguagcaaaagaagaaagccaagacugaaacucuugaagaauuccaauuuaaacacuuaguagauggcauucuuggcugcauagagacacaaaggagcaucauugaaaggcagaaggauggaacugggggccugcuauuaaugacacgauggcuaaaaagaagaggacagagagugggugccugcuauucuucuacaaccuguaucuuguccucuuaaggaagacaagcauggacaagaagaagguggaacaauggaauggagagauugaaaaauguuugcccacaaaccuuuucaaugauaagucucuuagcccaggcaagugacauagaaagagaccccaucaacuugggagaugauugucuccauaagaguggagaauguagcuuccauuuuuauaauaagccucaua

SEQ ID NO: 2831 - RNA, 13325 nt, Mus musculus
caugcugccccuagcggcgggccaaagcagugcaugccgcgcccccaccccaucccccaaggcgcccgcccacgcgccccccuccgcccccgcugcucgcgaagcacgcugggauuuggcgcccccccuccuaggaucucucuauauaaggcaagcaguccggacucccgauacacgcguuuccaacuugaguuggugugugucgaagaauccugaccaacuacgaccuggggagagcagccaaccgagaagguccaccgagccucgccuaggucugcugcgcgggcugcgguccggagccuucuccggaccgcggucacccaguggaccgggccgucgcgggaccccucauccuucguggcaucgcagaggaauccucguguggugaguaugguuaggauuuuuuuuuuuuuuuuaacuccaagaaaacggucacacgcaauccccguuuuacaucgggagcugcgggagauaaaaguagcgccccccaaaauaucuccucgcaaauuuugucaagccuucaguggccagauccugagacgagagcguggaaagcaagucuucacggcuucggguccgcgaauucgguuuccacgacucgcguccagaaauggucgguagacacaugagcugcggacagcgaugagcugcagacgcacaugagcuacugaccgaauugugaugagcuccccaaauacgcugcaaagugacuggcucugcacucuuaagugccgcgcuacgaacggauugcacugcagacggccgcgucuugcgcugugauaaacuaacgggcgcuucaugcgcuacaaaauccuaauaggcgcuucaugcgcuacaaaauacucauaggcgcuucaugcgcuacaaaauacucauaggcgcuucaugcgcuacaaaauacucauaggcgcuucaugcgcuacaaaauacucauaggcacuucacacgcuacgaacugaugggcgcuucaugcgcuucgcuguacuaaugggcgcuucaugugcuacgauguacuaaugagcgcuuaaugcgcuucgcuguacuaaugggcgcgccaugcgcuucacuguacuaaugggcgcuucaugcgcuucagcguacgaacgagcaaaugaaacgggcgaacaggcgaaccugugaacggggcgaacggggcgcuucaugcgccacaaaccagcccgaacuacggugauacccaaaaccgauucguguuucacguauucaauuuggaaagcugcaggagaguaaccaaacgcaaaagcgcaacaagagugaauuuagaaaaugcgcuacaaacugcggcacaggcauaagaccugcagccucuuaagugacacagaaaguagcguugggaagacgagagaacguaucucuccuuggugaggggacaacacaguucaccuuucgggucaaaacuggcuccguuuuccugucggacggcuaucugcaugauggugguggugcuggugguaaacaaaauggagcccugggaggccaaaauugguuuuaacauucugcccacguaacuccugcuuauggcaguggaguggaggggugcuggauuuuggagauggcggaauggccugccuugucuaguggugauugauugaggugacggugacggugcacuggacuuggggacacgaauggguguccagcaacaguuuguggaaacuguccgguuuucugggugggcacgaagccaaggugggaggugggagaugaugggaggugggagaugaugggaggugggagaugaugggacggugggaggugggggauucacucuugcugcacggaagggaucuggugguugggagcuggugggaggggucuggggagguaggggggcggggggaggcaugcagucauucugcagcccuguuguagccagucucagaccugccccgcccaucuagccuugccucaucugcagagaggccgcgcgccucgccugucgcgcgcuuuuccagaacaugcuuccacaggcccaaccucccaagugcugacgccuuagagccagccuaccugguccccacccccaaggcccgccuccucugagguggccugccuagcccccgcccccaaggccccgccucucuuacuguucagcuccucccagagcuccuccaagguggcccagagccccgccuucccccagccugcuugcgccugcgcaaugcgggcugcaaccccucccuucagguuugccuccagugcgcaugugcgccucugccugucugagccuggcugcacagccccgccucccugcgguuucucuguugcgcgguuuuauuuuuuguccacaggugucuaguaaauagaagaauaauaagaauaauuaacaacaauaauaauaaguauaccuaacaugcauaagcacuuuuaauaagugcauugcauuauuaaauaaaaagaucccacaauuaaaacuccugauagugggggauaugggaacuuuuaaaaaggccuaacugaugccuugaagcaaugaaggcaauuacuuauuuuaaauuaaaaauuaaauuuaaaaauauuuucauauuuaauuauuugaucaagacaccauuggacuuccuggaauuaaaugcuuuggaaaauacaaagccagaggugacuagcacuguguuucuuaggaguuuucaggggcuuuagugucauggcuuggcuucugagagagauguuuguuagaauagaaaagguuugucauuguuguuguuguuguuuuuguuauuucuuaaacauucuaggugauuagcccuggcugaccugccuacauauaguaaagugugcuuggcacauaguaaggauuuauuaaauguguguuaaauggccagaauaaauuaauuauucauugucuugcugcgggacuucaaguuuuuugaaauuuuguuccuuuuucuuaaggagcuuugcuguccugaguugaguugcuggcccuuuugaaaacacauuuaaaaguuucuuuuuaaaaaaguaugguuuugaacuucaguauuguaagcuguaauuauaauaugaaccaacuaaauuauauuccaaauaacuagcuuuuuucauaaaaagcuaauuauuuguuaucccaaguaauuagcuuuuuucauaaaaagcuaauuauuuggugucccaaguaauuagcuuuuuucauaaaaagcuaauuuaaauuuggggcaaguggguuauuaaugcuacauauugacauuucaaauucaugugauauaacagggugguuacauugcaggacagaaaugguuacaacuggcuuaauuaaacaucuguguaauuuacagagaagccaaauagaaauguuucuaaauuaaugaagaaauuaaaaaaaaaaaaucugguuccauauuauuuacuaugagccagaguuuuguuaaagagagaaauagggggcuuuugcucccccaaucuccugccuuccuagugccccucccuaguguauaacuaucugugggaaauauaugcuuauaauuacagcuugaaaugcaugcuuugcuuugggaauuuuaucugcauauuaaagagauucaaaacauuggaaaauauaugcaaauuacauuucacagauaauucacauaauauuaagaaaaugagauauauaaaauuucaaagcaacuaaaaguuccuuaaugguguuucauuucauaaugagacauuuacauaugauuuacuguuguugcucuuuguguugggggaauuaaaaauacuuugaagaagucauuguaaaggguuaauaauuaaucagauguauuuauuuauuuauucuuaacugauuaaaacuuaaugaucauauaugaagaugguccucucucaagcagcuggcuuauacagugugaacuuucaguucucaggaaugagaucucagcagccucauccccacacccaguccagcccuuuaagagggguuuugaggagccccaauuuuuaaaucaaauuaaaaugaaggcaaagugcuccuugccugucaucaaccuguccuucccuacaguaaacauugucauuacuuguuuaugguuacuguuaaccaguuugcccaauaccuuauaacuucuuacugguuaaacuacuuugggguaguagaguccuaccccaaaauuucaagcccacccccacaggccuaagccugaggccuagaaguggugaaggucacagaucuucaacuggugaccucacaagcuaaauaaggcacuuaauuuguuuaacuagcauuauauuauuaaaaaccaaaagcaaagccccuugaauagcuuggugggaggggcacaggccgaguauaguccccccgccccccaucaccuuaacuccaagcucaccuuaaaugaucuuacugagcauagugauuguuugcagcuuucccucgcaguuucggaccuauaguuaggggucuuuuauaggugauaauguccaccagaccuggcuucaauaaaucucaccccaguagggcaugcaccuuccugaccugagucaggcuguaccaggccaugcugagaccaucuuaaggaagguuuuaauuuuuauuuugaaguugucauucuuuucuagaugacagaagucacacuuuagucaccuguguguucugcuuauuggaaaggccauaggaacaacuuaggacaaaaggaaaaugucugcagaugguuauggcaggggaggggccuaaaggauggggcggggguggggguggggccuguacuuauuaagaaagcagggggaugggacaaaggugaugaacaggugucaugugggaugucaguuuuccucuauuuuuuaaaauauucaacagguuaaaauauuaucuaacuuugcuaauuaacaauuuuuuaucuuuuuguuucauggaauuuaacuagugcccauuuugccuugauugguaaaagaaaaaaauuauuuuaaaacuuauguuuguucaaaaguuuaaagcuuuauguccuuaaacuuuuauugagcuuuuuaaauuaaaaguuuguaacuauuaaaaaguuuuaaacuuuuugaaggaaaacaacuuuuaaaaguuucuaaagcuuuaagcuuuaaacuuaaaaguuguaaguucaauaaacuuuuaaauucuuuaaaaaguuucuagacuguccaauuacaaaguuuauacuuucuaaagauuuaagcuuuaaacuuaaaaguuguaaguucaaacuucuuaaaaguuuuuaaaagccuucaauaaacuuuguuaaacuuuuuaaaaaguuugcuagaccgaccaauuacaaaguuuuuaaaacuuuaaaguuuuaagcuuuaagugggaacuugcuuuuuuuuuuaauuuaauaaacuuuguuaaacuuuuuaaaaaguuugcugggcugucuaauuauaaagauuuuaaauuuuuuguucuuuacuauaauuauuuaaauuuugcuauuuugcgauccuuacaaauacauaaguauuaaucacucuuaauugcaccuaacccuauuucucaggaaguacauagguagucacugugcugugauugcacuauaaucauaaugaaaacauuuaaacuacucuuccccccccccacacacacacacaguuaccuucuuagaguucaugcucaguccaccuuaauuuuacaagccuuuggguggggccauaaaggcuacauacugucaaccuuuaaugcugaugacguucuguauuucuuuuacugauaaaguaaaaauuuaaaguaucuuuagauucaggaugcccaaguugcaauaguuauagcuccuccccacuuauacagaaaguagcuuucuguuauguauguaauaaccuuauuaguuaacaguugugauugagugauuucuaccuauguuaucuuuuuuaggguucuuuuuuucuuuauuaaauauuuuauuuguuuacauuucaaauguuuccccccuuccuggucccccaccccagaguucuucaccccaucccccuuccccuuugccucugagaaagugcucccccccacccucccacccaccacccccuacccuuuucucucacucccuacccucccacccccuuaccuauguuauguaauuaaaacaugaagaauuuaaauugugcuauuaucgggcauuuuuuuaaaaaagauguccuaguguauagcccauuucuuccuaguaggcaucaauuaauauuuguuuaauaauuuccuaauaaaguaaacugacauccccaugagcuguucaaugcuuuuuuaucccauagagaauucuccugaggaaguuaauuuguggucauaaaagcaauuagauaaucuugugguuuuugugauagugguuguugugacuuaauauucaggcuucauuguugagggugugccucugaugugacauuuggccaacugcuuugauuuuucggagcugaugaguacaggcauugugguuuuaauaccuaccucucaugugugugguuucuuauugauuaggguguuauuuucuccuaagguucuuauuaguaaaagguaugauguuggaaucaauuugcaugauuuugaaguuauuuugcauaauuuguuuucuacuuaucugccuuggaaguuucuugcugugugaccucuauacccaaacaaacaaauaaaacccaaacuuacuuaaagguguaugaaaucugagaaaucucuggugcucuuuuccaugaagagcuggcacugauacaugaaaggacccagcgugccaggguugccaucgaacuucucaggaaggucuucaaggcagcauaaagguguggcgcugcugaaggguuauauuauuaauuauaaagagcaagugaaggaguauguguuccacuauuuugugaaugaucaccucauccucuugaggguguguauucuguugacuaauuaucaggggcuauuugaacaccuaaaucccugcuaauagcgacugcucugaaugaauauguugaauguaugcuucuguugucauuuacaggaacaggcggguuuuaagaaccaaaagacgccaaccacgagggucccaggauccagggcucccuccccaggggagugaagccccucucaccgcagccauggcugcugcgggugguuccuccaacugcccgcccccucccccucccccuccucccaacaacaacaacaacaacaacaccccaaagagcccaggcgugccugacgccgaagaugaugaugaacgcagacacgaugagcucccugaagacaucaacaacuuugacgaagacaugaacaggcaguuugagaauaugaaccugcuggaucagguggaguugcuugcacagagcuacagucugcuggaucauuuagaugacuuugaugaugaugaugaagacgaugacuuugauccagaaccugaccaggaugagcucccugaguacagugacgaugaugaccuggagcuucagggugcugcagcagccccuaucccaaacuuuuucuccgaugaugacugccuugaagaccuuccugagaaguucgauggcaacccugacaugcuggguccuuucauguaucagugccagcucuucauggaaaagagcaccagagauuucucaguugaccgcauccgugugugcuucgugacaagcaugcugaucggccgugccgcccgcugggcuacugccaagcugcaaagauguacuuaccugaugcacaacuacacugccuuuaugauggagcugaagcaugucuuugaagacccucagagacgugaagcugccaaacgcaagaucagacgucugcgccagggcccugggccuguuguggacuacuccaaugcauuccagaugauugcccaggaccuggauuggacugagccugcccugauggaucaguuccaggaaggucucaacccagacauucgcgcagagcugucucgccaggaggcccccaagacccuggcugcucugauuacugccuguauucacaucgagagaaggcuggcucgugacgcugcugcaaagcccgauccuucacccagagccuuggugaugccuccaaacagccagaccgaucccaccgagccugugggaggugcccgcaugcgccuguccaaggaagaaaaggagagacgccgcaaaaugaauuugugucucuacuguggcaauggaggccauuucgccgacacguguccagcgaaagccuccaagaauucgccgccgggaaacuccccggccccgcuguagggggaccuucagcgacagggccagaacgaauaagguccccacccuccgaggcuucgacucagcaccugcaagugaugcuccagauucauaugccgggcagacccacccuguuuguccgagcuaugauugauucuggugcaucuggcaacuucauugaucaagacuuugucauacaaaaugcaauuccucucagaaucaaagacuggccagugaugguggaagcuauugaugggcauccaauugccucgggcccaaucauuuuggaaacccaccaccugauaguugaucugggagaccaccgugagauacugucauuugaugugacucagucuccauucuuuccuauuguccuaggaauucguuggcugagcacgcaugacccucacauuaccuggaguacccgcuccauugucuucaacucugauuacugccgacuucgcugccggauguuugcacagauaccuucuaacuuacuguuuacagugccacaaccgaauuugcauccguaucuacuucaucaugugcauccgcauguccauccgcauaugcaucagcaucugcaucagcaucugcaucaguuucugcauccagauccgcaucaguauccgcauccggauccgcauuaucaucaucaucagcaggcggauaugcagcaccaacugcagcaguaucuauaucaguauuuguauuaccaucuguauccgguuaugcaccaccaucugccuccagaucagcaugagcaucugcaugaguaucugcaucaguaucugcaucaguaucugcaucaguuucugcaucaccaucugcauccggaucugcaucaguaucuguaucaguaucugcauaaccauaugaauccggauccacaucaccauccucauccagaucccccucaggauccacaucacccuccacaucaggauccacaucagcauccggauccccaucaggauccuccacaucaggauccacaucagcauccggauccccaucaggauccuccacaucaggauccacaucagcauccggauccccaucaggauccuccacaucaggauccacaucaggaugcacaucagcaucaggauccccaucaggaugcacaucaggauccacaucaggaugcacaucaggauccccauauggauccacaccugcaucagcaccagcauccgcagccgcagccgcauccacaacagcauccuaaccauccucagcagccaccauucuucuaccacauggcuggauucagaauuuaccacccuguaagguauuacuauauucagaauguguauacaccuguugaugagcaugucuauccgggucaccgggugguugacccuaacauugagaugauuccuggagcgcacagccugcccaguggacauuuguacucaaugucugagucugaaaugaaugcucugcgaaauuucguggacaggaauguuaaagaugggcucaugacucccacuguggcgcccaauggagcccaaguccugcaagugaaaagaggguggaaacuccaagucacuuacaauugccgagcuccacagaguggcaccauccaaaaucaguaccuacgcaugucucuuccaaauaugggagacccugcacaccuggcaagcuauggugaauuuguccaaguuccuggcuacccauauccagccuauguuuacuauacaagcccgcauaugaugacugcgugguacccaguaggacgagauguacauggacgaauaaucguugugccuguuguaaucaccuggucucaaaauacgaaccgccagccuccggugccccaguauccuccuccgcagccaccuccaccaccaccaccaccuccaccgccaccaccaccuccaccagcaucauccugcagugcugcguagaaccugucauguccuuuguagucucugcccucaacuugauccugugcagcuucucaaucuaugacugugugguacuggaccuucagaggcgcacagagcucaagucaguuuucgucuugacugccacuuuauaaguugacaggccuggguuuuacuuguuaaaaccucucaccaucucaaucacaggcugccaagugucuuuacaaagaagcugauacaaacacaggccaugcugauuucuuacagagggagagaagaggaagagaagaagaaagaggaggaagaggacaugacuugcccauaugcugggcaccuuauaaaggaagccagacuuuucggugcaguauggaaaggcuuccgugauucucuugcugcaccccacgaaacuucaccaccuucaaacuccauuuucacgguuccguuaauuuucaaggagcagcaacucgacugguucucugcuacaugaaacaccucagcuugaaaaggaagugcucucucagacugacuugugagugugccuucacauucuggugcaaaucauguguacccaagaacucugacauagcaucuuaccaucaucaugccaggaauugguuuccuuaaagugugacacuuggcaaccagaagcgucugguggcuucagguguguuaggguuuuguagaaaguuguaaccaccucucagucaugcaagaggguacaucaaaaagacuucuaaauuugguacccagacuuugacaagagccugugaguuaguucauuguaaccaacuugucaggaacuucagcaagaauuuucaugaauguuguuaauuggcuggagaaauaccagcaaaguuuugcaaucauccacccauuugucugccauugugcaucuggacauccaucaaccgcccacucaguggcaucuaccaugaagauguuuagagacgggaaaugauuuugcacccagauccacacuccucucaugucagauauuuggaauuagagcaccgggaaucgucuugaagauaugaacuucuaagaauggagucucuugcuacuaccuugaaacauuuguuuauccucucuuucuguuugauucuacuacuaccauuaacccugcugcaggauuugucaccauucugccugacugcugagacuccauuuugcugcuaugcaaggagaugaaagaggcaggccuaaaggagcaguaggacauaacaugguuuuuauuucuaucugucaugaucuuaauggugaaguuuccuuuuucgucagcauuuaucucuuuguuauccugacauguuuuaauuaguuuaguggguuuuuuuuuucuauugguggugguguucuuuuguuguuguuuuuuguggucgucauuuugauuuuggaucacuucguguuuuacaguaauuacuuuuaaauggugcauuugcuucugauuuuuuuuuuuuaugaagcaucacaucaguuuaccucauaucucaauuccauccuucaugcauuuuuuuuuuaacucauuugaucuucaagcugcagagggccuagcaaugggucaucaccugcagcccuggcauguacacacggacauuugccaccacugaaagcaaacaguuggagaaguuggccaccugagucaaggagguggugcuggugugaguucacagcucacaggggacggugaacguugacauugacuuuggcaguguguacuaugcucuacuccuauauauacucuauagauguuaggcauuaaggauaagugaucuuaaauuuacugaaauuuuguuaaguugauuagauuuacauuaauuguuuauauuguguuuuuucuuuuauuuuagcacuuccaacaaaaaugccuuuauucauuuauuaggaagaaauuggaguggcgaacacaaacuagcaaaauuaauuaauuggcugugggcccaaauuugaauuccuuauuaauucaaagugaaggaagugugagaguuucuauugcuggucaugaaguucaccacgaagagucaguuuaguuuguaccgagaggcauuuagcugagagugauuugaguugggcaucucuaugaugcaguccagacuuguguuuaaguuuacagguaccucuuggacuccugaauugaucucgaugucacacaucaucgacaucccgcaucccacacaguuccaagauuggcgacagagagcauccuguuggagagaccugaccagucacgaaggaccgccugcagacucuucugcaggaccaugcuacauauucagcuggagagggaacacgcaucugaugggaauggauuguuuuugcuuguuucagaauuuugcuguugagauguuguuaaacuuugcauuguuuuucuuuuuucuuuuuuuuucccuauagucaauuaagaauaagggguagauaaucauaaguauuuugggcugggagggauuguuaaguaaucuuagguggguggguaauuuaggaaauuaaguuaggauaagauaggauaagauaagauaagcuaggauaaguuagauaaauuaggauaaguuagauaaguuaggauaaauuccauaagauaggauaaguuccauaagauaggauaaguuaguucacauaggauaagcauaggauaaguuagaucacauaggauaaguuagaucacauaggauaaguuagaucaaauaccucaacaaguggacgaguguacuuauuggucccuuaccccuaccaacuuuaccuuuaaggccgagcucagagggaacuacagggaaaucaguguuaggagugaauuggacauggaugacauucuagugaagguuaggacgauuagaguaaucuaauacaggcucugggaauuaacucaagggauuuuaggaaugccagaugacagucaucauuugauaaaacuguugcuggaauaaaguuuagaauguugaaugguaaauguuaauggaaauuguacgaaaaugaauaaaagcucuuuccauaccccucccccucccuaccccacucuuucuuuccucccccccuccauaaccuaccccuucucccaaacacaccccuccauuuccuaacucaccacgucuccccuuccacucccuaacccaccccuucuucccucccucccuccagaacccgcccccaucuucccccucccuaacacaccccuucuuccuuucccccuccaaccccacccuucaaacuauauuacuguauucucuuuauuauauuucuuuguauuaauaaaacuguauugauguuacaauaaaaauucaauaaauaaagacuuagugguuaaggcaaauu

SEQ ID NO: 2832 - RNA, 4233 nt, Mus musculus
ugucucugaauagggaggauacaggcauggagcacaggcaaauggugauuauaaagguaaaauggaaacccuccauauuaggaugagguguuuauuuauuaauuuuuauuuauuauuggggggaguaauacaggguuucucuguguaacaguccuggcuguccuuugaauucuucuuacagaccaggcuauccucaaacucacaggaauccgacugccucugccuccugagugcagugcugggauuaaagguguaugcuaccacacaaggugauuaauuuuaguugggcauguuaauuuggugagucaaagaggacaucugauugcuagacuucaauacuuucauaggugaaccuugguagucagcuuugggaggagaaguggccaaauaagggaauagaucuuggggacuggcuuuaggaaugugaucuaagaauuuuuagcaaggcagagggaauaggagagaagggagaggccugcuagagcuacauuugccacacuagagcuucgagaguccugucauccccucccacaagguguauuugguaauggggaauuaaggagaccuguuuauauucuaaagaacacugcuuaguuaaaaguuuuguaaauaguuuuaugccaggacaaaauaauacucuuuacuuuuaaccugugcaaucauuuuuuauucagacauuaagauuuuauaacuuucauuacuucaaggaaggaauagcccagcugaauguuagagggagaugucaccuuuuaaguuccaaaacacagccguauguugccgagagcuuagcuguucgacucuuugccuuguaagcaugaggaacaaacuuugauccccaacacccacauaaaagagcuaggugugugguuuguguuuguagugccagcaccgggcaaggagauuccugguacuuucuggcuaaaagccuagcauauuuaguauacuuuaggccagugagaagcugccucaaacaacaacaacaacaacaccacauuguaguugaugcccuacagagcaaccccagaagcugucuucuggccuucacguacauaugcaugcaagcaugcacaacuccaugcaugcacaaaauguaguuauugagaagacuccaaauaaaacuaaugauuaaaagccaugcacacuuguaacucgguccauuuugaaaaauaugauaauuucuuuuuuauccuaugcaucauaacuacuggauuacuuaacauuugacuauuaaggcuuuaacugaauaaaagaagcauaagcuaaauccaaggggagugggauagugaaccauauccuagaaaauccaagaguucaaagagcugaauucccagcuuagguuaaagucagugugaaguggccccacauuccacucccagaagccugaacagacaguugcuuuggcauugagaaaaacagaaggaagagaucagauguaggugagagaugauaaucauaugucugccgucacucaguuucccauugaauggucaaagccauucugaagccccaagaaguugagaguagauugguaguuaccagagaccaagagaguagggguuuucugggaauggaggagggguacugagggcuuaaucauugaguucuaaguuacaguuaaauagagugaaggagaugaagagaguuauuacccaaggcaacugcuauagaugacagaaaugcucucauuauuucaaaaaucuuggagaaagaaucaugaauauuuucaccaccuagaaugaccaauguuugaggagauauuuucagucugacuuaaauauuacacaaaguauaacgcuucaaaauaucacagcaauagaagauaucaaguuaugagcuuacuuaugccauguuaguaaacuaacaaacaccuccuuagcagaaccaaaugcaggcccucuuaugacuuuauacuaugcacuacaaaaacgcuuggaucucaacauccaucuuugaaucuacugagggcaaauaauuuguugccuguugagguuaugcaggcuguaagaaaauaucaggucaaagcauacucauauaaggcaauggaugacugggugagucacguggagcauaaucuagacuuguuuuuaagaaacauaugcuccgcccagggaguggcacuauuagaagguauggcccuguuggaguaggugugucacugugggugugugcuuuaagacucucauccuagcuuccuggaaggaguauucugcuaucagccaucagaugaagauguagaacucucagcuccucuuacaccaugccggccuggaugcugccauguucaugacuugaugauaauggacugaaccucugaagcuguaagccagccccaauuaaauguugucuuuauaagauuugccuuggucauggugucuguucagagcaguaaaacccuaagacacauaugguuguaucagguaguaagacuggaaaaaggagaacaaaaacaaaaacaaacaaacaggaaaggaagugggugagggacaaagagaggaagagaaagaaauggauaaacucaaccagagaugauacagagcuggagagagugaaaugagagguagcccaugggagaguauaugcaagaaaaugauauacuuaacagaaaacguagacaugcacaucugagagagagagacaugguggcuaaaguaagggauuuagcuugugacaaauugaaauccgagaagaaaggaauauagaauuuguaauaaauaaauaaauaaauaaauaaauaaauaaauaaauaaauaaauaagugaucacauugcaaauuagaaauacauaucauaucuugguaaaauugcagaauaucaaauccaaagucuuuagaaagagucagaagcgaaaagccuggcaucaucaaaaagaaaacauuaccauggucaaaagggaaaccccagaaggugccacacacuccgguugagucagcuugacaggccaagaggccuggaagcacuuaagaggcagagaguuucacggaaacucaacuucuggaguuuggcguucucauucaaccacauacucauacacuauucccgaguuagucugguguauggauccacgugcucucuuuuaguauuaucuuauuauaagugccuuuuaagauugaauucugacauagcuaagccuuugccaguguucuaauguccuagaaaguccuugagcugaccaugggcuuggaauucaguaagaauguugccuauucagugacauucagaauugccucugauauuacacuaucacuuugaauaaaaacuaagugacugcccuacacaggaauuuaccaucaucuaggaagaaggaaguuugagaccuaaggaggaaccagaguagauacuuagaacuauagauggcugaguuacacccauacacacauauuuacaauggccuagggggaagguagacuauacaauagacuaaaauaggaacuauggcaagggcaugaagcccuugacccuggcuucuaagauuaaguggaccuuagguggagcucuuuuugaucccaguuguuaacaaugaauucuaucccaggugguuccugucagaccuucuguguuugcauuccucuguuuuguguaagaauccaguaaccucuuuguaccuuguuggugugucacccaacuucccuauuuucuucuguauaaaaaguuugaugcuugauuugacaaauuacauucagauucuacacaaccucuccuguguuggucugucugucauucccucugacgcuuugcccaccugccccauagacccguucuacacagacaaugggauccagagggucugcggcaagaagguccaauaacuucagagucuucugaaguguaugcuaaguguguguggcgguaccuucagaguccagaggaagguaucagauccugugcagcuggagguacaaguagccauguacagcucagcacaggagcugggaauggaacuuggcuccucuacaaaagcaguguacauucuucaccauggaaacauucugacaagcuuccuggagagccuuaaaaaauggucacccuguuucuaaugaaaacuuugaauaaacgaugacuuauauagggagauauaagaaugaaaacacaaauaaauugucauaauagagcacugguuuuaauuauauucauuagguauuaguauauauagaaauuuuagaaauauauaaguaggauacaaauaaaagcaaacuguaucgaguagaguuaauauaauaaaaacuuguaccaaucu

SEQ ID NO: 2833 - RNA, 13499 nt, Mus musculus
uguugccacacaguacauuuauuccuaaauuaaauaaaggcaaucuggcauuucuguuggggaaaaaaagaucuauacuguugccuucuuugcucauuucuuuccagucaguagagcuuguaccauuuucuuucuguugaauagagauguguacuuguguucauuuggcucaaugacuccucuuggccugucuuuucucccccuugcaucuuuaggcuucugaacugauuacaguuuggaucucgggggguugauuacauuccacuggagucuuuccuuaaaaaaaaaauaccucuguuaccuuucaauucacauccgugaggcaugcuuuucacucaaagggacaaaggaaacuuuacauuaguguagugcuuucugagaucagucccaauaggucgaaaccacaacuuucugaauauucacacguauucaucacuuuuacuaaaucagauauuuuuaagugcgacuauuacauucacuuuaccauuuaaucucccacaguggcccugggugcucuguagcucaucacuuaacuuugaugacacagugcuuugaguuccaaaauaccaaagaccugagaaagacuguuggcuaccgucucaucccaacuaguucuucuuuuauuuagaaacuugauuaaagugacauuaguuucaaauaucuguuguacuugccauugcguagaucccauaaugccuauacacaggaaggugucaauagaaacauggcgugaaaaagacauagggacucacuaccuguccaucaacauagguagaagaggauugaacaguuaaaaaaaaguguacucuuaugauauuauuaugguuuauguuucaguauauuaaaaaugaaaucccuguuccacagauuucucuacuguacagucaauuguugguagguaggccuguaucauucuuagaacauuacccuuagggaacuuugauaaaagacagaaguuuguuugaaacaaaaaagaaauguugagaacgagguagcuaagaaagaauggaaggaauucaugauggcuaacuuaaagaaagaggaguuaagaaugaagauuauaaaacaguaaucuuaaaauguuuacacaguuguguuguucagacucaaaugcgcugagaguagguccccugcuacuggaggggaaaucucucagccguucuugcuaacacugacugcucuuuaagaaagguguugcagacgaguuuggacaaguucuagaaagaggcagccaagcagcuccacucaaugauuauugcugcucuuucugaccaggaguuuauaugauaauaauagucucggaaccaucuuucuguaauaccaguuuccgacuauugaagguuguuucauuguaguuguggcuagguauuacggacacuaacucauugagaguauggcuuaaacugucagcuguuuguacagagaagcaucaaguaagcugugguuaggccacucguggcugagaugccuggaaucuaaccccaauugcuaugagauucugcuuaugcuaaccuuccauuuuguguuuagugaacagcugcagauaguuuuauccuacuguguagaauucuacagaacaggaucggcuucuagagcucugacagauguugagugcaucuuacuuaguucccaggauauguaaaugaccuuugucaaggcugaggccaaauuucaaccuccauacaucguuaacugguauucugaaaaauaaaucucucaucuuagauuuugaaauaacgugaagaaaacucuagcaagacagcgguggcccaggccuuuaaucucagcacucaggagucagaagcaggcgaaucugugaguucagaucagccuggucuacagagagaguucuagaacaaccagggcuacaauggagaaaccugucuuagaaaaccaauagaaauguaaaugagcuaaauaccuaauaaaaaaugaaaaaaaaaaaaaagaaaaccaauagaaaagagccaggcagugguggcacaugccuuuaaucccagcacuugggaggcagaggcagguggauuucugaguucaaggccagccugguguacaaagugaguuccaggacagccagggcuacccagagaaacccugucucaaaaaaacaaaaagaaaaauaaaagaaaggaaaagaaaagaaaagagaaaggaaggaggaaggaaggaaggaaggacagaaagaaggaagggaagggaagggaagggaagggaagggaagggaagggaagggaagggaagggaagggaagagaacccccauuccaucucacuaaagauauaaugauaauaaguccacuaccaauauaccucuccugaaauuaaacucgcguguauuaacgucuuuguaaagacaguacuaucaaaugucuggccuuggccagaauacgaugaacuucagauuuaguaacacaucguccuuccaagacugugcugucccuuugaagacugucucuuuucaugcucauauuaagcuuagaagcuaugcuguguaguagaaacaaucauguaacccaggcuucuuucucccuugcuccugccccgcuaacacuccucuguucucguucucuucaguucuauugcguugcauaacuuaacaaggcagagcucugcacauauuugcacuacuaguaguugcuacagagcuuuuccagaaauuaggcucacacauggcacaugacgggaagcuccugugcuagccagaugauguuguuggguaggccuugucuuugaauaaugugcucgacacucagaugcaaucguuuccucuugcagcagugccugauccuccauguugauguuuuacagcauccuguguacugugucaauguuguugggacccagaaugcucacaaccugaucacugucucuaccgauggcaaaauguguuccuggagcuuggacaugcucucaaccccacaggugugucuguuuucaccuccgcauugaaggauucuggcucaaagaccugccucuucaagaacacaucuccuaaaggcccaaaggccugguuucagcaagucagaccuugaagccaaaaccuauuuccucuaccacaaauuaugucauuauugcaaucuguuaauccuugggucaguuucaaaugaaauggaauaauccauuuuaaagcacagggauuacagaacuugccuggagcgagaauuguacucacccuacagcauugggaagucaugcaaacgacguugcagcucagcagagcagcccuuccuggggacuugccuugaaggaaaaguaucccagcaaaacagaaacucaaucuguugcuuguuuccguacccuagacaaccgccuguuuuccucucuggagcguuugugagcauuggcucuugccaauccuugcccaauaagugagaaguugaaaaugaaccagugccagugucuccagaccacuacugaucacagccauggaagccaaaccaaggagcagaguagggaggacugcuggaggcaggcaucugagugccaccuucaaagcaugcacgugugacaugcacaugugugcaaacaugaaugcagacaugcucauacuauccacauaucuuuaugugaaaagguacagcgcucucccccaacuuaaaaccaugaagaguucacugggcuaguguuuggcaguuaugugaggaaaaucagaaaauuuccagaaaauaauucugagucuuaccuuugccauccauuccccugggaaugacagcucuaaaauaucucucauuugauuucugaagagcacuaguuucaagacguauaaagacauauggaagcuguaaagaaucuccuuuaaggcucuacagauguagacaauacuaaagcuaaguucuucacauaacuuuagaggcaccgagagagugcuaaugugcagcucacgauucagguuccugguuuugccugacuuuauacaggccugcaguugugugcagagaguuuaugguuuugcuuuaaaauucucagcaauguguuguuuucuuuuaaaagcacggagauuauaaacagauaucagagcaaacccucuauuugggaaguuuuaauugcccauuuugcugauuaaauguguuuguuuggguaaagcaaguggugugggagcuccgagcccauuuuuauuaguguuagcaugcccacagacgccuggcucuguguggagacaggguauuucauggucuggucuccaaggacagcagagacaaguggggcaucgcacaauugccugccccuaccccuaccccuccccccaggcccaccuucacccagugaguuaccaucaagcaaucccuuacuugcugcuaacguuagaggcagggcagaacaucagauguuccuguuuucuguguuacugucaucuuucccuuuaaucagcauccuacaaugcucucaauguagggaugucaauguaggaugaucaguaucacguggggccucaggguccgugugacuguauccuaucagcaagcauuuccuauucauagacucugaggccaaaacagcucguuuaacuuguacaggaauaucugaguuccuguacaacucaguuugucccaagcuucagacacauaaaauaggcuguuugauguaaauagccaggaauaaucaggggcaugguugauauguauccuuuauugucauuaaacuuaauuuagcagaacaucuuuuuuagacacguaugucugugugacugcacgcugugugugcaaaagucuccaugcaagucagaggcaucagauccucccgaguuggaguuacaggcaggugugagcugcccuccuuggaaucagagaauggaacccugguccucuggaagaacagccaguggucuuaaccacugagcaucuagcucuccaucuaccagcaucaggggugacuuuugacauacucucuaacucuccauuuaacaacacauuuuaucauaauaaaggcuccugugcucuguuagacccuguacaacuaacaaccacccuucaugggauccucuucccguugaagucugcuuuuauaggaccugagugacaauucccuggucucagugccugcaggacccacagucccuccaugacaaauguguuuaguacaucugauauuaauacacgaguauucucaugaacaauugauuuugaaaauguuuguaaauacaaggguauuguguguuuuauuuaagccuggagcugacaaguauaaucauuaccguauuaucuuuaguuucugcaccauuaguuucaaaauucucaccugucaucucugacugccuggggaagcagcgguccaugcugaugaaauccagucggccugaaaccagagauacagaguggccuggaugucaggggcaguugagucuggcuucuagcacagugggggucuuuuguagcacugugugaaaagcaaacagaccauuuagccaaaugguuuuuccaugcuaucuuuggcauugugaggaguugacagauggaaauguaaccacaccauguuuugguaggagagcauggagcugguguauaauaaguccaagccuguggcugugacgggaauggcuuucccaacgggagacgucaacaacuucgugguuggcagugaggaagggaccgucuacacggcuugucgucauggaaggugauuuuucuguuucuuuuccuaugacaugguccucauuuuccaaaaucuugccaucuagauuauaaccaccuugcuuuguaagaaaguuauuucugaaaaaacaaauacaaugcacaaccccaaguucuuacuagcuuaaagcacacaucggucugguucccggugacugacaaaccuugcucacuucacaucaccuugaagaacaaaguuugacuucuucacagagccugucauacucucugucccuugccagacucacucuuugcacaugccaucaagccccaaccauguguccugcagagacugauaagcucccaguaccgccuaucccuacgugccuucgccacucagcugcucuguucucugcugggucuaguguuucugacuuucuuuugccuaagcccuccucguuaaauaaccaacacaggcacgguuccacauugaagucuuuccgacucucuuuccuuuacagcuuaugggaguucaccuuguccagucaguucauucauugaaggagcguuugauaagaacucgcucuguaucagacaccaucauaagaauacaguaacgugaaaggugcuccugagcuaauguccuuuuugagaguaaagaccaguacaaaagcacauggucacuuaggauuauaagaaucaccaaaagaacugaaguaggaugagcaggcgaggaccauuuucaguuagggugguuagucuacggacucuucuacacguaucuaccguagcagcucucacauuguuuuccagacauucaucuaccacauuucuaucacgacaugauucccauuucaucucuucuuuccugccccaguaccuggcacucagcaaaggagugacaauauaaauaagaaauaaagaaaugacaauaucuaaauaaugaaagaagucccuuaagauccucccgccaagucagaagguuugaaucggugaaauauacacagcacucugcaguccccaagacagacuggcagguuucucugaaaacagccauaacaccgaaguggaguccaaccuuuuggacuucacaggugcccucacaucuuuugaaaggaucccuguauccacaaggaugcuuaauuucucuuucaccuuuauaguucucggccaauugauuuuuuucaucgcuugcacucaucccaggcucuuuagguuuaagcucagccacacgaauuuuuacacuccaagcacacaagcugugauguuucuauugguuuggguuccaaacaagccauauuugcccugcuuagaugauuuaaagaaugaccugggaagacagggcauacacauccauguccaacaucucuacaauaauaagacuugacuaagcccacacaccaaacauaaaaagaucugaucaagugauucaguuguucaaacagucacugggcuccuccucucuacagagagccuugcuggauguucuaaguuuguaggaaccauuuaaaccugguucuugccaucagggagcugacggcaguguuucccacacguacauaaauacaugcaacacuaauaaaaugccacgcagagcccaguuagggauccaauguagccacagguccaucuccaugugcaucaauaagacaggcuuucgguugacccaaaccaguuacaaccuggguugguauuagugacauaauacugagauuccacaaucccuauauguuugucauacuuauaaccucauguauauggauuuuuaaaauacaauauuguugguauauguucuaugaguuuucuaauuauguaugucuguaugcagacuauuacaugauuuuuaaaaggcuggaaaugauccuagcuugguuaaauaauccaugucuaagaauggcuuuuaaaauguguauuccuauucucaagugugcuuuuuaaggaacauaaguuugucuuucuuuuuuguuauauaguucaacaaauauuuauagaguauuuauuguauacuagacacuuggcagcaaaaaaaaaaauguaaacuaucuucccuuauagaauuuacaaaacgaaucucuaaucucuuuauagauuccagagaaaggaacauaucauuuuuuucaaauuauauugaaaccaugugaauuauuuugagguagcaaagauuuuuaugagaugucacaacucaacuuaagaaacuuccuagaaggaguaaacaacuacucuuucaaagaagcacugaacuguaaagccagugaccucguuagagagcacgcaaauggggccgaaguaucucaggauuugcugcaucugagaacacuucugaguuuucaagugcguuuguuucacuauaacaguggcccaacaauaacacaaucugcaagaccacaggaaauagacaaacgauacaaauuguauuauuaaauucucgagauuucuuaagcaucaaugucuuccuuucaaaaucacuaugaaaaugguuucacuccugguuguguaugguuguguaugguuguuuucaccauaugcagagaugagagcuguuguuuggaagaaauguuugcuuugcaaaggucacugaaaugcuucguguuuucuuucugcagcaaagcaggcaucggugaggucuuugaaggucaccaagggccagugacaggcauuaacugccacauggcagugggucccaucgacuuuucucaucuguuugucacgucaucauuugacuggacugucaaacuguggaccacgaagguaaggaugccuugauagaaacugcuccacaggacacagcgggagaggauguuuccuuucugggauaguugcagaguacagcuguugccuggcauugaaauucaggcagccuaugggggaacuccaucuaucugggcaauauuguaauauauauguggauauauauauauauauauauauauauauauauauauaauuguaauauacauauaguaguauuguaauauauacuuuuuucaaauaaugaugacuccacagugcuucuuuccuaauucuauuaauguucaccaacauaaaucuugcugauaaucucucuaggauguguaacauuuacuuacacacauucacagcuauggggagaaauguuuguaugguuugucuugucuuggucuuugauuguguaucuuucaucuauuuugguuuauugaaccuuucgggguuucucaacugguuuauuaaaguauagguuacuugugauuuaaauguccuuuguacuaugacagaaaaaaaaagugcaguggccuagagaacaaagaguguuauagagcuggaaaguuugggacagaagggaagaagaugacuacagaaugaaaugcaaaagagaugaaagccacagaaguagcugauuagugauuugacuggaagaacugugauagagucagcaauaccuagggaaucuggggagacaccaaucuugccaaaaugagaaacucugguuucaacaaggguccccugccaagauaguaagauagaagaugacagacaggacgaaaagcacccagcaccaaccuccagccuucacagaagcacacacacuugcacacguacaugcacacauccacacagacauguccucgcacaaagaaacuagugaugugugguagccuucacugcauguagugaagcacagccaaggaaggacaugucaggggaaaaccuauacaagcugagcuuaagguuucugggaaguucaguggagaccuuugagcaggcuguuugcugugcagcagagaaggagagggcuugagcugcaguggcagauauaguagcagucagaaagcagugacaguuguaguugcagggucuggaaggaaguguggagacucaguggaggagggucucaaugguagucaagaguuguaacaacagagaagggagcagaaagcaagucaagaaaugggagagaaguaguuuugugggcguauucauggaucuucagagagauaauaauguuaggaugacagauguggcccacgauugucugaaaauaugcacagccucauuuaaaagggaaacucaaaugaaauucgcauucaaaaauuuauuuucaaauaucaggugaacauaaucuaacaauuucacaucuaaaaacauccagccagucuuguacuuguugggaaugcaaaauggugcaaaaucauggggaaucauuucagaagaucugaaaacauugcagacccuaacaagccauucucaucuuagggaauccaugcuaaagauacacgggccaaaacacaagggucucugcugaggcacagucauugaaagauuaacuaaagaaccaaaggcugaaaaaacccagaagucuucauuaacaggguacugugagaggaaaaauagagaaaaaugacuucuccacacuauuauaaauugaacucuagaaacuauaucuaaauuagaagagcuaggcagaacgaacugagaauaguucuuugucaugucuucuuuauauaguuuugaaacuuugaacagugaccaacacacauuaugugcuuaaaaaaaauaaugaucacauuacuuugaauauacucugcuuuguacauugauauggaagucauuaaaguauuuuguaauuuaaaaaaaaguaagacaacuuagaaauuaauucauaagagaauuuaauuuguaagaaaauuuaaaagaacaugaucugaaucacuuuaguguacuucaaagugaugacaaaauccccauaccgagaaaugguuugaaguggcuuuaacauccgacacuuggggauccauuccuagagcuauauauuucaaggggaaaaaaauaccagaaaaacaaacugccuuaagccauuucuaaaacuaacaugacugcuaggcauuugcugccacugcucugacuguuaggucuguauguccagauuaaauaaacagcuacgugacugucauugagaacugucauaaaauccguggguagaaaggagccacagaggcaaggacugaagcgacaguucucuaggacuccugauuuagaagccucuuuaagacuuuggggguaaggauuacauuuucauuagaaaaauccauuguucuacauucaagaaaacucuagaagcucuagaaacccuauggcgaagaccucccugauuuccaacuguucucccuaagugcaaguucuccuaguaacgaaggacacaguaggacugucuccuccucagucugaagcaggggacacggauaauguuaugccaacuacuacaaagcuuuucaaucaaaggacuuggaacucauccugaguaaguuaccaagaagggugauagauuuaagacuguuugguggauagaaaaaacaagccaacauaaacguauuucuggaucacauuuggaagauaauagacaaguaagcucaccguuuucaaauuuggugaguaagagaaagaaaaauauaauuagucuaucuuuuccgaaagacuugugcuacaggguuguuaagugguauguguguguguguguguguguguguguguguguguguguguguguguguguguguuucaguugacauagaaauaugaaacauauuugaauuguaucauuuuauaucccuaaugguuccaguaaugaucauggcuaauaauauuauaaaaauuaggaaggauacuuguaacuaggauaguagggacgccacuuuuauggaggacuugcacuaaaaaaucaguccugaauuauaucaaucuucaucucucugagauuagauacaaaaguaagcaaagaagucacaugguaaauaauaccacagguguauagguagcccugccagacuguggggaaauugacaagacaaggcauuucauuucuacaacaaagcuaaaacaaacaacaacaacaacaaacaaaaaaaaaaccaaauuaaauagaaaauauauauuaaaauaaaauagaacaaaaaaucugcaagaaagguaaaacaacaaaaacaaaacaaaaaaccaaaauauuagauagaaacuacauauuaaaaaaucaaacaaaaacaagcuugagacuuuacaaauaucucaaaauagggaucucgcacaagucuuacuuaacacugucagcuuguuuaaaagguuuagaaagcugucaaagacauaugacuacuauuuaauggcuuucaugaaucuuuaaauaugauauuauaauaaucuuaaauggcauuaccuucuagggaugcauaccagaauauuuauagaaaauauaaauauauuuucuauacugcugccagugauuugcucaaaauaagccauuugggaaagggagagccugugaauagagauaaauaagacugcguguguguugguaauuacugaagcugagugagugacauuaguccauuuaccaauaugcgugugcaauguuugaagucuucucuaacaacauuuaaagaaaaccugagaguaaauaacccugacaaauauucagaacugugaucugccucuguauuugccaacccagaagucgccagugcucaaggaaaacacacuuucuuuggagcaugagaaaagagcacaaauuauaauagaucaaggccugagaacaaggugagaagcagcuggggcacccagggucugucuuucuuucuuuugacuauugaauuuuaagauggagucucuuguagaccaagauggccucaaaaucaccccauaacagacaagccuugaacugcugaagcacaggccugagccucccuaggacugggaugucagacauucaccguggggguuggguuuugcugcugcuguuguugcuuuuguaucuguuuaagaacuguaagaugcuuguccauguugauguuacagaaguacggguaaaggaagaaaacaaaaucuauaaguguaugcuggagggaaagguaguuaaaauguuugcauaaauaguaccccuagcacgggcagagcaauucaguuuagcuuugagcaaugacaucuguucuauaauaacagagggacaggaaguacugggugggacaaacacaauccagcaggcuuagugacuggaggagagcaaacacugauaaugacuauuuucuuaacaaaguaggagacucaggucucuggugaauggaaguagaaacgcuagaggaaacagauuucagcuaguguagauucaugaauauaaaacaaauuguguaaacaaaacacaaauggcucugggcacggugguggaccguuuguggucagaacaguauuuucaugugucuaucuuugaagcagauuuuuaccaauggaggucagcgguagaaguuucuacauaaagaagggaaggaaagguuucuggguuggagcuuuaccagagugugauggaaguaaacuagaacgugggaccuggagauagaagaaaggaggcauuugguuuuauaagcucaugaaaacaggaaauaaaaacagacaggaggaggaaagggagcgagcaucuggaaagccaucgaggaucaaagaauggguaggaaggaaggaacugggaaaaugauagcaagaaauugcuauagggaaguaggaugcguggauguagcauuucaugacuggccuagcuccaaacgagguuuuaaaaaaucaugaagaauacaguugcccacaguggaaaccuagugaagguggaggucacucgaaauaggaagaauauagagaagaaggcaaaggugcugcgacacaguggguuugaaaugggucagaucaucccagaucugacuauagcagggcagaaagaaaccaugaugacagugguuaaguuuucagugaccccggcuuuucccuggaguggaagaacggugaagcagucccaaggagcaagaaagaagccuuuucacucacuguuuggaaaaugcacacacgauaacaaacagcugcugcccgagcaaggucagccuuuuagccgaaacaggaaacguuggucuaggauuccacugagguauag

SEQ ID NO: 2834 - RNA, 1186 nt, Mus musculus
ugaauaauaauuuauugagaccccucccuccuagccucuccaauucuggggucacuuucucugcuuguagaucuuguuugcaaguuccaugaagauggauggauggggggcaggggcgcagagcacugcucuaugagacucuugaggcgguuguaacugucuuucacauacuugaagaaaacagacugcagauccagcgccucauacagugcuuucacccgagccacuuuuucugaguccuucugcccauaauucuccucuaagacccggcacuguugaggagaggcuaguagcagacacugaaccaccagucagcuguauuuguuguccuggaugucagugccgaccuuucccgucacacuuggggucuccaaagagaucaagguagucguccuggaccuggaagaacucgcccaucuccaucaguaucuucagggcauuggcguguuccuucuccccaucaaugccugccauguacauggcggccgcgauaggcagguagaaaagaguagaaagcugucuuguacuugacaaucgauuuguaccucuuuucaguguaucuaccaagauccacaugggccuggggugcugucaugaggucuagaguaugcccgaucucagucugauaggaacucugcagaaagagcuccagcagguucagguaguagggcugcucccugcaguagaacuucagcaaacgauagauggaggcuuccagaagcagagcgucguugauggcauccaagccuaugccuggcuucugauaccagcagaucugucccgggcgaguaagggaagaguccaugaugucaucugacacaaggaagaaagccuggagcaguucuacacaccagcccacugucagggcccgcugaagacucucagcauccuguuucuuccgcuccaccagcuccuggaaggcuuguacuacggucaaaccccgguuguacuugccuccuaagucauuguacucuaggaccuccuugagccaggcaauagcauccccuaucucugggugucccagcuccuucucagucagcaccuugacgaucugggaggagugcuggaugaaguucugcuuuucuugguuauaaacaucuaauuucugguucccauucauucugacaccgaggagcuaaaugagagcauuuaguucuucaacgcggauucucccgggcagaaagcc

SEQ ID NO: 2835 - RNA, 1186 nt, Mus musculus
ggcuuucugcccgggagaauccgcguugaagaacuaaaugcucucauuuagcuccucggugucagaaugaaugggaaccagaaauuagauguuuauaaccaagaaaagcagaacuucauccagcacuccucccagaucgucaaggugcugacugagaaggagcugggacacccagagauaggggaugcuauugccuggcucaaggagguccuagaguacaaugacuuaggaggcaaguacaaccgggguuugaccguaguacaagccuuccaggagcugguggagcggaagaaacaggaugcugagagucuucagcgggcccugacagugggcugguguguagaacugcuccaggcuuucuuccuugugucagaugacaucauggacucuucccuuacucgcccgggacagaucugcugguaucagaagccaggcauaggcuuggaugccaucaacgacgcucugcuucuggaagccuccaucuaucguuugcugaaguucuacugcagggagcagcccuacuaccugaaccugcuggagcucuuucugcagaguuccuaucagacugagaucgggcauacucuagaccucaugacagcaccccaggcccauguggaucuugguagauacacugaaaagagguacaaaucgauugucaaguacaagacagcuuucuacucuuuucuaccugccuaucgcggccgccauguacauggcaggcauugauggggagaaggaacacgccaaugcccugaagauacugauggagaugggcgaguucuuccagguccaggacgacuaccuugaucucuuuggagaccccaagugugacgggaaaggucggcacugacauccaggacaacaaauacagcugacuggugguucagugucugcuacuagccucuccucaacagugccgggucuuagaggagaauuaugggcagaaggacucagaaaaaguggcucgggugaaagcacuguaugaggcgcuggaucugcagucuguuuucuucaaguaugugaaagacaguuacaaccgccucaagagucucauagagcagugcucugcgccccugccccccauccauccaucuucauggaacuugcaaacaagaucuacaagcagagaaagugaccccagaauuggagaggcuaggagggaggggucucaauaaauuauuauuca

SEQ ID NO: 2836 - RNA, 2232 nt, Mus musculus
guuuuuuuuuuuuuuuuuuuuuuuuuaacuugccuuagagaaggaguccagaagguuuuccuuccuuucucucucccuucuucccuccccucuccuuccuucccccaucucucuuucccucccuccaucgcuuucucccucaaucgcucccucccuccaucacucccucccuccuucccuugcuuccuuccuuccucacuuucugcuauagucacagaucagcuuguuucucauccaucaucagagacacuucuuucugaagcagaugggaauacaaauagagacccccccccaccccaaggcagauauacaaagggugagagauucugaaauagcccucaaugggaugucuucaucaaaugccuuuucucaaggcuuggugaacacagcaaaagaggcagaaagaguauaagagccagaggggacagaggacaccaagaaaacaaggcuaucuaaaucaacaugagcaacagucacaucagaagcugagauagugugcccauggccugucuggcauaucagguccuuuguguguauauuacagcuucuaguuugguguuucuaugggauuccugaguguacggauaaguggaucuccaauuccugugccuccucuuaggcucuuuuccuucuguuuguuuuguccaauuccaauauguuaguuuuuauuuuauuauauuuuauuaucaucaucccuuugaagccuguuuucuaaugagagacagaaaggguguagaucuggauggagagagagguggagaggaacagggaggagcgaagggagaggaaaucacaauuaggauauauuguaaggaaaagcuauccauuucaauaagaggcaaaaaaggaaggaaagcaaaaauacaaacaaccaaacgaacaaaaacccgacaguguucauuuucuagaacuuauggaacaagucacugagcuuuuggccagccuugaagacucucagcugggaagugagggaaguagguaggugguaggugcaaggcaaggagccagggaagacugcugacucccauaugagcaucccuucgauuucaguaucccugcuuccucugagcucucacuugagcgguuauaguaacacauuuauauaaaaagccccaugcuugaaacccaucucccacguuccccuucacacuccugugccuuccagccuguggagggggagacacugaacacauguacuucucucuugggaaacggaagcaaagagaaucagaggaugcagcuucucucaccuacccaguggucacagaccaccguccccccacaucccaagacgaaucagcugcacaugguggugcacaccugugcagcuucucucaccuacccaguggucacagaccaccgucccuccaccucccaagaugaaucagcugcacaugguggugcacgccugaaguucuagcaugcaggaggcuuaggguaggagauucuuaguguggaguucugaugggguuacauugagagacucuauuccaaaacaaaacagcaacagcuuuugccccccugaaaaagauuccagacacuaaagaugccuauuuugucaauuuaguuaauaauucauuuuaugugaaagaaacuauaucuucugauuuuccuuggcaaauaaauaauuucaguaauucuaauuugauugcaaucuguauaauaugcuccucuaaaaagugucaaugcaauaaucacugucacacaaaggaacaugauuucuuagccacacagccucauuaaugaaaaagggggucaucuaagccaggguuucuguuuuuuuuuucuauucauaacccuuuucccuugagaaauuuuuguaugacuccauguauguaaaguaguuauauaaaucaaacauuggcucauaauaaaucauuaagaaauagacuuuuaaauaauucuuuuaauacaaauaauuguauauauuaauaucaaacaaaaucuguauacuaaagacauucagguacuuguucauuguaacagaaagaguuaaaucuuaguagaauauuugauauugccggacauggaacaucuucaauauuccccagaguugauuauuacuuugauuuuauauucaucaaugcugagaauaccacuucauauaaaaauuuacaaaaugacagaaguauagguggggucauuucagagauuguugccaguucuaccuaauccaaagccaagauucauccaauaaauuuaaaauguaaaaacgagucaguaaauagaaua

SEQ ID NO: 2837 - RNA, 4987 nt, Mus musculus
aaaaucuuuguuuuuuaucauguaaugucuuaaacucauuaaacaaguaaaaaugcugccauguuugugcagauucuucugccgguggagaaugucuguaaaaaaaaaaaaaaaaaaagucauuuggauagagaguacuaaagaggaggcucggggccugaaucccagacugugaaggaaaauauccuuacagugauggguuuccagaacacuggcacaaaagccucucucucucucucucucucucucucucucucucucucucucucucucucucucucucguguguguguguguguguguguguguguguguguguauguguguguguguuuauuacaaaguuacuuauuaagguuacuaaagacaguaaauugcagaagaggagggaaggggaagaaagcaaggauggaaagauaggcaagaaauaaagaagagcgaguaaaagggaugaaaaacaaggaaagaaagggaggaaaagagaaaggaaggagaggagaugagagggggagggagggagggggggagagagagagagagagagagagagagagagagagagagagagaucacagggcaguugcucugagcucaaugcuuaggcuguuuggcagauacaacagaguccuggauccuccuugccuccuucagaagcuccguaggcguucacucagagaagucacaucaucuguggucucugcaugguguccugguguggugaggaauaccagugugaauaccccggcauguagcuguugggaggcauacugacgcccuuggcagaggcagaaacgucccacacuggaggcagggcuggugaucguggugacagggcugcugaacccgggagggggucacucucguguggguuacuacccugcuucagcaauuucuuaaacuuagagcgcuuauucugaaaccauaucuucaccugcaagacauguaguaauugucaggccagauaaacaucauacuggugccuucagugucaccccagacuuaagaagcaauauacaaacaaacaagcaaacaaaacaaccauuaccauuccaagaagccccuucccuucccccucauuccccucuuucaaaccaucuccaucccuucacucuaggccuacuagaugucuuauugugauuccuggauuuaauccuauagccugggguuuuuaaaguaacagcauaaaauuagaaagaaauaaaaugagaucaguggacccaaaauuuuacaaaggacuuuuaagugaaauagaguuuggcucacaauuguacaacuaaauuuaccuccuuuggucuauuccauuuuuuauauucaccaaccccccacauuuauuaugcuaugcauaucaaguaguaaacgauuaugaauugauuaaagguuguauguucauagcaaaauaccuugaacauacuuaugcacaucgugcacacaccauggcauaugccugggaucucuuucuccaguccugcaaggauuaagaaaugcaucaacccccacuaucuaccuccuauguugcuuaagcaaacagaagucaucaaucaucacaugauuguugggguagcuacuaaaagucaaaaggcuucugacaacuacagaaucaggaaucuaaguuggcagcuuauuuaagucaacaacccaaaucucuagaugaaaggaaaccuacaauguagcauuaccuuuacaauuccagaaucuauuuucccaagaauacgagucacggagcaucuagagcccuuucauagcaaaccucauacauuuucaguggcaacaugcaguagaaaccaggguaagugagaagaguucagggacgcggccugaagacaccauucuguaaggucuuggcuacugucuuauuagacccuugcuggaugaagaugaugcccaucagaagaggccuuagcaucccgugcaguucucuugacugcuggcuuuugagugcaggcugauauacucaccuaugggccccuuucugugaaaucugaaauguccaguauacuuuucaggucagcaggacuguuuauuaucuguggugucccaggccgugauuuggggaacauucucuuuguuucucaauucugucaaguucugugcuccagggagguaccucagccugcacuauuugguaccagaaugauucaacuacagagcuuaaugcaaucuucagaaaguccugucuuacccaucccggagugaauggcuuacacauggaugucuuuauuaagcugcuagagucuaacuuuugcuccuggucucagcucauaaguuuccuuccuaugacaaugaguugaaauuaauauuaauuccuaagggucacuaaaggguccuuaagaaaggccuuauuuugcuucuuagcuggauacuacacacacacacacacacauacacacacacacacuuguucuacuucguguuauucugcucuggaauaagauuugauugaauuuguucaccaaaagauccuaggcucagcuggggucgcagaggguugguguauaugcaaauccaauucaguauucaauaccaugucauuuguuccaaacugugugaucccaggaaagugcacaacuggagcacgggcauuugucauuuagcuccuuccauccuugguugacuaggccaagaauuccuccugguaugcucucugcacgguuaucaagcagggccagcauuucagggguacuugggcuucccgggaauuaccuguguuugugucaguccuaaggaagcagccaguucggcucucucgggaagggccagguauugagucugcugaaagcgaugguuuaaagccuggagcugcaggcuggaauaaaugguccgaggcuuccgaaucuuuuuccccuuuccguugaaccugauuuccccguuuucgaucacugucguuuuuuguugaucuguaagcaaaugacacagaggaguggucacccgcgaggccacuacugccuucucccuucaugugacaaggcuggcaaggaguuucucccaaguuuaaaaagaguuccucguaauauccccgcuauaccacugugggcacgugcccccagaggcugugaaagcuucccuccgaccgugucuccaacacuaacaaugcauuaugauaguggaucgaaucuaggaagcccggggcauaaaagagacgcuccgcaacagcggagacagcgcaggccgcuuuccgaaguccguggcgcuguaaggcuucucuucucugggcccgagagcgguuucuuggccuggcuuuucccaacgccuaaagcuauaccagaaccacccgguuguuuaugugaccaguuaguuuugugucacccagcugcaagcuuagugcuuuaagucccuucuguauguuugaaaugauucugcucgcguguaucaaagcccagacacagaacacaaccaggagcucagagcagcuccagagcaggcugagacucucuggacaacggagagcuaucaaccccaggcccucugcuucacuuccaagaacaaaggagcagccaaaguacuacugaaaacccagagagagggagccaggucuggggacgugggggggacaccucaaagcccacgagggaagauuuuaaaagcaaaacaaaaacaaaagacaaaacccaaugucacuaguaucuaucggcugcaacagcuucguuccaagucaccaaggggcaccaagugccccaggcaaaguaggccaccgcucucccagcguugagaugggaagccuuaacuagcccuucaguccuggcccagaauugucuccaguucugauaaaugcgggucccagcagagagggaagggacaagguagagggcacacagaccuggugggcuggagggcgcaguggggaccguagagccaggcuagggcacagccuggaggcucaaugggaaccacaagcaggaggcggaggagccagcgggccucggggugagccagccggggguccacggcggcgggaaggggccgggcagggagaggccggcaggcaggcgccaggcgaucgggagcccacggggcccgacugggggcgcacggggccgcccgcaggagggggccggcggaggccccggcguggaggaagugagcggggcgggaggggucggaggcaguggggaggcgggcgaagcuagcugccuaagcggccucucaccugugucguccccgcgcgucugggcggccgcgcugcuguugugguaggacuggagguaagggcugugcugcgaguggcucauguagggguaggcggcgagcgaucggugguuguaggaguugccuccgcucgacgcguagggcgagccguggugguggugcuggugguggugauggugggagccggccgccgccgccgccgccgcggccgagugcaagcagugcagaggguaaugugcgccugccauggccggggaggucugcugcgagugcggcugcggcggcggcggcgguggcggcggcggcggcugcuguugcugcugcugcugcugcuguugcugcugcuguuguugcugcugcugcuguugcugcugcccgaacuccaugaaggcggauuuggacgaguccuggccuuccaagccgucagccaucguagucauggucaucaucaaaacuuugggggcuggagaaagccuucucccggguuucuuucacccucccccacuuggcucgcaccgcucuccccuuugcagccaccuuagcucccgggauccuugcaaaaaaauaaaaaaaauaaaaaauaaaaaaaaauuuaaaggagggggcagaggugguucucuuccucacucuucucuaauauauacauauauauauuuaauauaaagagauauagugagcagggccuuguuaacccaaagggaggaggaagggggagggaugggagaggagaggggggagggggaaucugcucucuucuccccccccuugcuuuuccccccuuggauuuuugggggcuggugcaguuuaaagcagagauuuuaagguggauucugcgaaaguugcg

SEQ ID NO: 2838 - RNA, 4287 nt, Mus musculus
guuuccauggucgaaauaauuuuauuuauccagaauauacaguuuaauuccucuaucuacacuuauuuacacgguuaaaauaacauugaaaaaagucuuuugaaaaguugaggucauagauuucaaggcaccauugauaguguccacaguugcgcaaaaaaaaaaaaaaaaaggguucuuuucguaaaaaagggggcggggcucucugaaaugcaauaacuuacaugcaaaaaaaaaguuuacacaugaaucuuuuuuguuuccauuguucaaacauccccguaugaauuccuuucuuucugauuucuaaaccagcacaacacuguagucccaaaacugagcaagagaaaguagcccaucuaauaaagcgucccggaggccagugccagcgggugcugcaaggagcccggcgguggcaggugggaauugauugagcuggcugcgcuuggguaccaggaagccgaguucuccagguagcuggacgcgggggacugguuggaggucggagggugggcaugagggugguggcugagagagcgggaugagcccuggggcucccacaccgcuggugacuguggcgaguuacacgccauagggucgcuggagcugggacugugcuccgggggcaucuccccguuuuucaugaucuucuugaucuuggaucuuuuguucugaaaccagauuuucaccuggguggggaacaaaggcacacguuaccgggacacucagagguugcacgcgccuuucccugagcgacgaaugaaggcucuccuggcccuagacuauccugcccugauaacuaacuaccagcagcaagccgcccaucgccaggagguugcaguuucagccuaggcaaugggagggacgcacagagggagcucuguccagcucagcgggaaccagcuucugcuaccccaaggcuuugucuuuuauucacucuagaccuggucgcacgugugggccugugcaccaggucacuggggaggauaccucuccugcucgaaggccagaguccccgauggggaggggcuugggccaaacuguaggugcacugugccaagggaaaggagagauuguccaaucuccuguccaacucccuucaguccccucggcacugggaggccagacucugccugaagcucugggcugcgacuugaacauuccuuauucuaggccccagcgggcgggguugggagggaaaagaaggggacaaucccggaggguuuccccguacaacagcgccccccaccucgcgaccuucaggcugcugaggcuugaucugccucagggauagggucgaccgggacaggacgauccaggccuuugcauggcuggagacucaucaucaggccaauaguaaggcaagcuucucacugugaagggacccagaccuuuuucaagagcgcgaggcagauucccccuccucccagaaauaccccuucucuuguuuucacuauggaaccuugguccccagccuuuggugguuaaagcagggguggguuugggugggaggggauggcggcaacucgggacaaacgacgaaucccgcgcccaccgccacgugggccuggcucauggagggaaagaugcaucgguuggugucuuucuaucugugaauuucugcaaagugcuagagaaucggcuccagccagucgggaccgaaccuugcagccgagcugggcuugcaggcgaggcggggccgguacuuggcggcggccggauuuaccuguguuugcgucaguccuagagaggcggccaacuccgcgcguucuggcagggcgagguacugagucuucugaaaccuucucuguaaagcggccagcugaaagcuggaauaaauaguccuggguuuacgaacuuucuuugguuuaccauucaccauccucaccucuggcuccgccacuucuuucucuaaauaaccaaaacagacuagguuagagcuuccuggcagacaauggcucguuugcacaggcccucaaaucagcgagauuuuguuuguuuugaaauauguagucaucuuucucuuucccaauaucacaaucuuggcuuuucaaaccccagagaaaucugucccauccucagaucauacauggaagagcuggcgagucucugacuacuagccacugugugcguggggcacuuuguacacaucaaguucuucgcuuuagggauggaacccuuuggagaugcuuauuuuucucauuauuuuuucccucccuguauucaccuuguguguuucugggacgcgaauagccacuccaaucccugggcgucacgcgaggaggccccugggccaugacccucugucggcgucuguucgggcgcccgcagaggcuagacgcuugggcagggaagacgcuagccaagggcuccaaaguucaaagaccgacaagcaaacuauguuccuucacuacagcggcaagcggucggucggggcugcggcagacagagagccgauuauguaguccccauaaucucacugcagaucugagagggcacagaugugucugguuucuuucacaaauagacuuaauauguucuugaccaaaaaaaaaaaaaaaaaaaauccucucccuaugcaaggauacagagacagcaagaggagcagacucaaacuuccaucaacaauguauugcaaaggaaucuguaguaaggauauuuucguaguaaaggggaggaaccaaggaagaauucucacugucauaaauguaccccgcugggguccugugaauccguguuuugcuaaugugccccuaggccacauggccccuuuucccccuucaguccugaaaggaguggaagagucgguguaugaagcugcugccagaggaaggguggagaaggagggagggcugcggucuccgcucuacuggaguaggggaugcuaauauuagcagccuuauuaaugugucggugaggggagaucaaaaucgacuaguaaaauuucuccacugagacuucacgccucucauuuaccgcccaagcucucuaccccacuguaacgcucuaaggaaguuucacaguggacggaaaggggagucuguggggaagaaggaaggcagacaaauucuaggcacuuacggagagagcacucgauggagugugugugugugugugggggggggucccucuaacagagugaacucucggcaauccuccgcuauuuuaaaugacuuuuuguauuuggaaauaccuuggauaaaccgcaaaguucccuguucgcuuuucugucaggcugcagcccuccggcccccaggucacccggugugcugcccgcacccuccaugagaggccucggggcgcuucgcuggcuaauccagacuagaucucaccaacucagcacgcucacccagaauuccaacuaacuuuccuuuuauuacgcaaacaccacuagggcugcuugauuucacccaccccccgccccccaaaucccuuagccucuuugcagccaagcuggcuuucuggcuaggccagcuaggaauccagcuaaggagggauccucgagcagcgccagaggcaaaacacccgauuaaaccucuucaaaaguccuccacugcccccccccccaugccggugugaggugcuguccuguuugcagucccaggcccccacucgcuucugcgaagcacccuucuaugggugcggacagcguggcccucaucuaccacccaacuuggcgcccgcgggguuacggaugcccuggguaccugccucccgcccccgcgcgccuaccuggcuggcugguggcacucgggacgcgguuguaggcgccgccguacuggugguaggggcuggcguagccguagucggcauaagccuuggccggguagccggcugcggagccguucacgccgugguacugguacugguagggguugagcgcuuugccauaagaagcagagguaggagagcaguagccgugcggggcggcccccgcgggacuguaguagucagaaucgguggccgaggacucgggcaaaguuggcgauuccugagacggguggugcauggcggcggacgucgggaacggagcuuggaagucgccggaucggaugcuugggacucuucugucaaacacuccugucauagcucccgggcgguggcuguucuucuacugcggcggccgcugcugccugaauuggcuguggagcugcucuggucuaagcagacauggcugugggagcgagggaggaggaggaagaggaggaggcggcggcggcggcggggaggaggaggaggaggaggcugggagucguggaggcucugucucccgcaggcugacugcug

SEQ ID NO: 2839 - RNA, 18115 nt, Mus musculus
aggcauuucagaugugaaacuuuuauuucuuuucaugccuaaguaagccugggugacugauggcugagucucauucuuucugauugugucgcugucucgaccuucagagccggaagaaacauuuacuuuuacacaagaguguagagagugccuaagcuuuggcagcugacuuauaaugggucagagugcgggcagaagggucaguagcauugauccacuuaggcauccaauaaugagucagccaaucagcccggccuggguaauggcguucaaagaucugacgguagaaguagccuuccuuaguuuugggaguauugaagggaaacuucugggaggcugcagacaucaucucaucaucaaccuauaagauaaaguaggaacauaaaacauuucgauguguauuugcucugauggugaccaaaaaaaaguuaaggcaugcuaugaagcaacaagacccuuuacgucacucauuauuuagaaagugccaaagcaagccauaauaaacagacagugacuuuuuaaaagcucucaugcauauuaauacuuagaggcucaguguuugacucauuuguacucaucagguacccagacgugcaaaaugaucagcaaugaauuggaagucuucccucuaucccuuuucuuuugaucaucaauacuacuuuauaguccuucauuuuccuuaauuauuacauaaagcuuauaaaagacauauuccuugcaggaacucugacucuccuuuagauacaacuauucaaacgaaaggcaaacagagaucccagcucucuauuaaacuauuauuguuccagaauauauaucuuuaaagacagaccugauguucaacauaguccugcaaaaucuugaaccaggaguucuugacugaggugaucccaucacugaaggcuucuuugggucgccagagaaucucuuuggguagcagguugcaguccucaaaagucucucucaggagauguuuuucuaugccauucugacaggagcacacaaggagggucagugaagucgccggaggaaccaacaauauuuggggguuuuauccaggguugauauaccuacuuuuggaauucucauaucuggcggcagagacagguaauaggaagaaaaccgaugauccagaaaggggacucucaguucgagacuuggggaaaacagaagacaaucugagucagauggcuggcacggcuuccugacaaccuccccagacugagucauggagaagaaagaguuacauuccagccuccuagggaccacacugcaugauuagccacauacuaauguuuguacuugaaauaaaaccagcaucuagggagggaagcuuucugucuuaaaguauuucuuuccuucugcgccuaugaaaaauuaccuguuucuauaaaacguuaauuaucaugagugaccuggucaugaggguauaugaauauucauaccaucauauguacaaaagucccagugacacucgucaggacaugcaggcaggucauaacuaugauuccagaccauucguaagccaaauaugguucaguagaggaacugaaaauguugaaaggcaagucuuuauccugcacaguaaagcucuucuauucuucaacaagcccaguuaacccuagaaacccugggcaagaagaaauggcuccaaagaaacuuauuuuuauucuauaguccuaucaacaaaugaaugaaugcaugaagauugcauuucuccucccagaugcagcaaacuggcuuggcaggcacguaguauuugcuaccagaagcaauacuccaaaugcucuaaaauguuuccaagaagccgcugcagccuucccucuaggccagaaacggcccauugcuguuaugaucuagugacacaaaaccugccuggcauacccacaggacaugaucucuccacaccccggugauaguguccaggccauagcacagcuuuuaggggacaaacuuugcugaaaaccauacuuugcagccagccgaaagaaacucaaaauaagcaacugaucucauuuaagcuacuucccccuucucccuuguugguuuuacaacugauuuuaaaguuacccgugugcagcaguagugcggucggcccggagaacaucaaacagguagaguuccuucagcagucucucacucuccuccucggccuucucaggggaaggagccuauuuaacaaacgaaggugagugccuuccuuuggcacacaggcagccuucauuuuccccucuuacauaugaaauaaagaaugaguaaggcagaaagcuuaagaggaggguauaggaugugaguaaaugacuucagaggccagcaauguuuuacaagaccgacccauccauccuccgaagugcuuagugugaaaacaaauuaaaugagugcccugggcaacagacacagugccuugcaucccagcacuugggaagcagaggccagucuggucuauaaagugaguuucucaacaaccagagcuacuuaaugagacccugucuugaaaaaaaaaaaucaauagacagacagucagacagauaaaauacaaaagcaauucucguguuuaagaauaaaaaguaucugauacuauuaagucuucuuucuccuauaaauauauagauagacagacggacggacggacagacagacagauagauagcaucaauucuuaaacacaaacacaaauacacucuaaaacuacaacaaaucauaaggacagaauagaaagggucaagugauucugacuuccuaacuuagccuggccaucguuucaguucagagcgcuuaccuuguggaaauauauauagcccuguguaaguucaucugaccccucuccggagaagaucaccacgcugucuguguucuuccgaauauacuuggaaauuaaauacaugccuuaaaugaaagagaaaucaauggcgaugucauuguugucuucagaagcaacaguaggcuggagugucuuguuggacugaguuaguauaaguauuaaagcagcuuccaaaaggaucggaaauuuguaagucaucuacaagcugucaauccaaccuaaacaauaaaauagccugcaauccacugucauguuuuacaaacagguugcaaagcuauguucuuagaacaagacuuucuauguuaaauguuugcuggauugaaccacucaaaugccugaauaccacggcauguguacuaacacaguagaguaaggcguggccuugcaaugcuuuggaugcaguuuggucuccaugugguggugugauccaugguggagaaguggaagauaaggugugguugggguuccuugcuccucaagcaucaaaugauuucuccugauucaauuauuuaggacagagcccaucucuugucuccaaugccugggaucacuaugagaugccuuucucaugugccacuccugaugccacccaccaacaugccaugcuguugggcuuucuaaaguuucucaucuggcauuauccauuauuguaacagaaagcagacuaauggaaauagcuuacuuuuaauuguuucguucuuuuccauuuccaccccucauuuccaaaucccacauuugauuaagaaggcucuguacaauauugugcuaugucuacuugguagauagcucuacacuaccaucucucuacacuaccaucugucuccuccaaucucauuuuuauccuucuuaggagagacauucuucuaacucugcuuccaccucauaaaaauuuaaccacagaugugcuauacgugugaguauuuaacuaugaugcuucaggagaccaaaucacuguaauacccaagguauuuuaucacacuccaaagugaguuuuuaaaaggacucacucagcuaguaaaauuuuagagguucaacaaaauugggucugauuuguguuacauuucuaaucuuagaauguguucgccagauagaaguaguguugcuugcaugacaauaauagcuaguaacugguaagcugugugauggaauacuuauuauacaucuacaugaggacccguuagagaaaauguacuguaacauggaccgauuuccccauuuuauuaagaacaguguucccucauuauucauuugggauugguucugggaaccaaacagcuacacauaucuucagauacccaacuccuuguaaaaugauagcauuugaacacaaccuacacacaucuacaggccuaucuuguuuuacuaugcuuagcuuuauuguaucucagaggaaguuaauuucuuacaaaugaaaagucuggcaauccugcacuaagcaaauacacuguaucauuuuccacagcuuagaugaucaacaacaauaagauauuccuaaauaaagguacuuaguugaccauaguacacuguagccauagcuuuuacaugcacuaggaagcacaccagauuauuauacauaauaauguuauguacuguggcccaacuauaucauccaagauauuuuaaacagagaagaugagagaaagggagccaaaauauguguccauucuauggucauaccauaugcugacagcccagcaaucccccugccucaaccuccugggugcuggaauccugguuaugaugaguuaguucugagguaacaaauaauucauaugaaguaugggagacagaaccuagcaugaaguaugugcuuagcagaugugagcugcuuuuauuuuuaugaagcauucuuuaagaccacaggccgagcugaccuuguaaauucaguguucagaugaucugauuauauucauuaagcacuuccuccagucgaaagaaauucagggcgcuuuuaaauggucuuaucacuauauuauaguauuauuaacaauauaggaacuuugcuaguauucauauuuagacaauauuucuuaagcugaaaucauguuaaaccuucuacuguuucaguauuaaaacgcuuuucccuauaauaaaaucccuuacccacagaugcccgaacugucguaauaucauaaguuuccaaggaaaauaugacuucauccagggccugaaugccuucuucagaguuaaaaaggacuucaugaugcucgcuuccaauauaauuugccaccugauugugaagaaaaacuccauagauuuguuaaagaaccacuuuagaaaaugaaacaggccaguuccucucaagguaaacauggugaaaagaaacaaagcugaagaugacucaaggucucuccagaccgccuugguaaggggcggugcaggccuuucaauaagaggaggugcaggccccuucuguaagaggagauagaugcaggcacagccacaugcuaccuaaagcaagccaggugccucugccuggcccucacuccccacucaaccacauuggcucucuucaaaucaaagcuacagacugacaguccagagucccaaucagcacaccacucucuccuauuuuacuuaaccugccucauuucucccuuuugaccaucaucucccuuguacuguacugaaaugccuaauuuuauauccagcaugguaucccuacauauauagccuuuuccugucgaauuggaauucuccucgaggcuucucucagucauucuaggucuuuacagagcagcacgccaucuuccacacacggcauugcauguacaauaucugcuuguaaugcauaugcuucauaagaaaacaagaugcgagcugauauccuggcaccagucccuauccuaguuguucucuauggcuugucugucacaaagaucgugaccaacaucaacuuggaaaggaaagaguuuauuugguuuaucugagucacaguccacggaggaaagacaaagcagaaaacucaagaugggaaaugaaggaucaggagccaggaggagcaaaccaacaacuaagcagugccccuccauggucucugcugcaguuccugccuacaggcuucugccucaaauucccaccuagauuucgucaguggacuacaacucgggauauguaagccacgugaauccguuccucacccuguugcuuucuagcaugaccuuucucauaguaacacaacaggcacacgaggacgacuucagcuugauuuucguccuaacaauugggcuaaguucugagucuauacgaugggcagguugugcuguaccuuucuagcggccaggagaucggggcuguccuccaugccaauagcaaaugucuggagaggauacugaacuugggccuccuugaguugcuucagcagagaggcagcaaccaagcucgaguccaggcccccugcagcaugaaaauaaacuugaugguugcaggcauacauuaaucagggcaaagauaaucacacaccugcuaaacaucuggauuggcauuugacuaugaagaucucugaguuuuauaaacagaaaucagcuuuaguaagauuuauagugaagugaaaugaaguguguguguauguauguauauauguaugugucuguguguguguguauguauauauauauauauauauauauauauauauauauauauauguauguguguauguauguacacauacauauguauauguauguguaugugugugugaauacauacauuuucuuguccccuuacaauggcaacugcaucuaaacuggcuuaaaagaucaauacacaggagucuaggggaugaggaccaacaagcucuaacccuaacaaaugcaguuuauaaacacgucuauagaaaaugaaacaugaaacuauauaguaggccuuuaacauucaaagcucagugccagcuacaaaucauuucauuuaaacaccaguaagauguuuuuauuuuuuaaagugacuucaccugauaaaaggcagccaauccuccggucugucaucaagcguuucuugauagcguugucaaaaaggauacgcagauuguucuucacggucucuaggucaaagccuaacaacacagaaaguaaauggaaccgccacaaacaagcugaggcuaagcugacugagaugaggcaagcagucuacuacaucauugugauggcucucccucacucacggagaucgcuccaccuccaaaucaaagaggaacaucuuaaaaccaacaucauugaaaacggcgcaaauggcccugaguugucaggggugagcuagaguucugggguuuggucaugggcacuagucaccugggaagaguuucuccacgcugucauagauggcaugcaaugguucauccguacagugaugguauuugaccauuuccacagacgcaacuuugccauuugguuuuaaauccaaaacuucauaguguccaggaaggaagggcuccacuuuuaagaagggagugguggaguguuuuaaggaaacaaggccuauaaauggaaaacagcaacguaugcaauuaggugcuucucugcagccugugcagugagcuaguacacucuaacccauacuuucccccuuaaguacaaacgcauauccauuauacaaaaaaggugggaggggaaauaauuaccccauacccuagcaucucuccugaagaagcaagaaugacauggagacagaacacaaaacagcauggauuugcagucauuugaugcaauaggaagaugauuccuuacgagauaauuuccuaacauagcaagauaaaaauuccaaacaucaccuuuuaacuaguguaugucucgucguuacaauaacauccucugagacaauccucucucccaccugaaaggcccugauaccuuuauuaaaaugaaagucuucaucaucccauuccuuuaccuagcugaauuuucugaaaccugucuuuuagacauuuauaaaguuuucaaagaaaaaagcuuuuuaaagggaaggccuauuuucugucagaacauaaacaagaggaaauauaaaucugagaaaaaagagaaaucagaauguuaacuucauguuaacuggcaugguauuuugagagaccaaugguucucaagucuuuaccacguaaaaugauacacuacugguacucagaagccaguacccaccccuucauggcugucauagaauguguaugagaaagccauagaauguaacuguaggcaguucuuaaagacaguagcuacccugacaccaccgugaucugcacaaaagccaauguuguguaauaaauagauaaacaggcuaucuacacagauauuuguuauaauguacuaugagucuuauaacccaaucuguguacauugaauucaaaggucaaaggaaugcagugugcucacuagcuggcagagcucaaaugcuguucaccccauagaggaugugaugcagccaacugaaaggucuuaggcagaucaccacgaugagaugguuuuaaagccugguuaaggaagcagcacuccaaugggaucugugugguggauucaauaggaccccuacagagcauauccacuuggcccccagucaauagaacuguuugggaaggauugggaaguguggccuucuuacaggggcaucacuaggaauaagcuuugagguuucaaaagcccgcaucauucccagucagcucucugccucaugcuuguggaucaagauguaagcucccgggggcuggugagauggcucaguggguaagagcacccgacugcucuuccgaaggucaggaguucaaaucccagcaaccacaugguggcucacaaccaucuguaaugagaucugacuggaaugucugaggacagcuacaguguacuuacauauaauaaauaaauaaauaaaucuuuaaaaaaaaaaaaaagauguaagcucccagccgcugccugccugcuuccauguuccccaucaugaccucauagacccuagcccucugaaacucuaagcuccaaauaaagucuugucuuggucgugauuucuuaucauaguaauguaaaggucgcuaggcagucuagaaaaggacagaguuaaggaugcagaaaacaaacugcagagaguaaacugcuggugggauuccagguccguaucaagccaucaucaggucuaaaaguccaaaagauagcccgcagaagcaggaguccauccugcuuuauauuuccuuugccagguuucccugacgggauuuuagguaacugauguagaaugcccuaugcugucugcugacagaccaagggaagcauauuuaauacccacacuuugguuagcaugcagaucaagauccugguuucaaguaauguaaaaucugaagacuaaguggcaaaggauucaaaaaauggcaaacuacacuacagaaaacuugcuaucuagguaagagaccaaagaugauuacaaaguuuacugccagaaaaauaaugcuaaguagguguauuauacugaguauaacaaguuaagguaucuauugcuauaauaauauacccaagauaagaaauguaaaagaaauauuauuuuagcgcaagcauuugagccacugugaccaagucugugguugcuuggcucuaucuauaaaccauggcagagauacuuugcaugaagaaaaaaugugcucaccuccuagaggccagaagaaccgggugcugcagaaagacugagugaauaaggugccugccaagccccaugcuaagcaagccugaggaacugagauuuaauccccaggccccauggagaaccugguagcagcauccugcaucuuuauuucuaggauagguggggcaggacgaagaaggcagguggagaccuggagcucagccacuaaaucaggaacgugagugagugaguucuaagugcaaagagaccgugucaagaauuaaaauggagacuggcacgauggugcauaucuuuaauccugguacucaggaggcagaggaaggcggauuaaauaaaauaaaauuaccaugucuaauguuaagucucuggucucuacgugugcguauguaugagcacacguguauacaacacacacgcacacaugaaagaggaaaggauugacuaagauuucaaauccuauucauacugaguauucaucuuucaucauuuuaaaguuuuugauugacaccucucugggauucucacuaugauccaggaagaaacacaaaccaaaaauaguuaaacuccauuauuaccuuuagcuucugaacacacagccagaaacccaucuucugucauggcuuuaaacaagggccugacuccauaggugucucugcccagaaauacuuucuuauuggcaguguccaguaagaugaaugcaaacaccccguccagcauacagaugguuuucucgaugccuccuuugucauagagguggaggauaaucucaccauccacauuggucugauauucaaauucaaaacguugcuguagcuuaaggaagcagagcaaacaaaaaguuaguauccuuauggaugcugacccaguaucuguguucuagcaucagcucgugugcauuagugauuuaaaaaaaagaagaagaaggagaaagaaaaaaaaaaguauggcauuauucaaaucuaccuugucuaaacucacaauucugaaaaauuuucaccauaaaggcuaaacccaugacgauaaagacuguguucugauaaacaggauacaagggucaggcaucagagcugugacacaugaagaaauucaaguacauauugcagcccagagucuacacucuguaguuacacauacacauuuacaugggaagucauccuuucuuuaggaccccagccccaagacaaaaaccugcaggugaccuagugcuuuuugugaaauagaauauuaucuacauauaauauaauacacauccuccugugcacuuaaaugcuuucuagauuuagaauacuuaacacgccaagcagugguggcgcucaccuuuaaucucagcacuugggaggcagagacaggcggauuucugagcucgaggccagccuggucuacaaagugaguuccaggacagccagggcuauacagagaaacccugucucgaaaaaaaaccaaagggggaaaaaaaacuuaauacaacacuuuagaugcaauuguuaugcaauauugugcaggguguaaagacaugggcauguucaucauagguauaauuuuucauaaacauuucccaccaguguuugcucugaucuuugaagguagaaaccaagaauauagauaaggacaugccaacacacuuggagaacaguuugccuuguuaccauggagcaaaaauguguuaucaacaacuguugacuuuugguuugagaugcagaaucggcugagaggcccuuccagcuaauccucaaagaccucccuugaaauauucagcaaaaggaaaaccuaguggccaccccuuacugacaaaugcaaaggaauccaucacaacggcagagcccagacccaagcugcugguccucaggagaggacaacagccagaccuuccugaauagugggauauuaaagcuacuucucagggacagagaaaaugaucauagauaggccgcacaggaacagcaaugggcccuccacugucucugucagcaaagugaaaaggcuugaguugggcccagauucugacaguuucuacuacacuagcacaccagccacgcguuaggucuuuccaucccuaccgcgugguccucuguggaaagcauucacagaacuguuaaaacacgugcuuuagcugccucucuuacaguaccggcuggccauucuuccaagcuaaggacuggucagggucguccuggcucagguaggugggguuugaaaaaucuaccccucuguuuacuuuauugauuuuaugugugaguguucugcaguguguacaccuacaugcuucaguuucuuuucuagauggucccgagccaccaugugugugcugggaauugaacuaagcaccucuggaagaacagauucaacugcugaggcaucucuucaaccccaaaaaucuaccccucugggugggagcacccuacagcauuugaaaauaaugaacaucgcuuccacucucauuuucaaugauaauuuucucagaaagcacucgucccuucacuaacaacugccgaguacuaacucuaacucuggaauggacgcuucugugcugcacacauguccugccaccuuccuaaagccacaccggccucggacuuguucugggccccuggcuuauaagcaggaggugaagacgaacuuugaaggugcauucugaaaaauacuuauggcugaaguugugcauucuacucuuagacaaguuuguagcagucgcauuuguuuaaguuuggaugcuugguagaaacagcagaaagucucugcaaauauaacauuaccuaauuuuuaaaaggcauguuuuuaagauauugccuuuuaaauuguuaacaaaauuaauaagcagcagcaacacuguccaaguaaaccauaagccaagauaugugcuaaccucacuucaggaagacaagaugaagggugauacugacagagcgcaaccucauccucucagguacacuggcuugacuuacugagacccaaacuccaccucaccccucacugcuuuccuuaacuuuccucuguaccggguucauccuagagcauugagcuuugcauacagaagcccuuuaugaagguauauuugcuaagugguuaaaggcuucagaugagaacccugcuuugacaaugccccuauaagcaagcaaacuggcaaauuaaaaccauuguccaggaauaaagauaaaccccuaccaaugaaagauaggcacagaagucucaaaauuuaccaugaaacagcauggccaaaugacuaaaccuugacugaaaucugcccuaccaaacaaacaaaaccaaacaggggugcauaagcaugaaaacacacacacacacacacacacacacacacacacacacacacacacacacacacaccaaaaaaauaaaaacaaaaaggcaaagccaaacaaaaacacagcuaaauguauucuagggacauuuggagaagcuuaacuaugaacuugauauuagauauuauauuauuagauuauauuauuauuauauuauuagauguuauagucuuagguugggaauuaacguuagcuaggagaauguucugauuauuaaaugacaaaugauuacauauuuuagaggaaacacauuaugguguaccauacuagaauuauucagccuaaagggaccacgcaggccuggagauaaauacagacaggcaguaacaauacccaguacucaggcacauugcucugaagcaacuagaaguuggggagggguuaacaaguuugcaaauauaacaaggggugguauuuguacaagcacucauaaauuaaagauuuaauucuuuuuccuuaugaaaaacaagucaaauaauccuggcuuggaugguccguaccauaucugguuuccgagaucagcauuucugccccucacucgcuccuguucucuagacaccagagaguuucaaugcugcaagucuugcuuaacacacuucagugccuccggccaccuuucuacaauuuggcuccuacuaagugugaaacugcaaacgcuuucucaguggcccuauuauauaacacugcaaaucucaccuccucucaacauugcaggacuaucucuccccucuaagcccucaauugcuccuggccuuggaaggcuccuauagcaggagacugacuguccugucuucccagcuccauggguccucuucucacucacucucgcccacacugggcaucuacacacgcuaucccccucuaugggaaacacguccggggcuuggcaaguauucucugucuaucaggucucaguuuaagucucccuuccucagacccauccccgcaaaccgcuuuccuaugugcaccacuucugcauuugcuuuccgaaaguucaauuuacagugauuuuuuugucugucuccuguuagcguaaccugcaauggagcacaggccugacauuuucgcugacaggacuccaucagcuaacacugcccuaaucaauauuaaaauguauaacaggaaaaaaauugaauuggcaucuccauguuaaucacuugaaaaaaaaucuaacuaauuuuaccuuucugugucaguuuucuguauaagaccagagcaaaggagucagaacauagaaaaagauacaaaguaaaaaagcgugacacaaaauaugaacaucauaaccauaggucugaaggugaguuauagccagccagccauccccagcuucacucugcuuaccgccuugugguuguagauuucaccauuguaacagagccacaaauaaggguauuuccucacucuuaucggcugcauuccaaacagcgggucaaccacagccaagcggugaaagccaaagcagcaguugguguauccauugacauucucaaagcgaaaugcaucuggcccccugugcgcgaucuucaucgcacucagacacugcacggaaaggcagucaucgcugccgaagagggcccagaugccacacaugcuacaggcggacugcaggcacucuacagagagaagcacagggucucacauugaguauaagcaacucuggauucuugaaaccuacacaacccucuccaaauguuggacacaaaccagcuuuaucuacugcaaugucccauuagguggguaggcacaaggggagugauuucauuugcuuacaaauauuaagaaauacaaaugacuuuuauauccaaccauaaacccugcacccagccaaagcucacauuucucccaccuuaggauuuuugguggggguuacgcccagcaacauccaggucacagcugcaacccaggaugcuccaaagagcaauagcaggaguagcuggcuccaagcuaggugggauaccagccccagcuacuccaggugagaaccucaaaacaccccaaagguagauucuccauguucguacagccucuucuuaagccucuauaauuaaaugccaucucucuauuuccaggucaaauacaaagggaauaaacagcaacucgugggcaccauuuuguaauauuaacccauguguauacacagagagacacacacacuaguauaauacauccuuaggcaugucacucugcuagcuuaaccucuaagugacuucgcuaaauguuauggaagaauaaggaaacaauaaucugauaucagauacccuaacaagcauuuugaguuuacugaggauguaaaauauuugucauggcuggguacuguagugcuuaaugcuagcacugaggguagaagcaggguagaucaaagguucaaggccauccuguacuguaugagaccaugugucaauaacagagaaguucaacauccaguguccuuaaugacaaaaacacucucaaauauuuaucucaaagccgcauugguuaguuagaaacaacacuggagggggggaaacuuaauuaaagcccuguaagccaggaagcaaguaauuccuacaaauccuucauuuaaauaucugaaguucaaauaguucaauaaagagucuuugaacaugcaauccuguucaaaaagcaaaucugcaacaaauggccacauccucugaaaccuacacccucccauccccccacgcugagcaagccuugggaaacauuccgacuggaucaaagcuuuggugcgcuuugaguaaaaccagaccaagccacggaaagugguaucaagcaaugcaaccggaagaggaagugcaagaggcccauagcccuuccaugcuguccaaauggccugugauaggcucggucugcgcauucagaaggagaauccagagauauaggagaaguggccauuaauaagcaguguuugauucgaugccuaugaaaaguggguuagucgcacugcuaaaagauggcuccaucgaaucccgacccucagagcucagggaacccugagaaagaggaggcagaaggaguugcaaaaaccugagacagaggacaucagaacaagguccucuuaaaacaaccgagcaaagcuccgaugaacuccgagaccgaagcagcaagcguggggccugcacgggucuccacuagguccucugcauguguacuauagcagcgguucucaacccuggggucaaagggcccuuuccgugguugccuaagaccaacagaaaacauauuuacauauuuacaauaugacucaaaacaguagcaaagcugccgugaugaaguagcuaggaacaugauguuauggcugggguucacuucaguguucuguauuaaagggcggcagcaucgggaaggcugagaacucacaguauucuaacuuucaguugagugcguuuaugggacuccugacugaacugugaauccgggucucugauuccugcgccuucucuucgggaucuuuuuaucuuucuguugguuucuguuguccaaccucaauaugaugguuucccuuuuaucucaccuuacuguauuuuauucuauuuuguugcuugccucuuagaagccuauccuuuucuaaugagaggcagaaaaggggugaauucagaggggagagguggggagacacuauaaguagagaggugggaaacuguucagauaguauuauaugagaaaagaaucuaugucuaauaaaagggaaagggaagugggcuaacaaagcgcucugaaaaucaauuaugaucaccgagaaccauuuaccuaggucuuaaggcucuuuaaugaacugucugguaugcaaaacauaugccaggcacuacauugaaguguaaagaaaaguuuaaaauucuuuccuucagcaggaguaaggaaauucaaacuccuuuguaaucggacucagaggcccucuuguaccauauuuuccucacuguugucuguaaauuuccuccuuuccugguuaacuucugcagcaguacuggccagugagccauaugugaaauuuuaauauacuaauaaagcucauuaagaagacaagagaaaacauuaaaacuaauuuuaaacauaccuuaacaugacacacccuaaauacgacaaccaauacaauauaaucaaaauuaauuauauuuacacuacuuuuccuaaauuauuaaaaccgggcuggagggauacuuuagugguuagaggcugcaaucaaacaucaaaacaucaagcguucgguuuucauaaucaucgaaaucgacacauuacacucuuaccacaucucaguucagacuagccagcauuucuaggggucagucuaugaaagagcacaggcuccccgcuggacagcgccgcuuucguacacugaacugauaguucuaaacuccacuggaucaccuuaagaccucaauaaucaacccguggccuugugcaagucuuacuucaaaugaauauuauaguacugacaucaaucaacgaagaguuagcuguuaaaacccguaggccacaggcaacgaaaaaucaaacucgcccguguauuuuaaaaguuaucuuaucugaaacuagaccugugaaauagcuauccauaauuaagaaaaaaaaaaaaaaaaaaaaaaaagcacgccaauuccuuugccuuuucccguacuugguugccugucuccuuaaacagauuuuucccggcguggcugcgaguauggaacuggaguggaggaagggccugagcagcgaggugagugagugcucagaaauccggauccagacagacccagagacacucgcucuagagcuugguagagccucuguccugcuggagagcgagaccccuacacuagccuggggcucccaauuacagcuggucuugugcaagcguccaccuagucccaggcaaaaccuucggauggcugaaauuucccagaucuagacgucauacaguaaaaaaaaauauuuauggugucuaaaugaaggccaccuucgccuucugucuggagcggcccugccuccgcgcugcacuucgcucacaugaaagcuuuccuggcagcuccguccuaggugcgcaacaaucgccccgcgcccgccccgcccugccucgcgcugcaccgcagcaucggucuggcgccggacccgagcgcuccgcauccgaacucccgggacaugugcccgcgcggacagcacauccuccggccucccaggcgagcagagcgcuccgcgcugagcacccggcucccgcuuaccugagcacuagcggccagggccagagaagguggagcagaggcagcgcagugacaagaccgguuggaggccgcuucccaccuuagagucgccgggcuucuguaacgcgugcgggaaguuucaucauguggcugggacccaacccgugcgcaggggcguggcccgcagugcu

SEQ ID NO: 2840 - RNA, 18115 nt, Mus musculus
agcacugcgggccacgccccugcgcacggguugggucccagccacaugaugaaacuucccgcacgcguuacagaagcccggcgacucuaaggugggaagcggccuccaaccggucuugucacugcgcugccucugcuccaccuucucuggcccuggccgcuagugcucagguaagcgggagccgggugcucagcgcggagcgcucugcucgccugggaggccggaggaugugcuguccgcgcgggcacaugucccgggaguucggaugcggagcgcucggguccggcgccagaccgaugcugcggugcagcgcgaggcagggcggggcgggcgcggggcgauuguugcgcaccuaggacggagcugccaggaaagcuuucaugugagcgaagugcagcgcggaggcagggccgcuccagacagaaggcgaagguggccuucauuuagacaccauaaauauuuuuuuuuacuguaugacgucuagaucugggaaauuucagccauccgaagguuuugccugggacuagguggacgcuugcacaagaccagcuguaauugggagccccaggcuaguguaggggucucgcucuccagcaggacagaggcucuaccaagcucuagagcgagugucucugggucugucuggauccggauuucugagcacucacucaccucgcugcucaggcccuuccuccacuccaguuccauacucgcagccacgccgggaaaaaucuguuuaaggagacaggcaaccaaguacgggaaaaggcaaaggaauuggcgugcuuuuuuuuuuuuuuuuuuuuuuuucuuaauuauggauagcuauuucacaggucuaguuucagauaagauaacuuuuaaaauacacgggcgaguuugauuuuucguugccuguggccuacggguuuuaacagcuaacucuucguugauugaugucaguacuauaauauucauuugaaguaagacuugcacaaggccacggguugauuauugaggucuuaaggugauccaguggaguuuagaacuaucaguucaguguacgaaagcggcgcuguccagcggggagccugugcucuuucauagacugaccccuagaaaugcuggcuagucugaacugagaugugguaagaguguaaugugucgauuucgaugauuaugaaaaccgaacgcuugauguuuugauguuugauugcagccucuaaccacuaaaguaucccuccagcccgguuuuaauaauuuaggaaaaguaguguaaauauaauuaauuuugauuauauuguauugguugucguauuuagggugugucauguuaagguauguuuaaaauuaguuuuaauguuuucucuugucuucuuaaugagcuuuauuaguauauuaaaauuucacauauggcucacuggccaguacugcugcagaaguuaaccaggaaaggaggaaauuuacagacaacagugaggaaaauaugguacaagagggccucugaguccgauuacaaaggaguuugaauuuccuuacuccugcugaaggaaagaauuuuaaacuuuucuuuacacuucaauguagugccuggcauauguuuugcauaccagacaguucauuaaagagccuuaagaccuagguaaaugguucucggugaucauaauugauuuucagagcgcuuuguuagcccacuucccuuucccuuuuauuagacauagauucuuuucucauauaauacuaucugaacaguuucccaccucucuacuuauagugucuccccaccucuccccucugaauucaccccuuuucugccucucauuagaaaaggauaggcuucuaagaggcaagcaacaaaauagaauaaaauacaguaaggugagauaaaagggaaaccaucauauugagguuggacaacagaaaccaacagaaagauaaaaagaucccgaagagaaggcgcaggaaucagagacccggauucacaguucagucaggagucccauaaacgcacucaacugaaaguuagaauacugugaguucucagccuucccgaugcugccgcccuuuaauacagaacacugaagugaaccccagccauaacaucauguuccuagcuacuucaucacggcagcuuugcuacuguuuugagucauauuguaaauauguaaauauguuuucuguuggucuuaggcaaccacggaaagggcccuuugaccccaggguugagaaccgcugcuauaguacacaugcagaggaccuaguggagacccgugcaggccccacgcuugcugcuucggucucggaguucaucggagcuuugcucgguuguuuuaagaggaccuuguucugauguccucugucucagguuuuugcaacuccuucugccuccucuuucucaggguucccugagcucugagggucgggauucgauggagccaucuuuuagcagugcgacuaacccacuuuucauaggcaucgaaucaaacacugcuuauuaauggccacuucuccuauaucucuggauucuccuucugaaugcgcagaccgagccuaucacaggccauuuggacagcauggaagggcuaugggccucuugcacuuccucuuccgguugcauugcuugauaccacuuuccguggcuuggucugguuuuacucaaagcgcaccaaagcuuugauccagucggaauguuucccaaggcuugcucagcguggggggaugggaggguguagguuucagaggauguggccauuuguugcagauuugcuuuuugaacaggauugcauguucaaagacucuuuauugaacuauuugaacuucagauauuuaaaugaaggauuuguaggaauuacuugcuuccuggcuuacagggcuuuaauuaaguuucccccccuccaguguuguuucuaacuaaccaaugcggcuuugagauaaauauuugagaguguuuuugucauuaaggacacuggauguugaacuucucuguuauugacacauggucucauacaguacaggauggccuugaaccuuugaucuacccugcuucuacccucagugcuagcauuaagcacuacaguacccagccaugacaaauauuuuacauccucaguaaacucaaaaugcuuguuaggguaucugauaucagauuauuguuuccuuauucuuccauaacauuuagcgaagucacuuagagguuaagcuagcagagugacaugccuaaggauguauuauacuagugugugugucucucuguguauacacauggguuaauauuacaaaauggugcccacgaguugcuguuuauucccuuuguauuugaccuggaaauagagagauggcauuuaauuauagaggcuuaagaagaggcuguacgaacauggagaaucuaccuuugggguguuuugagguucucaccuggaguagcuggggcugguaucccaccuagcuuggagccagcuacuccugcuauugcucuuuggagcauccuggguugcagcugugaccuggauguugcugggcguaacccccaccaaaaauccuaaggugggagaaaugugagcuuuggcugggugcaggguuuaugguuggauauaaaagucauuuguauuucuuaauauuuguaagcaaaugaaaucacuccccuugugccuacccaccuaaugggacauugcaguagauaaagcugguuuguguccaacauuuggagaggguuguguagguuucaagaauccagaguugcuuauacucaaugugagacccugugcuucucucuguagagugccugcaguccgccuguagcauguguggcaucugggcccucuucggcagcgaugacugccuuuccgugcagugucugagugcgaugaagaucgcgcacagggggccagaugcauuucgcuuugagaaugucaauggauacaccaacugcugcuuuggcuuucaccgcuuggcugugguugacccgcuguuuggaaugcagccgauaagagugaggaaauacccuuauuuguggcucuguuacaauggugaaaucuacaaccacaaggcgguaagcagagugaagcuggggauggcuggcuggcuauaacucaccuucagaccuaugguuaugauguucauauuuugugucacgcuuuuuuacuuuguaucuuuuucuauguucugacuccuuugcucuggucuuauacagaaaacugacacagaaagguaaaauuaguuagauuuuuuuucaagugauuaacauggagaugccaauucaauuuuuuuccuguuauacauuuuaauauugauuagggcaguguuagcugauggaguccugucagcgaaaaugucaggccugugcuccauugcagguuacgcuaacaggagacagacaaaaaaaucacuguaaauugaacuuucggaaagcaaaugcagaaguggugcacauaggaaagcgguuugcggggaugggucugaggaagggagacuuaaacugagaccugauagacagagaauacuugccaagccccggacguguuucccauagagggggauagcguguguagaugcccagugugggcgagagugagugagaagaggacccauggagcugggaagacaggacagucagucuccugcuauaggagccuuccaaggccaggagcaauugagggcuuagaggggagagauaguccugcaauguugagaggaggugagauuugcaguguuauauaauagggccacugagaaagcguuugcaguuucacacuuaguaggagccaaauuguagaaagguggccggaggcacugaaguguguuaagcaagacuugcagcauugaaacucucuggugucuagagaacaggagcgagugaggggcagaaaugcugaucucggaaaccagauaugguacggaccauccaagccaggauuauuugacuuguuuuucauaaggaaaaagaauuaaaucuuuaauuuaugagugcuuguacaaauaccaccccuuguuauauuugcaaacuuguuaaccccuccccaacuucuaguugcuucagagcaaugugccugaguacuggguauuguuacugccugucuguauuuaucuccaggccugcguggucccuuuaggcugaauaauucuaguaugguacaccauaauguguuuccucuaaaauauguaaucauuugucauuuaauaaucagaacauucuccuagcuaacguuaauucccaaccuaagacuauaacaucuaauaauauaauaauaauauaaucuaauaauauaauaucuaauaucaaguucauaguuaagcuucuccaaaugucccuagaauacauuuagcuguguuuuuguuuggcuuugccuuuuuguuuuuauuuuuuugguguguguguguguguguguguguguguguguguguguguguguguguguguguguuuucaugcuuaugcaccccuguuugguuuuguuuguuugguagggcagauuucagucaagguuuagucauuuggccaugcuguuucaugguaaauuuugagacuucugugccuaucuuucauugguagggguuuaucuuuauuccuggacaaugguuuuaauuugccaguuugcuugcuuauaggggcauugucaaagcaggguucucaucugaagccuuuaaccacuuagcaaauauaccuucauaaagggcuucuguaugcaaagcucaaugcucuaggaugaacccgguacagaggaaaguuaaggaaagcagugaggggugagguggaguuugggucucaguaagucaagccaguguaccugagaggaugagguugcgcucugucaguaucacccuucaucuugucuuccugaagugagguuagcacauaucuuggcuuaugguuuacuuggacaguguugcugcugcuuauuaauuuuguuaacaauuuaaaaggcaauaucuuaaaaacaugccuuuuaaaaauuagguaauguuauauuugcagagacuuucugcuguuucuaccaagcauccaaacuuaaacaaaugcgacugcuacaaacuugucuaagaguagaaugcacaacuucagccauaaguauuuuucagaaugcaccuucaaaguucgucuucaccuccugcuuauaagccaggggcccagaacaaguccgaggccgguguggcuuuaggaagguggcaggacaugugugcagcacagaagcguccauuccagaguuagaguuaguacucggcaguuguuagugaagggacgagugcuuucugagaaaauuaucauugaaaaugagaguggaagcgauguucauuauuuucaaaugcuguagggugcucccacccagagggguagauuuuugggguugaagagaugccucagcaguugaaucuguucuuccagaggugcuuaguucaauucccagcacacacaugguggcucgggaccaucuagaaaagaaacugaagcauguagguguacacacugcagaacacucacacauaaaaucaauaaaguaaacagagggguagauuuuucaaaccccaccuaccugagccaggacgacccugaccaguccuuagcuuggaagaauggccagccgguacuguaagagaggcagcuaaagcacguguuuuaacaguucugugaaugcuuuccacagaggaccacgcgguagggauggaaagaccuaacgcguggcuggugugcuaguguaguagaaacugucagaaucugggcccaacucaagccuuuucacuuugcugacagagacaguggagggcccauugcuguuccugugcggccuaucuaugaucauuuucucugucccugagaaguagcuuuaauaucccacuauucaggaaggucuggcuguuguccucuccugaggaccagcagcuugggucugggcucugccguugugauggauuccuuugcauuugucaguaagggguggccacuagguuuuccuuuugcugaauauuucaagggaggucuuugaggauuagcuggaagggccucucagccgauucugcaucucaaaccaaaagucaacaguuguugauaacacauuuuugcuccaugguaacaaggcaaacuguucuccaaguguguuggcauguccuuaucuauauucuugguuucuaccuucaaagaucagagcaaacacuggugggaaauguuuaugaaaaauuauaccuaugaugaacaugcccaugucuuuacacccugcacaauauugcauaacaauugcaucuaaaguguuguauuaaguuuuuuuucccccuuugguuuuuuuucgagacaggguuucucuguauagcccuggcuguccuggaacucacuuuguagaccaggcuggccucgagcucagaaauccgccugucucugccucccaagugcugagauuaaaggugagcgccaccacugcuuggcguguuaaguauucuaaaucuagaaagcauuuaagugcacaggaggauguguauuauauuauauguagauaauauucuauuucacaaaaagcacuaggucaccugcagguuuuugucuuggggcugggguccuaaagaaaggaugacuucccauguaaauguguauguguaacuacagaguguagacucugggcugcaauauguacuugaauuucuucaugugucacagcucugaugccugacccuuguauccuguuuaucagaacacagucuuuaucgucauggguuuagccuuuauggugaaaauuuuucagaauugugaguuuagacaagguagauuugaauaaugccauacuuuuuuuuuucuuucuccuucuucuucuuuuuuuuaaaucacuaaugcacacgagcugaugcuagaacacagauacugggucagcauccauaaggauacuaacuuuuuguuugcucugcuuccuuaagcuacagcaacguuuugaauuugaauaucagaccaauguggauggugagauuauccuccaccucuaugacaaaggaggcaucgagaaaaccaucuguaugcuggacgggguguuugcauucaucuuacuggacacugccaauaagaaaguauuucugggcagagacaccuauggagucaggcccuuguuuaaagccaugacagaagauggguuucuggcuguguguucagaagcuaaagguaauaauggaguuuaacuauuuuugguuuguguuucuuccuggaucauagugagaaucccagagaggugucaaucaaaaacuuuaaaaugaugaaagaugaauacucaguaugaauaggauuugaaaucuuagucaauccuuuccucuuucaugugugcguguguguuguauacacgugugcucauacauacgcacacguagagaccagagacuuaacauuagacaugguaauuuuauuuuauuuaauccgccuuccucugccuccugaguaccaggauuaaagauaugcaccaucgugccagucuccauuuuaauucuugacacggucucuuugcacuuagaacucacucacucacguuccugauuuaguggcugagcuccaggucuccaccugccuucuucguccugccccaccuauccuagaaauaaagaugcaggaugcugcuaccagguucuccauggggccuggggauuaaaucucaguuccucaggcuugcuuagcauggggcuuggcaggcaccuuauucacucagucuuucugcagcacccgguucuucuggccucuaggaggugagcacauuuuuucuucaugcaaaguaucucugccaugguuuauagauagagccaagcaaccacagacuuggucacaguggcucaaaugcuugcgcuaaaauaauauuucuuuuacauuucuuaucuuggguauauuauuauagcaauagauaccuuaacuuguuauacucaguauaauacaccuacuuagcauuauuuuucuggcaguaaacuuuguaaucaucuuuggucucuuaccuagauagcaaguuuucuguaguguaguuugccauuuuuugaauccuuugccacuuagucuucagauuuuacauuacuugaaaccaggaucuugaucugcaugcuaaccaaaguguggguauuaaauaugcuucccuuggucugucagcagacagcauagggcauucuacaucaguuaccuaaaaucccgucagggaaaccuggcaaaggaaauauaaagcaggauggacuccugcuucugcgggcuaucuuuuggacuuuuagaccugaugauggcuugauacggaccuggaaucccaccagcaguuuacucucugcaguuuguuuucugcauccuuaacucuguccuuuucuagacugccuagcgaccuuuacauuacuaugauaagaaaucacgaccaagacaagacuuuauuuggagcuuagaguuucagagggcuagggucuaugaggucaugauggggaacauggaagcaggcaggcagcggcugggagcuuacaucuuuuuuuuuuuuuuaaagauuuauuuauuuauuuauuauauguaaguacacuguagcuguccucagacauuccagucagaucucauuacagaugguugugagccaccaugugguugcugggauuugaacuccugaccuucggaagagcagucgggugcucuuacccacugagccaucucaccagcccccgggagcuuacaucuugauccacaagcaugaggcagagagcugacugggaaugaugcgggcuuuugaaaccucaaagcuuauuccuagugaugccccuguaagaaggccacacuucccaauccuucccaaacaguucuauugacugggggccaaguggauaugcucuguagggguccuauugaauccaccacacagaucccauuggagugcugcuuccuuaaccaggcuuuaaaaccaucucaucguggugaucugccuaagaccuuucaguuggcugcaucacauccucuauggggugaacagcauuugagcucugccagcuagugagcacacugcauuccuuugaccuuugaauucaauguacacagauuggguuauaagacucauaguacauuauaacaaauaucuguguagauagccuguuuaucuauuuauuacacaacauuggcuuuugugcagaucacgguggugucaggguagcuacugucuuuaagaacugccuacaguuacauucuauggcuuucucauacacauucuaugacagccaugaagggguggguacuggcuucugaguaccaguaguguaucauuuuacgugguaaagacuugagaaccauuggucucucaaaauaccaugccaguuaacaugaaguuaacauucugauuucucuuuuuucucagauuuauauuuccucuuguuuauguucugacagaaaauaggccuucccuuuaaaaagcuuuuuucuuugaaaacuuuauaaaugucuaaaagacagguuucagaaaauucagcuagguaaaggaaugggaugaugaagacuuucauuuuaauaaagguaucagggccuuucaggugggagagaggauugucucagaggauguuauuguaacgacgagacauacacuaguuaaaaggugauguuuggaauuuuuaucuugcuauguuaggaaauuaucucguaaggaaucaucuuccuauugcaucaaaugacugcaaauccaugcuguuuuguguucugucuccaugucauucuugcuucuucaggagagaugcuaggguaugggguaauuauuuccccucccaccuuuuuuguauaauggauaugcguuuguacuuaagggggaaaguauggguuagaguguacuagcucacugcacaggcugcagagaagcaccuaauugcauacguugcuguuuuccauuuauaggccuuguuuccuuaaaacacuccaccacucccuucuuaaaaguggagcccuuccuuccuggacacuaugaaguuuuggauuuaaaaccaaauggcaaaguugcgucuguggaaauggucaaauaccaucacuguacggaugaaccauugcaugccaucuaugacagcguggagaaacucuucccaggugacuagugcccaugaccaaaccccagaacucuagcucaccccugacaacucagggccauuugcgccguuuucaaugauguugguuuuaagauguuccucuuugauuuggagguggagcgaucuccgugagugagggagagccaucacaaugauguaguagacugcuugccucaucucagucagcuuagccucagcuuguuuguggcgguuccauuuacuuucuguguuguuaggcuuugaccuagagaccgugaagaacaaucugcguauccuuuuugacaacgcuaucaagaaacgcuugaugacagaccggaggauuggcugccuuuuaucaggugaagucacuuuaaaaaauaaaaacaucuuacugguguuuaaaugaaaugauuuguagcuggcacugagcuuugaauguuaaaggccuacuauauaguuucauguuucauuuucuauagacguguuuauaaacugcauuuguuaggguuagagcuuguugguccucauccccuagacuccuguguauugaucuuuuaagccaguuuagaugcaguugccauuguaaggggacaagaaaauguauguauucacacacacauacacauacauauacauauguauguguacauacauacacacauacauauauauauauauauauauauauauauauauauauauauacauacacacacacacagacacauacauauauacauacauacacacacacuucauuucacuucacuauaaaucuuacuaaagcugauuucuguuuauaaaacucagagaucuucauagucaaaugccaauccagauguuuagcaggugugugauuaucuuugcccugauuaauguaugccugcaaccaucaaguuuauuuucaugcugcagggggccuggacucgagcuugguugcugccucucugcugaagcaacucaaggaggcccaaguucaguauccucuccagacauuugcuauuggcauggaggacagccccgaucuccuggccgcuagaaagguacagcacaaccugcccaucguauagacucagaacuuagcccaauuguuaggacgaaaaucaagcugaagucguccucgugugccuguuguguuacuaugagaaaggucaugcuagaaagcaacagggugaggaacggauucacguggcuuacauaucccgaguuguaguccacugacgaaaucuaggugggaauuugaggcagaagccuguaggcaggaacugcagcagagaccauggaggggcacugcuuaguuguugguuugcuccuccuggcuccugauccuucauuucccaucuugaguuuucugcuuugucuuuccuccguggacugugacucagauaaaccaaauaaacucuuuccuuuccaaguugauguuggucacgaucuuugugacagacaagccauagagaacaacuaggauagggacuggugccaggauaucagcucgcaucuuguuuucuuaugaagcauaugcauuacaagcagauauuguacaugcaaugccguguguggaagauggcgugcugcucuguaaagaccuagaaugacugagagaagccucgaggagaauuccaauucgacaggaaaaggcuauauauguagggauaccaugcuggauauaaaauuaggcauuucaguacaguacaagggagaugauggucaaaagggagaaaugaggcagguuaaguaaaauaggagagaguggugugcugauugggacucuggacugucagucuguagcuuugauuugaagagagccaaugugguugaguggggagugagggccaggcagaggcaccuggcuugcuuuagguagcauguggcugugccugcaucuaucuccucuuacagaaggggccugcaccuccucuuauugaaaggccugcaccgccccuuaccaaggcggucuggagagaccuugagucaucuucagcuuuguuucuuuucaccauguuuaccuugagaggaacuggccuguuucauuuucuaaagugguucuuuaacaaaucuauggaguuuuucuucacaaucagguggcaaauuauauuggaagcgagcaucaugaaguccuuuuuaacucugaagaaggcauucaggcccuggaugaagucauauuuuccuuggaaacuuaugauauuacgacaguucgggcaucuguggguaagggauuuuauuauagggaaaagcguuuuaauacugaaacaguagaagguuuaacaugauuucagcuuaagaaauauugucuaaauaugaauacuagcaaaguuccuauauuguuaauaauacuauaauauagugauaagaccauuuaaaagcgcccugaauuucuuucgacuggaggaagugcuuaaugaauauaaucagaucaucugaacacugaauuuacaaggucagcucggccuguggucuuaaagaaugcuucauaaaaauaaaagcagcucacaucugcuaagcacauacuucaugcuagguucugucucccauacuucauaugaauuauuuguuaccucagaacuaacucaucauaaccaggauuccagcacccaggagguugaggcagggggauugcugggcugucagcauaugguaugaccauagaauggacacauauuuuggcucccuuucucucaucuucucuguuuaaaauaucuuggaugauauaguugggccacaguacauaacauuauuauguauaauaaucuggugugcuuccuagugcauguaaaagcuauggcuacaguguacuauggucaacuaaguaccuuuauuuaggaauaucuuauuguuguugaucaucuaagcuguggaaaaugauacaguguauuugcuuagugcaggauugccagacuuuucauuuguaagaaauuaacuuccucugagauacaauaaagcuaagcauaguaaaacaagauaggccuguagauguguguagguuguguucaaaugcuaucauuuuacaaggaguuggguaucugaagauauguguagcuguuugguucccagaaccaaucccaaaugaauaaugagggaacacuguucuuaauaaaauggggaaaucgguccauguuacaguacauuuucucuaacggguccucauguagauguauaauaaguauuccaucacacagcuuaccaguuacuagcuauuauugucaugcaagcaacacuacuucuaucuggcgaacacauucuaagauuagaaauguaacacaaaucagacccaauuuuguugaaccucuaaaauuuuacuagcugagugaguccuuuuaaaaacucacuuuggagugugauaaaauaccuuggguauuacagugauuuggucuccugaagcaucauaguuaaauacucacacguauagcacaucugugguuaaauuuuuaugagguggaagcagaguuagaagaaugucucuccuaagaaggauaaaaaugagauuggaggagacagaugguaguguagagagaugguaguguagagcuaucuaccaaguagacauagcacaauauuguacagagccuucuuaaucaaaugugggauuuggaaaugagggguggaaauggaaaagaacgaaacaauuaaaaguaagcuauuuccauuagucugcuuucuguuacaauaauggauaaugccagaugagaaacuuuagaaagcccaacagcauggcauguugguggguggcaucaggaguggcacaugagaaaggcaucucauagugaucccaggcauuggagacaagagaugggcucuguccuaaauaauugaaucaggagaaaucauuugaugcuugaggagcaaggaaccccaaccacaccuuaucuuccacuucuccaccauggaucacaccaccacauggagaccaaacugcauccaaagcauugcaaggccacgccuuacucuacuguguuaguacacaugccgugguauucaggcauuugagugguucaauccagcaaacauuuaacauagaaagucuuguucuaagaacauagcuuugcaaccuguuuguaaaacaugacaguggauugcaggcuauuuuauuguuuagguuggauugacagcuuguagaugacuuacaaauuuccgauccuuuuggaagcugcuuuaauacuuauacuaacucaguccaacaagacacuccagccuacuguugcuucugaagacaacaaugacaucgccauugauuucucuuucauuuaaggcauguauuuaauuuccaaguauauucggaagaacacagacagcguggugaucuucuccggagaggggucagaugaacuuacacagggcuauauauauuuccacaagguaagcgcucugaacugaaacgauggccaggcuaaguuaggaagucagaaucacuugacccuuucuauucuguccuuaugauuuguuguaguuuuagaguguauuuguguuuguguuuaagaauugaugcuaucuaucugucugucuguccguccguccgucugucuaucuauauauuuauaggagaaagaagacuuaauaguaucagauacuuuuuauucuuaaacacgagaauugcuuuuguauuuuaucugucugacugucugucuauugauuuuuuuuuuucaagacagggucucauuaaguagcucugguuguugagaaacucacuuuauagaccagacuggccucugcuucccaagugcugggaugcaaggcacugugucuguugcccagggcacucauuuaauuuguuuucacacuaagcacuucggaggauggaugggucggucuuguaaaacauugcuggccucugaagucauuuacucacauccuauacccuccucuuaagcuuucugccuuacucauucuuuauuucauauguaagaggggaaaaugaaggcugccugugugccaaaggaaggcacucaccuucguuuguuaaauaggcuccuuccccugagaaggccgaggaggagagugagagacugcugaaggaacucuaccuguuugauguucuccgggccgaccgcacuacugcugcacacggguaacuuuaaaaucaguuguaaaaccaacaagggagaagggggaaguagcuuaaaugagaucaguugcuuauuuugaguuucuuucggcuggcugcaaaguaugguuuucagcaaaguuuguccccuaaaagcugugcuauggccuggacacuaucaccgggguguggagagaucauguccuguggguaugccaggcagguuuugugucacuagaucauaacagcaaugggccguuucuggccuagagggaaggcugcagcggcuucuuggaaacauuuuagagcauuuggaguauugcuucugguagcaaauacuacgugccugccaagccaguuugcugcaucugggaggagaaaugcaaucuucaugcauucauucauuuguugauaggacuauagaauaaaaauaaguuucuuuggagccauuucuucuugcccaggguuucuaggguuaacugggcuuguugaagaauagaagagcuuuacugugcaggauaaagacuugccuuucaacauuuucaguuccucuacugaaccauauuuggcuuacgaauggucuggaaucauaguuaugaccugccugcauguccugacgagugucacugggacuuuuguacauaugaugguaugaauauucauauacccucaugaccaggucacucaugauaauuaacguuuuauagaaacagguaauuuuucauaggcgcagaaggaaagaaauacuuuaagacagaaagcuucccucccuagaugcugguuuuauuucaaguacaaacauuaguauguggcuaaucaugcaguguggucccuaggaggcuggaauguaacucuuucuucuccaugacucagucuggggagguugucaggaagccgugccagccaucugacucagauugucuucuguuuuccccaagucucgaacugagaguccccuuucuggaucaucgguuuucuuccuauuaccugucucugccgccagauaugagaauuccaaaaguagguauaucaacccuggauaaaacccccaaauauuguugguuccuccggcgacuucacugacccuccuugugugcuccugucagaauggcauagaaaaacaucuccugagagagacuuuugaggacugcaaccugcuacccaaagagauucucuggcgacccaaagaagccuucagugaugggaucaccucagucaagaacuccugguucaagauuuugcaggacuauguugaacaucaggucugucuuuaaagauauauauucuggaacaauaauaguuuaauagagagcugggaucucuguuugccuuucguuugaauaguuguaucuaaaggagagucagaguuccugcaaggaauaugucuuuuauaagcuuuauguaauaauuaaggaaaaugaaggacuauaaaguaguauugaugaucaaaagaaaagggauagagggaagacuuccaauucauugcugaucauuuugcacgucuggguaccugaugaguacaaaugagucaaacacugagccucuaaguauuaauaugcaugagagcuuuuaaaaagucacugucuguuuauuauggcuugcuuuggcacuuucuaaauaaugagugacguaaagggucuuguugcuucauagcaugccuuaacuuuuuuuuggucaccaucagagcaaauacacaucgaaauguuuuauguuccuacuuuaucuuauagguugaugaugagaugaugucugcagccucccagaaguuucccuucaauacucccaaaacuaaggaaggcuacuucuaccgucagaucuuugaacgccauuacccaggccgggcugauuggcugacucauuauuggaugccuaaguggaucaaugcuacugacccuucugcccgcacucugacccauuauaagucagcugccaaagcuuaggcacucucuacacucuuguguaaaaguaaauguuucuuccggcucugaaggucgagacagcgacacaaucagaaagaaugagacucagccaucagucacccaggcuuacuuaggcaugaaaagaaauaaaaguuucacaucugaaaugccu

SEQ ID NO: 2841 - RNA, 8057 nt, Mus musculus
agcuuccaagccucguggucgaauccacugucuccuguugugugagauacguuucgacccggagcuccgccauuaaaaaaccucuuguuguuacaucaagguguuguguucuauucgcgauucuugggugcacgccgaaucgggagcugaguggggguuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuaguuuuucaguucugagauuguggguuugagccccauucuggcagcugccacugcggaccguaaggacccuaguggcugugggaagacgacggucuauuuccccacaggcugcacccuuggaagacauuccgagggagacccuggagugcccgggguacggaacagucaggaggaccuggcuguugccuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccgugucuacuccuuuaucuuugacuaaggaccauuggacggacguuagggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaaggaccagggucgcauccagaccaacaaccguacaucaugguaugggaggacuuggcacgcuacccacccccguggguucgcccauuccucccgccucuccgcccuggcaccaagauucuagccauccaagaaaauggugagaaagagaaaccgaaaccaccgcucgggagagaugaugaucgcagcacaccagugacgaaaccccccaagaucuauucagagauugaagaacccccugaguggcccgauaccccucaacccccaccuuaugcuccccagccccaaccaucagcucccucgggaccccugccucaggccccggccggaggagggggucccuccacaggaacaaggagccggcgaggagucaccccugaggggccugcggauucaacuguggcgcucccccucagggcuauuggggcuccccugccgauccaaauagucuacagccccuacaguauuggccuuuuuccucuucugaccuuuacaacuggaaagcucaucaccccccuuuuucagaaaacccugcaggacucacuggguugguugaaucauuaauguauucauaccagccgaccugggaugacugccagcagcuucugcagacucuauucacaaccgaggagagagagaggauucuccucgaggcucggaaaaauguccgagaugaggcugggcgcccuguccaaacuccagcugagauagaugaaggauuuccgcuaacccggccccgaugggauuauaauacggcaucagguagggaacgacuguccaauuaucgccggguccuaguggcgggucucagaggugcugcccggcagcccacgaaucuggccaagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagagauguaguuagagaggcagagaaaguguaucauaagagagaaacagaagaugaaaaguuagagagagagaaaagagagaaaagagaagaggaggauaggagagacaggaggcaagaaaagguuuugacuaggauccuggccgcaguaggagaaagagauaauagaagaagagguagacagucagggaaccugggagacaaaaggcagcagggaccaaggagacccagagaaggcgggcagcgccuggagaggaaccaaugcgcguauugcaaggaaaugggccacuggaagagcgacuguccgaaaaaaaaaacaagagguaaaggugcuuucucuuggagaaaaugaagacuagggggaacggggcucggccccccuccccgagccuaggguaacuuuagaaguggaggggaccccuguggacuuucuaguugacacgggagccgaauuuucaguacucaaaacaccucuaggaaaaguaaagaaaaaugaaaaaaccuuggugaucggggccacgggacaaaaaucguauccauggaccacaucccgaguaguagacauagggcgaaaucgaguaacucauucguuucuagucauuccagaguguccuaugccuuuauuggggagagacuuacuaaccaaguuaaaagcacaaauaacuuucaccucucaucgaccggagguuuucuggggaauaaaagcgccccagacucuagagcugucuuuacaacuaggggaggaauaucgacuuuaccaaaauaaaguaaagcccccugagggauuacaggacugguuaaaucgauacccccaggcgugggcagagacgggaggaguggggauggcaaaacuggucccccccguggugauugaacuuaaguccagggccaccccuauagggguccgacaauaucccaugagcagagaagcucaagaggguauacgcccccaaauuaacaaacugcuccaacaagggauuuuggucccaugcaaauccccuuggaacacuccucuacuuccaguaaaaaaaccagggaccagggacuuccguccaguacaggaccuuagagaagucaacaagagaguucaggacauacaccccauggugccaaauccuuauaaccuccucagcaccuugccaccuggucggacaugguacacaguccuggaucucaaagaugcuuuuuucuguuugagguuacaccccaacagccagcccuuguucgcuuucaaauggcgagacuccgagaguagacaagccggacagcucacauggacgaggcugccucagggauucaagaacucgcccacuuuguucgaugaagcccuacaccgagaucuugcucuuuuccgagccaauaacccacaggugacucuucugcaauauguagaugaucugcuccuagcugcagaaacacgcgaggacugugaaauugggacccaaaaccuccugggcgaguuaaguaagcugggguaucgggccucugcuaaaaaggcucaguuaugccagauagaagugaccuaccuaggauaugucuugagagauggacaacgguggcucacagaagccagaaaacaagcuguuaugcagaucccggccccaaccacugcucgccagguaagagaguuccuggggaccgccggguuuugcagacucuggauucccggauuugccacacuggcagcucccuuauauccacuaaccaaagagaaaggggaauucaccuggaccagagaacaucagcuagccuuugaaacucucaaaaaggcacugcugcaggcuccggcauuggcccugccagauuuaaacaaaccuuucacccuauacauugaugaaagaaauggaguggcaaggggaguccuuacccagguuuugggaccauggaagcgcccgguagccuacuuaucaaagaaacuggacgcuguggccaguggauggcccuccugccugcgagcgauagcagccacggcugugcuaguaaaagaugcugacaaacugacuaugggccagaauguuacuauaguggccccacacucucuugagagcaucaucaggcaaccaccggaccgcuggaugaccaacgcccgaaugacgcacuaccagagccuauugcugacagagcgaguaaguuuugcacccccagccauucucaaccccgccuccuuacuaccugaggcugacgaggccccugcacauaagugugaagaaauacuggcagaagagacuggaauccggccagaccucacagaccaaccuuggccaggggcgaugacuugguucacggaaggaagcagcuuugugguagaagguaagcggaaggcuggggcggcaguaguggauggaaaggcugucauaugggccagcagucugccggaggguacaucagcucaaaaagcggaacuaaucacauuaauucaagccuuaaggcuggcagaaggaagggcucuuaaugucuauaccgacagccgguacgcuuuugccacggcucauguacacggagcaauauaccgacaccguggacugcugacgucugccggcaaagauaucaaaaauaaagaagaaauucucagcuuauuagaagcuguucauuugccccguaggguggcaauuauccauugcccaggacaccagaagagaacugggcccguugaaaagggaaaucaaauggcagaccaagaagcuaaaaaagcagcccaagggccaaugacucugguggugagaacccaacagcccgcugcugaggaaauaaauaaaagaacccucacagaagaagaggggcgagauuacuuagcuaacauacaccaucugacucauuuaggaacuaaaaaauuacuaaaauugguuaguaagucccccuauuacauuccuggauuaaaaggaauugugaaagagauaguaaaaaacugccgugcuugugcacuuaccaacgcugggucuagcaggcuccaggaaggaaaacgacugcgaggagacagaccuggagccuacugggaaacugacuucacugaggugaaaccggcuagguauggaaauaaauaucuccuaguuuuuauagacaccuuuucaggaugggucgaagcguuccccaccaagaaagaaacggcuaauguaguggucaagaagauacuugaagaaauccuuccccgcuuugggauaccuaagguaauggggucagacaacgggccugccuucgucucccagguaagucagggauuggccagacaacuggggacaaauuggaaauuacauugugcauacagaccccagaguucaggacagguagaaaggaugaacagaacgcuaaaggagacucugacuaaaauagccuuagaauccggcggaagcgauuggacagccguucucccuuaugccuuguucaggguucagaauacaccuggaccccuuggccuaacuccauuugaauuaauguauggggcgcccccacccauuuuuaugaccguaggggauaagaaucgcccggaugugucuuucucuccuucuucuagucuuuuggcucgauuaaaagcucucgaaauaguaagaaaagaggucuggaaacagcuaaaagaaaccuauguugcuggugacacacaggugccgcaucaguuugaaguaggagacgcaguccuggugaggagacaccgagcgggaaaccuagaaccgagguggaagggacccuacuuggugcuacugacaacgcccaccgcggucaaaguggaaggaauccccacuuggguccacgcaucccacguuaagagagcacccccuggagucagccaugaugaguggacuuuggagaagacuacuaauccuuuuaaguugcgccugcuucguaggagcgaucccaaaagacuucaacccccacaguccuguucaacaaacgugggagguacucaaugagggggguagggcuguauggacaaucacugagguacacccucuguggacuugguggccugaucuuuucccugacaucuguaaguuggcuauaggagccccuccuggaugagacuuggagggguacucugacauucagagggcaccuuuaacacccccuccguacguagaaaaacauucgagagacccauggggugguugcucuaaccaaagggauagaaguaugcuucgaacccaucccuucuaugucugccccgggccccaccgaagucagucccucaauccaacguguggagguaaggcugacuucuuuuguaagagcugggguugcgagacuucagguacagcccgcuggaagcccuccucgagcugggacuauauuagaguaacagccaacuauucccuagcgucuuauguaccuggaggauuugaccuagacgaguguacugacuggugccauccgcuccgugucaccuucacugaaccagggaagagagcucugggauggacaaaaggguauaccuggggucuuaggauuuacaaggaaagauaugaugagagauuauuguucacuaucagauuaaaaauagagacccccuacaauccuuuaggccccccaaccaaguucacaccccucacccauacaauuacucagccuacuccagugauugcggacccccuuaauauggccgcuaucacccaaccucccacuccucagguaccucuaacuauuacccccgagauuccuucaagacagaggauguuuaaccuagugagaggagccuuuuaugcccuuaacagaacugauccaagcgcuacugaggacugcuggcuaugccuguccucggguccgccuuauuaugaaggaaucgccuucaauggagauuucaacagaaccagcagccauacuuccugcucuugggguacaggacaaaaacugacccugacugaaguauccgcgaggaauccaggucucuguauagguaccccaccuuccacucacaaacaccuaugcggacaaauucaguccguguccagaacggaagcugauuacuaucuuguaccuuccccgguuagauggugggcuugcaauacaggacuuacucccuguguaucaacuaagguuuuuaauucaucucaugauuuuugugucaugauccagcuguuaccccauguauauuaucacccugcauccaguuuagaagaaagcuaugcaggccggcggucaaaaagagaaccaauuacuuuaacccuggcugcauucaugggaauagguauggcaguaggaguggggacgggagugucagcuuugauagaaggaagacagggaauucagucuuugagggaugcugucaaugaagaccuagcggcaauagagaaguccauagacgcuuuaaaaaaaucuuugaccucccugucugagguaauuuuacagaacaggagaggucuugauuuguuauuccuaaaggaaggaggacugugugcugcccuuaaagaagagugcugcuucuaugcagaucauacaggaauaguuagagacucuaugcagaaacugagagaaagauuagagcgaaagaaacgggaacgggaugcucaacgggggugguuugagucgugguuugaaucacgaccaucuuggauaacuucuuuaauuuccgcuguagccggaccaauccuuaugauaugcuuagcuuuaguuuucggcccuuguauaauaaauagaggaauggcuuucauccacaguaaaauugauacaguaaaacucaugguucuucaaaggcaauaucaaccuauaguucagguagaugaagaguuaagggacaccgaccucuaaaauucuaugauuagaauuagucuaaacagaagaagaggggaaugaaaggaaauaaaacuguaauucauguaauguauguuaaauagcccaaagaguuguuucugagcuuugaaaccuggggcugagaacauagcagaacagaccaggacaugcccgggcaagcccaucgccucccuagcucccaccccucugaccuaaguuaaauguuacaggcugcugauguuuaaauggaccaaucaugugaaaccgcgccaauuccucccccagccccacuccuuuucuauaaaacccccuagcuuccaagccucguggucgaauccacugucuccuguugugugagauacguuucgacccggagcuccgccauuaaaaaaccucuuguuguuacaucaag

SEQ ID NO: 2842 - RNA, 30895 nt, Mus musculus
cgcgcgccgggcccgccucggccgccgccgccgccgccgccgccgggagaugaucugggcggccgcgggcggcccaggcuagcggccccugcccgugcugcggcgggccagggcagcgaaggucgcggguggggggucguccuccuccccgccuccgggaggggcgagagggagccggggcugaugucagggacggcgggcggaggcgcccgagggcugcggguccaggggcucggcugccggcggcagggcgacugaggguucgggaacgccgcccggguccgcguccccguccgcgccggcgcggccaaacaggugucucgggcggcgggcgagcggccacccucgcgcucuccgcggcccggcguguccggcccgaggcgcccggggcgggccagcgccgagcgguccugcccgccgccccgccccgggccuccgcgcgcccggcgcccgccagcugugugcacucaggugcgggcaccuuccggccgcaacagucccgagugcccgccgccguuggaccgucagcuuugucuggagcuggucgguuaugguuggaacuuucccugcccuucguugacugagugaaccagccagguguguugggggcuugcuacgcgcaggauuuaaaaaaaaaauguuuuuuguuuuuucuuuuuccuuugguaacaaagugugauggcuuuccuagauguuggcuaguuaaacaaagugcuuugacuuuagauagauacucuucuaaauuaacuaauuuaagagugaggaucggggauuaaugcuuuugagcucuguccacacuucuuacuaguggcgugggacuuagaauauucuaagaucccuuacuuccuggaaaaaaaauuuuuuuuuuccaaucuagaucuuuguauucacgguauuuccuuuuaguacauacugucaaaagauguauucugaguuaaaaaguuacaaaguuagaacuucagugcuucagacugaguaggcaacgcggaagggacagaaguuugguaauuugcaggaaguugaggauagaccacagauagcucagccuggugccaagaaaaaaaugcugugcacacuacaaguuguuugauucugguggaaguuuggauuuggaaguggaaacuugaguuuuuagaagguauuuauaaacgguacaauuuuccaguuccuuaucagauaaaugucagacgagccuugugcacacgauauugugugcucuaagcauuguauagcauuucugccagcuguaguauauauuuuuguccaguuuaaaugaauauaagguuugaaguuaccaaacaguuaacucuuuucaccauauguucaguaaaacugacuuaggaaggcaaguaugacucacugaaaagucagcauuaguggacaacuaacuuuaguguuucagauuuucuugaaauuuauguuuuccucuaucuuuuuacucaggacucagcaguuuacaaaugcuuuguggucauuucccacuuaaacucccucucccuacauugugcucuuaaaaaaaaaaucagccuacaguuguggauaacuuuaauaucaagcaguuuaaaaguacauauaaugaguuaauguuuggcuaauuguauucaaaaguaugugcuguauauugcuuguguguugauuuugcugaaaugaaaauuguguuauucagcuuaacuauaaacucaugauaauauaaagucaaaucuuuggugaaaguagugguuggaauuuuguugcaauuuauuuaugaaucaaaugugaauugaaauuguuaccuuaaugcuccuguuuaccuauuacauucaaaaguuggcuuuucgguacagauauuuuaaaaggacuuugagauuuuaacaacuagcuugaaauaaaagaaagauacauguuuuuaauuaccaaaucuggugggacuaaggucuuuuuaaaaauuaaaaauuuaaauuaacaugccaaguggugagauucauauauacguuggucauuauacuuugguuuuauucgcuuaaagaaaacaagacuugcugcauaaaaugugaaguuggccuuuuaucuuucaauccaauaagaaacaaaugauaaaguguacuuaauuuuuugcauauaauugaaaugucacuccccaccugguguuggggguggggcgguguaagucacucagcugcaacuguuuuuuuuuuuuuuuuuccuguuaggugugaaacaggaagcuguucuuuaugaaucagggagucccauuugaagguggagacaccaaacagaaacuuaaaacaaauuaucuugcaccugcaguaugaaguguaguaagggccuggggaggcaguauuaaagagacucuggauuuggaaaucugacuguuuuuacaaugaaagcugucugcugaagcacaucuugacuauggaugaauugaaauauauagaacuccguguggccacuugcauucuuguuugcuauguuaguuuucugaggcuaccaacaacggcccauuugagacgcuggcaaagcugcacugcuccagagguucuagaaucuaccguuacugcaagcucugugucuaaggguguccuuugcuuucuuuuacaccaccccagccucugccccugugaucacaaggcaucgucucuguguagcucugcaagcagggaacuugugagaaaugcacauuuucaaaguucucuugacuggggauggaaugcuuugcuuuaaggugggaaacaagugaagugaaaaaaaaaauaugaggcugcgagugccagcuggaggucaguguaggauguccagggaagaccccugugaaggacauagcagaaacagugugcaaggagccgagccagggaugccugagcaggguguugcagcagagaccagcaagacccuggugugugaaaggagacagcagagucuaaaguuaaaacccaguggggaaagcgguauaggcaguauugaagacaggucauuuuaagguuugggcuuuuuaaaaugaggcuaggcagguuguagaggcguuugagaaaaugggugacaaggucugauuccaguugauaggaugacucuggcauacuagcagaaauagccagaagaaagaagggugcgaggaagagaaguguuggcuggaaggcuguugcugugauugugagacagcucacaccaggguggaggcaguggagacaagcuaacuacacacaguacacaauacagugcacaaaggcagcuuuccuguuagucaccuccuugucugccuuaaagagaaucaauguuguaacucgccuuauagauucuuucugaggugauagauaagagaaacuaugucacaacagguuagaacaggggugugccuuugccauugugggucaacaucaggugucuuccucaauugcucuccauguuuugagcuggucucucacuaaaccgggaaguuagcuggucggcaggccccugggaggauggcccuuguggcccugucagcccacugccccuugcuauuguuuuuguuuuguuuuguuuuguuuuaacuggguucggagggauugcacucagguccucacugagcccuugccccuuccuggugcagugguuccugccuaaagcugacucacuccuccaagaggacuuugauccucauccagauagaacugugguugccaugacuagaagaaaugcuacugucgucuaguaaauacaggccucgaagcuucuaaaugucuguagaguuaauaggacagcccccacaacagugccacaagcuagcucacacugccacugguaccaagauuaagaaaaugugaccuaaaagcacuugcugaggugagaaugugaggcauggagggaggagggcauuuuagucagaugacacaggagaacuauggagcugacuaaacuaggauguuuaagaaucuauugauggucaggaguauugauuggcuuagugaaaggugagauuggaacguagacacaguuauccaggagaggcuuuguaugucuuguuaauuaaggacacuucauuucucacgugcaggcuguagaguugugugaggauucguggaguggcauggccacuuuuucaugcuagggaucaugcuaggguacaguagaaaugaguuggacaagagugguacacauggagggaacaggcugugugucucaggaguuuaccguugacacggaagcagcauagaguagacaggaagaggguggauuagaaguuggaacuugggcuuggcugggugagacgugguggaacauuaggaaugucugagggccguuucugggagugcaucugcuuagcguauaaggcccuggguuugauccgcaacaacccccacauacacacugucccccccacccucaauuacuaguuucaauaaucagaugaaucuuagugaaagaggcacacacugcugguaacuuagauaaucaccuguauuuaaggaaugguauuuaaggaagguauugacuugcuuuggggcuuguugaguuugaguugccuguauuugagucuaugugacuuugaaucuuagagaguucugagaagguccagagaagugauggggagggaugcauguuuuuauuuuuacucucuagauaaauaauuaucuuuaacuuuuguaggaaaaguagaaaccuuuuuuauuuuacauauacagaaaugugugugcccuuccuuugaggguuuguucccuuucauucucuuuguuuuguuuucaugcuacuucuacaaaacaaucuauuagcaauuaaaaauguuagccacaggugcagauauuuuccucgccaacacguguaguuaugguucuuaccagcugcaguguauaguacucugugaacuaacaucugaacauauggcucucaugaacaacuuagaaggcgucaaugaauuuacccaucaguuaaauuucugaucaugaaaugauuguucagaguauauucaguuaagcuucugagauaauugccaaauauucuuugaaaagacaguaaaaguauguuguaaggaagauuguauggugucauuuaauaaauacugcauguuaacaaaccaggaauucugccaguaugccagcuuagaaacagacucucuucauuugauuugccuuuccuuaauuguuggugaaauugaauaauagccuugacugcauccaguguguguauuccucugagucuuuugugucugcuuuuguacguuguuaaucauuuugugucuuuaugccauauauguuuuaaagcauguuaugaagaaacauugcuuugcagcugcugugccuccgggacucgcccacugaagaaacuguuuuucaguaggcccagcuucugaguuuuaggaaguucucaguucaccauaaaaauaugcaaaaagauguuuucuccuagccuguuuuuaaaauauugaaaucuuagaaguuguaauuguuaauuauuagcaaaggacccagcugguugcuuuugugguuuccaaaggauuaauuauucucauacacugccuugaauaagccaccccuuccuugaugucaaaugcuguguggauuauguauuacacagucccauacauuuuuuucccaccaaccauuucggucugaugacacacugccccguugccugucugcugguugacaagaguaggguguuuucuuugcugcugcagugaagaaggcuguacagcuggggaaauagcagauuucacugaagaagacaucaggacuguaagguuuuggaaaaggcuggaguugaggcaaaaaccuacuguugcaguauuuaaucguuuuaaaacuacagagucugggugucagaaggcuaaacaucuggccugguguuuggagaccucggagauaagauaguuguggaauguuaugccuguauacccuuaucugacacuccauuggaaacugaggcugaucagucauccaugcaagaaguggaagaccaggcucacugauggcauuggaaaugauguaguuucuagcagucuggagaguugcucagcuaaucuguuauuaauagacaugcuuuuaaacacacugugauuuaaaacacacgauggccugucagucucaacguuaaauuguuaaaucauuucaguucaccucugauuuguuuguuuuguuuuuugguuugguuaugaaaaagagaacguauguguauuugagaucagguagcccaggcugacccuaggcaggccuucaaguccuaccccuuuguguucaggccccaagugcugagauuaugugugugccaccacgcguccauguaaacauuuuaauaugccuuguguuuuaaccgccagccacucaccauucaagaauuacccauucccuggucaggcaugguggccuagaccuuuaauugcagcacucaugagacaguucagggccaggacagccagguauacauagugacgugauccaauaaaaacuugauacuuacucauuuuuccaggccagguuggucuacauuacaggucccaggacagucagggaggggugcauagugaugugauccaaauaaauaaguaaguaaguaaauaaauaaauaaauaaauaaaauuguguacucaucagggaagggugcauagugaugugauccaaauaaauaaauaaauaaauaaauaaauaaauaaauaaaauuguguacucauuaauuuuuccaagcuuuuagaauacauuuuacacgguuauuuagcuuuuaaaacucuguguuuggggugggaucacauuauacacacagauugauguguagaaaacugucacgugauguguguuugugugugugugugugugugugugugugugugugagauaaaacaccccuaauaugcucauccuacccaguuuuaccuguacagucaguccaguggugguugcauuucuguuaugauguacccaucaucauuguccgacucuagagcccugcauccugugaagcugaaacgcacuacccuauaaacaagucccauucuaccuccccauagccccugucagccagaaucuucuguugcugaguuuuaauuaacguaagggaaacuguacauuguccuccuccuauugguuuguuucacuuaacaaaauguccuacuuuuaucuguuuggagcaaauuggaauucucuucauuuuuuuaaagauugucaauaaauccuuuauguauuuacuaauucauuuaccugucaaaagauguaucccucacccuuacuccauuugaauacugcugugaauaccagugugggggaaauaaccucuuugggacucuguuuucaaguccuuaggguauguaccucaaaguggcaauagugggucauggcccccuuuugaagaucuagucucacuguauaacugcugaccugaaacucaguguggaccagacugacccugagcaggcagauguaugccugcuucucccaagugcugggauugcaguugagcccccccacgcccagugaguauuagugugaaauucugagggccugcuguacugaacugcuggccacagcagcaguacuguuuuauacuucgacuggcaugugcacagauuccaauuucuuuauguucuugccaacaccuguuaccuuugauuguugguaguagcgaucauuaugaguuaugaacuggcauuuaacuaaugauagacauauuguuuuacuugcuuauugacuguuguguaucuauucaaaucauauguccauuuuauggauugauuuuguuuuaguugauuuuuuuuuaggacuucuucgcauaacguuugcuccacuaauccaaauuauagauaugcuuuguguuuguucauucugucaccuguuuguuuuuuucuuaacuguugauaaaguauuucaaugaaaaaagcuuuaugguuuuuuggguauuugggcugcuaaacuuaauacuauuuucacuacuuaagaccucucaaaauuucauaucaauuuauaaaacuuugggauuuuacuaaaaauuuuauugaaucuguguauuagcuuguuaagaacuguaguucaacacuaucuuaacagugugaaguuuuacaguuuuugaacaugaaacauuuauacuuuuggcuuuauguuuuagugaucaguuauuagagacauaauuguuuuauaucgcucuucucuugguuacugucagcaugcagugucucuuuucuauauuucuacuuucaaacuauuugucuuugggucuaaaguuagucucacaguuacaacauaguugaucuuguuuauucauucugcccauuugugcuucuugauuagaguuuaaucuauuucauuuacaguaguuaccaggaguuuuccagcccccuuuuccuggguaacugucucguuucccuuagaguauguuguuuagcuggcuucucugguuaucaggaggguuacacuugguaucacuaagcuacagcacucuagcuugaguucauacugguuaaacuaauagcauacaaaaugccuuucuucuagaacuugccaaguucacugguugauaacacaauuacaucuuuagacauugugugucaaaacuauacuaaugccugucucuuaaauguauggaaccaaguguagagcuaaaaccacuguuauacuaguauaagguguucuguuuauccguguauuuaauuuuuauuuacuuugauuguccacuguacuuuucuaauauucugcauuucuugcagagcgagucuguaguaaugaacugcuuuggggguguuuacacaaaauaucuuaaguucccuuuuacuuuuaaaggaaaaaaaaauugucagauguaggauucaugguugacacuuuuuuuuuuuagcacuuugaauauaccagccuacuaccuucuguccuccaaaguuucugaugagaaauaugauaaucuuucugacagucacuuguaugccaugaaucacauuuucgugguuucagaauugucucugggccuacuauuugaugagacauauuugguauagccuugaauacauccucccuggagucucaucugccucuugggugcuaagacugcgaucuuguauugaaucuggggagugcugguggcuuuuuggcuauuccuccccuccugccucgacacuccagucucuuugcugggcuccuucacugugacccagaccuaguucgcccucacauccaucucucucuguugcacuccucagacucagcucugcccucagacauuuguucugucuucaggcuuggcguuucuuucuccugccugcucaaauuuggguuuauucuuucuaguagaauuuuaaauuuaguaaugcuauuaugcuuuagauuuucuguuuuguuucuuuuuuagguuuucuguuucuucaaagucuuuauuuaauaaaugacugccugguccgccuuaaaagauaguuaaguuuuucuuacuuguugcuuugaaugaaucauuuucucauuuaugugucguguguuuuguuuuuuuuuaaacaaaaaacaaacagauguuuccauuuaauaaugugaucaugaaaucagauugucccauucccugguguuugguguuuuguuuuuuguuuguuguuguuggauuugggggugggguaguuggagguuuuuugguugguugguuguuauuguuguuuugguuugucucagugucaaggacaagucuagcccagguguuucugagguugcacuuuauuuggucauacaccggcuauguaauuguccuugugcaugcaguguuguaguucuuaaugucgauaauuuccaaacagagguggaagagaaaaacauaaaaagggguggagaugauaucagccuuucaaaaccaacuagaagucauuuccgccagagagggagggguuuaucuggguaggugaggguauaucaccagugauugcccaucucugagucuaguucuaugaucaggcacagcaguuggcauucagaagacagguuucuuacugcccaccuuuguucccagaaccuuuuaauaacuauuuuauaaauacgugcucugcaaacagcugccuaccaagcagaccuaguagacaggaaggcggguaguuacuucuaagccgugaaauuaacugaaaucaccuguauuuaccuuacuuuccaaguccugcacaggacauuuggagccuuugauaggucuucagaguucuaaagaguuaacaccagauucuaccuggguaaugucugaguggaaaaacguauuccuaacacuaggauggccuuuucccagaagcugguguugacugcucguauggcaaacuguugugcuuucccacuuacugaauuuuuauuuuugauccuuuagugggguuauauuucccuuuauguagaguuuguacauuuacaaagugauaguuauucuuuguuaccuauagcuuuuuugguuucuauuacaauuauuuucuauauaacuacuuacuuccuggauauaaagauaugauucacuucucaaauagccacuuuuaaaugauuucuuuuaaguguuuccaacuuuuuacaguuggucaaauuaucaauuaccacgauggguuugacaccuucuuaaauacauauaccuguuauuuucuuguacaguugcacuugugugugcuucuggaagacuuuacucgacaggagaacguucaugagugauuauguuucugugguagaacaaguggucucuaacuuuuugucuuuaugaugagucuaucagaacauaaccucguggagaguucaugagcuccaggauuuuguuuaaugauaauauagaaauuuaagaaaauuguuaugguauguggugugugaauaugggucuguaguaauugcagugcauguguggcaguccagaggacaauuuucgggacucaguucucccuuccuuuaggaguucuuccauggucugacuugugcaacaugcacuuuacccacugagccaucccugcaucuggauuuuaaauagucaaugugguuuucauauuuuaugauguguuuaucagaguauuaaauaaauuuucuccuuacucaaauaguuucaacuuacaguggguuuguuggacuauaacuccaucauagguugaacaccugucuuaggguuucuauugcugugauaaaacaugagcaaaagcaauuugggaaggaaagagucuauuucauuuacucuuuuauaucacaguucaugguugaaggcagucagggcaggcaccugggggcaggagcugaugcuguaauccuggagggaugcgcuuacuguccuguuccuaaggugaacuguggacuugugagucuuagauucauuaguuacguagaguuuuccuuaaaaugucauguaacucuuagcugucuucauaacuuacaguggugcuaaaaauuaauuauaaucucuggacauauuuugggccuaaucaccaaugagccucaauuguaagaugaucuaaugugucaaucccugugggaauuccacaguacauguccacaauaguuuuuaacuuuucacuaccucagaaucaugguagcagaugauuggugguagcuucauucagaggccuucugaggucuugcuuugcccugaucuucagcucccggugcucaguucugacauccaguuccuccuguuuagugugggauguagcugcccucauugugucugcagcugaauugccacuaaagugcuguaggaguuacuaucacucucuuccuaaggcugauucgaggagugaucaaaugcugccuugaggaaaugaguuaaauaaauggcccuccgugcgacccuuagcuuccuuccuuaaaaguuuuucccagagaauauuuuugguugacucuuaggauaaauuagaguacaaaaugaauggcuaagaaagagaguuuauuuggguugcuucaaugucaucuaggcugacacagacugaaugugaucauaggucauagacauuucagacaaguuugaaagacaaaaucccacggagcuggggaauuaugucaguuguuugccagaagauuuaagcugacauagaagcacugucuuguaagaaagagauuggauaauuuaaagaaaauuaaaaagaaaaaaagaaagaaagggggaugggugagaaacaaaaagaaacccucgggguaggggugcugcauguacccucaggacuugggaacauugggagugauccucagcuacugaggaagccagugugaggccagcaagcccuaugcaagaccuuguucaaacaagcaaauagaaaggaacucucaagaaaaaguacuucuuggcaucuucacucagaugaagagggagaggaaguuuaaccaggcuaccagacuacuggguuaccgagcuacacgaccucuugugggcaaagguggggucacagggcuauguguccugggacaugcaggcccaaagcaggguggggaaccauccuaguuuugccgaucuuaggauagauuucugggaauuggacacaccuuaacuccaaucucgcucugagccuacuccacucccaccuccccagucccauggcucccuaaccccauacauuaucagcuguauugaugaauauucugaauccuauguuguuaugugaguaguguucacugugucuucaucuggauugguuuccgucacuagaaacucuuugcccuucuguaagaagcacuccucagucauuaaaguuuuaugaugaaauuguagucacuuagucacauacucaaacugcauuuccaguucuaacaugaaauuuaagcagcuacagucuacacuucuaguucccuuucgauuccuccccuaccuucagaugcuaccuccacugguucugaauuccuuggaguuaccagaguguucacaucagcguuuaugggaugccuuccaaaaaucacacggcugcauguuuacauggagaguguugaauccuuggccuuuuccaaguggcuucaguuuccuuggcaagacucaucaggaagagcacugacuaaagccgauacauuguaaaagcuguauuucuugaauaagauuuggagcuccucauugauccacaggcuucagaauggaugcuguguuagcugugccaacagcacuaagcuugcuguauaucuccagcaaguccuggggagcuaggcgcaguggcaaugaaugguaauaucuuuaaaagaaggcuuuuuuuuuuucccuaagaagcagguuuuguacugccaaccagguuuuguuauuucaguuacacagcacagggagaguacauuugguauaauuauaaagauaaucugggggaaauacuuuugagaauguuaaaugccaucagcuucaguuuagggucaugagcugcauucaccugauaacaagauaaucaggccuauucugugacgcuuugaagccagaauugucaucuccucuccgucuaugagagucuuaggugauaucuuuuucuaguauaaggcuguuucuuauacacugaaaaugcugucugucccuuagccccuugcagcauuguccauagcuaggucaucuggauaagcuccuacaguuuguacaccagcguuucuugcuucauuuuacacucuggcucuaggcccagugaaccaaccucugcuaccuuucuauuuuucuuguauaccuuacuucuggccuuuuuagaauuaaguuagggucuugcucugaauuagacuuuagcuuagugacaaccacagugaaucuucuaaccaguccaccauuucauaccagcaauaagacuuaaauucucuugucaguuacacagugguaggaaugucaguuugcuucgagaacuucuccuuugguuuuacuacuuagcuaguugugugagaauccugguuuaacaucccuuuuuuacuaaguauauuucuaaguuuuaauuuaaacugguaagugugugcaagaguuuguuucauuugaacacugaggauccuaguuuccguauuguuggaucccagggaaggguggaaauggagaacaagaaguuagugaaucagucagaacaugaagaaccucuuauuggguucacgaccucauacaggagugcuucaugguguccccagacacuacuaauacugaaggcuaaggccacugauuacagaucaccgugauauguaagaacaaugagucaggccuguaacccuaucuguuuggaaugcaagacaacuggauuacauguucaggauauacagggaguuccagaccagccugaacuacuuaguaaaacggucucaaaauaagugaaagucuuugccuggcauacauacgaccuucagcuaaguuccuagcauugcuccugcaauucuagugccccauaauugggcacauuacugaauugugacagugauagaaagugagcaggugcuuuugaaaagauagacuuguucaguacagaccaucacagucuucaauuuaucaggaauacaaaaugucugaaaaggcaauaauaauacaccugugucuacagaaagcaaaaauaauaaacuucuacaaggggugaauacuuguguaguacccauaugagaagacugugguauaauuauaauaucuacaaaauuuggaggaaaaaaguauacuguaucaaguuguacauucucuaugaaaccaauagcaggcauucuugagccugcagcaauuccaguguaguaacaguuggcacuggcacaacuaguugcugaguucuggacggugacaugugacagcagugagaacaccucugauaaaaggacuggugaugaacuuggaguccacuuucauauagacccaagaugugacaagggaacaauuacaaacaccaaauaaaaguaagaaagucgagugugagcaucgugcacauauggauuuccauauuucucccagcaaaaacaugcugccuauaauucaaguacagaaaacaaaacaauguuuuugauaauuuucucuaucuucaaaaaggaucauuuauuuagagaaagaucauucuaaauauuuaacuucuuuagauuaauuucauuuucuuuuuucuuauaaguucaaagaauuagaauucacaguguuaaaucuuugaaauuguaugaccaguguaaugucaauucuuuaaaacuguaacaaagugguuaagagucagaauucuuaauucaguuugcuagaggcacacaugcuacugaccugucugcauucaucugcaaaaugcaaagaaguucgucacuuuccauguaaagcucuugccacgguuugcacacucucgugugugcguucacacacacauguguaccaugcauuggaugugggggucagaggacgauuugcaagagucauuucuccucuuccauuaugcaggucucuggucuuggcagcaaguacuuuacuuacugagccauuuugcuuuuccucuauauguaguuguuguuauauaauauuuuugacguuugccauaguuaucuuuuaucuccuguuguucauaguuauagagcuguauuagucaggguucucuagagucacagaacuuauggauagucucuagauaguaaaggaauuuauugaugacuuacagucugcagcccaauucccaacaaugguucagucgcagcugugaauggaaguccaaggaucuagcaguuagucucagacagcaagcaggcgaaggagcaagagcaagacucccuucuucuaauguccuuauauugucuccagcagaagguguagcccagauuaaagguguguucuaccacaccuuuaaucccggaugaccuugaacucggagauuuaaucuucuggaauccauagccacuaugccucaagaucucuauaccacuauaccaagauccauaucagaaucuucuaucuccaggccucuagauaagggucacuggugagccuuccaauucuggauuguaguucauuccaaauauagucaaguugauaaccaggaauagccacuacaagagcuuaccaaauguuuguucuuaccaaauguuaaucgugauuauuuugcaguagugagcuuuggguuguugccuccuuuauacagaucuuuauugguugaauuuuuuucuucacaacaauaauacaaagcccuuucuuuaaaaucuaaaugauuuuaauuuucuuaguccuuuuuugcaucugaggucacaguuuccaacccuaaagaucuguauuuuuuaaaugguccucacauaauucucaugauauacggggcuucaaaagcucuugaaauagauaacucucucccaucuaagcaagcauguuguucauaauuaauguauaacguggcugaaugagucuuccagucuagucuacugcaugcaguaugaagaaucugggagguggacaugcucuuaucagaaauccaacugggcuuuggggauacauuccaccuucacacaaugacugcuuuauugcaggaacaggaaagaaauuaggaguucuugaaauaggaaggacuuacaacauggaggggccuucauacacucugacuggggugugagaacaguaaguguggaugcaucagacagcgucccaaaguguuuuaaaauuagaaacacauuauaaaacaccgaguguuucuuugcaucucuccuggaaagaugccaacuuugaguuuugcuuaguguuacugccgccucagcuguuuuucuaaaucaguauagucagccuucuauauccauucauucauauccauaaagcuauuggagaaguguauguguaauaaacauauauagucauuuucuuugucuuuuuuuuucuaagcaauacaguauaaaaucuauaaaagcaucauuuauauuguauacaauauuauggguucuuuaaauauccugagcauauguaggagacuuguuauauaccguuccauuuucuauagacgauuuggccaucuguggacuugcuuauucacgaggagcccuaggaccaauuugccaccgagagugaagaacaaccuaacuguccagaguagagcugugccaaguaccuggcuccuggcuccugacuacgcucuucuuccccucgggaguuaucacuaucucacuauuuuauuacuaccuucacagucuguuauacuuuguccaucuuuucucauuugcauugaugacaaguauuggugaacccagugaagcaguccauaaauacagugcuagagcuuucucagguuugugguugugauacuggugauuauuggcuuuugccaaucaucuucuaaguucuucuuccugacucccuacaugcauguuguccuuucuguugaaugaauggugauugcuugcaaacgaagaauguaacagaugaaacauugccacuucuuaagcagguagacaggagugcacaucucugcuuuguaauugugcuaaccauuuaugugacaugggaagaugugagauguuagaggcagauaccuuucuaucuugucuuuacauuccuuauacugccuaauauagcuauacuauauuguauuggaaauagugucauggaaaagucuauauuaccuguugacuuuuaauuuagugugugugugugugugcgcgcacguguagaugauguaugaaugcagaccaggaaaggccaucagaccccucagucagaauuauaggcgcuuauggucaaaauugccagcuuguuggugggaaauugguucuagggcuccuccagaauccacagauggccaaauccuuuauaggaaauggaaagguacuugcauauaacaaguuucaugggugcuaagugucuacacuuugaucuucauaaugaacuauuuccccagcuugacuuuuuauacuuucuguuuucuuguuuguaaaaugcacauuaugagaauggaaagugcacuagcauauggcaggugcuuagcauuuuuggaacuucuccuagagaaguauguauauacuuaaggccacaucauacggguuuauaacugccaugugguugauuguuaacaaacuguuaaaaagagaauaacuugguugugaaguagucagcaaguauucuuugagcccccacuguuccaggcaccauacugaaucugaugacagacagacgcacuggggcuuagugagccaguguguuagcagugagagccuugaacauccagagucuacguccagaauugcacaaaacagggauuuggacuaggagcuggcaaacuucuauuaaagggcuaggugaagcuuuguuggacaaguuacuucuguuguaguuauucagcucugauuuagaaccagguacagucaucauacacaggaauggacauggguguucguaaauaaaacuacauuugcaaaaccaagaaccuacaucccagaaguucacugacucugcccacucucuucccaccccuggcuagguggcauguguauacacacacauacacacauacauacacacauacacauacauacacagauauuuauaaaacuguugauguuauuauccguucauggcacacagaccaaguguaauuauauuucuauugacauagggggcugcauggcuuaguuuaccuccauggugugggguuuucaccuuaugcugcucaguuugucugugcaaacuccgucuccuugucaugcugcuccaggucaugucacgguguuucuucaggacagccagcuguucuggagucuucucucagaaguacagauccucuucagacuucucucccuacccauaggccccaccugcuucucagguggagcuggagcccgugucaggccccccaacgcagagggagaugcgacuuugacgcuuuuaaagaccagagacagucuguagcugacaaagccugaagccuuuuaguucuaguucuugucagagcuugcucacuccacauugaagaauagaguaaguagugauuggcacagaagugaaaacacuagaguugacagccaggaauggaacuuguccuggcaaacaagcuuggcucauggaggaauccugaugagagguaggucccaggcucugggccaauaauagggaguccaucuuccauuugcuuguaauuguccacagagggccauuagaacaacacaaagaguuaaacuuacaaaugaggagaagugacuacuauuagauaaauugucuuacagaagggauuaacuuccacagggaauuaaaccucagaauacuucuucgugauaaugugaucacuuaguaauuuuauaaccagguacuaauuauaaaauuauuuguuuuauuauuaauuauuuuauaauuauuacaauuuuucuuuuuuuacagaaauacauucccaggaaauggccucuaaaucuuggcugaauuuuuuagucuuccucuguggaucagcaauaggguuuuuuuuauguucucaacucuugaguauuuuguugcgagaagaggcugccauucagccuaacaugcuucacaaugacccucaugcaaggcauucagaugacaauggacacagucaccucaaaggacagaugaacuucaaugcagauuccagccaacauaaagguaggcucuguguuacagaaggauuuacuuguaagaaaugugucuuguucauauuucacggccaguacgagguaacuaauaagugaaagugagagaaaaugagaaaaucguguucugggaguggggagaagaaaaaggaaaaagcuuagacauuagagagugggaugaguaauuuuuagcauuacccacaucuugugauccauaaagguaacaaauaucuaucaaauauaugugcauacagugagaggaucagucauagcccagcuguggggauaaagcugucuugucucccuccauguacuauaccaguuuuugcuguugguccagggugugaugugucuguguggcuaagauugaucccauaguuccagaagcagaggcugcuuccucccugacugcagagugcagcucuucuggacucaguuccuggugcuccauggcuuggaaagucuuucaugccuuuccccccuuuucuucuguucucuuccagucaguuaacuacuuaacuguaccucauuggucaucuuucacaggaccaagguuacaacagcuaguugaccauuacauuuaaaaguguuguacccuaggauuagugagagcucucuuaccaauuguugcuuauagauuauaucaucugauuuaguaagcuggaaucaggaauaaaauacuaauuugcaaaguaauuuuguauagauagaaaaauagagaugcagggcuuauauauaguccaaagcugagugcuuucuaaugauuuauagaaguauagguaggccucuagcaauugaaaauaaagaauguuccuucgcuauauauauuuuuaaaagccuugguauaugaccacacauuuaugacauaugaauaguacuaauuggauuugaguuauuaaugacaauaaaaacacaaaagaggagccagucaguggugggacauacaguuaaucccagcacgcagaaggcugaggcaggcggaucucugugaguuugaggccaaccuggucuacagagcaaguuccaggacagcuaggaauacacaauguaguccugcuuuuguggaaaagagggcauguaguuaugaaguugggacaagagagguuuaucacuaggggggauuggaagaacauagugaugaauagggaugaccaguguacauuauauaaauguauacaacuuucagagaagaaaaguauguuuuuaaaaagcacuggucuagaucuuuuaguuguaccuuccucuaaaccagugcuguucacauugugcuguucacauugugcuguucacauugugcuguucacauugugcuguucacauugugcuguucacauugugcuguucacauugugcuguucacauugugggccugauagcuugagaauuguuuuuacccaggugagcugcuuuugaccagguuucagguccuaagcuuacuauuguguuuaggagccauuuucaucaaacccgguugguauuguacuuuauauucugacacaagaggugcuccuauuucuuuagaaacugguagcuuacagaagaaacacuguuguagauaaucucagaauccaaccucuacccacuagcucgguacuguuucuaacuccugggcuugaguuuggagugagguguauaguacugucccagcaugcucaauucuacauuaacuccuuugcuuugaacugaaacugauguuauugugaaagucuucaagaacaccuuaggguauuuguacaaauucauaacaguuggcucauagacuucaaaaauaaugaacugacuugagcagcaugguuuucuuguuguguuuucccuuuuauucuucugucuuagaaacauauucacagcagugagaaauucacagggauacugggaaauacuacuuucuuuguagucuuaaguugcaaggagagacaaugggaggugguaugugagucugaacugcuaggccugagguggggccugcuauccaccucacugcuaacggacuucccagaugcuguugauacucucaauccauucagguaguaagcacuuaggaggagcuagugauguuucagagaucuguggguaaaauugacaggaaauuagagugucaggucacauuagcuugugcccauuuaucaaagucauuaauaaugauggguaaauagagucuuaaauuauuuaugaaaaguuuuuuuugaugugauauauuuggguuuuacaucuauguaaagguaacuuuuaaaaauguuuguuugauagaugagaacauagacguugcugagaaccucuaucagaaaguuaaaauucuuuguuggguuaugacaaguccucaaaaucuagagaaaaaggccaaacaugucaaagcuacgugggcccagcguuguaauaaaguguuauuuaugaguucggaagaaaaucaagacuucccuacugugggauugaaaaccaaagaaggcagagagcaacuauauuggaaaacaauuaaagcuuuccaguauguacaugaccauuauuuagaagaugcugacugguuuaugaaagcagaugacgacacauacgucauuguggacaaccugagauggcuucuaucaaaguauaacccugaacaacccauuuacuuugggcgaagauuuaagcccuaugugaagcagggauacaugagcggaggagcgggcuauguccuaagcaaggaagccuugagaagauuuguuaaugcauuuaaaacagaaaaguguacacauaguuccuccaucgaagacuuagcucugggaaggugcauggaaauuauaaauguagaagcuggagauuccagagauaccauugggaaagaaaccuuccauccauuuguaccagaacaccacuuaaucaaagguuaucuaccaaaaacauuuugguacuggaauuacaacuauuauccucccauagagguaagucuagaaguuauuaguauuauauaaauacuugggacugacuuauguuuaccugaauuuucuuaaaaggcuaguuaauauguacguuucguuaguaccauaacccaagcuuuuuuauguauguacugacaguguaacacagcagaugagaacagaggccccagccagucauucaguagcuagcuauugagaccucuguaggccagccauuagcauacugucacuggcagauaaaaguuaauacaggcaucuuaguuuucuuaugcucucuauaaggaggcacaaggaaaauaggcauacuuauaaagaaaugacuugagagaaugacaggugcucuaaaccugugggucaugacuccuuuggcaaaccucuuaacugcaaaaauauuuacauuauaauucauaacuagcaaaacuacauuuaccaacuagcaaccaaaauaauuuuaggcuuaggaaucaccacagugugguaaaagucuaauuaagggugaagucuaccauugaccgguagccucugaggcucggugcguaguggaagaaacccaucaguaguuagacuucuccuucuuuggccuugucuggggaauucuaagccccaacacaugccucuacugagaaauagcacgaagccucaguuagauuauagaaucaacauccugucucccaauacaaacccgcugagguagcaccugagauuccugaaaugcuucuccaugguaaucaggccuucaguagccuaagccuucagccuguccuggauguuucuacccaccguccccuaaaacuuuauaagccuugaaucacccaaagugauauggcugguccagguguguguuauucaccauacauacucacaggacuuccaaacuccccuccccugguuaggcuuugcccauguggacuguaucagccaaugaucuucgagggcagggagaaccacacacacuacaacauuaggaacuguacuaaagaauugggcauuaggaaggagaaccacuguucuaaagaaaaccaagaagacagugugacuuuaggugggguagucugccauggauuugcugauuaaggaagugacauugaacaauuuugggugaggcuagagaucuaugugaagaucuagacugaguuuucuaguuaucagggaaaaaauaagguucagaaagacaagauucaaauacuguucuuccauuuuguaguuggaugaucuuaaaauacgagaucuggcuuaucuuugagccucaguuucuccauauguaaaaugggugccaucugucucucucauuuguaauaacacuguaguauagcccaggacaguauuuaaugacaagcuugucucuaguucauaucuuaauguacauuaaaucagaacugagagaguugcauuaucuauaaacuaucucaaaaguauauaacuuucccaaguauaaaacuauugucacauuugccucagauauuuucagaauaaaagugugauagacaguuaaggcccaugugcccucuuaucuuuuuccucuaaccacuacuaccaggaauuaaauguuauucauuaacauugcaagcuuuuauauuuuccugcaaguugauaugugcauaaauaagucagcauuguuucuuagauuuuaagaucaaauuauacauuagacaucuuacaaauuucuauguuuauacauugaauuuuauuagcauugauauauuucucugcuuuguucuaagugauaauuuaauauaugaauauucuguaauuaauucauuuugcugcugauucgagaaaaucuauaugccugcuauaguaaacuacucacaggauuauaaaacauagcuucucagacucuguuacugauuagugaugcuuuuaggcaaguuacuaguucuuuaugccaccuuuuucuggcccuaacauacuacuaauacacuuuagggcacuacuccaagcuagugcaucauuuucugucuauuauaagaagauuuugauguuuuuucauaaguucugaaccccuuaccauauaaaauauauucaaguucaucauuguaaaucauguaaugcauauacccagauacauauaauauuuuauaaagaguguaugauaucccagacauguacaacaguagcaaaaauaugcuugccauuuuauuagcaguauccuuccuucuuuuuaagagugcuuuauaaaaaggguguauuuagcaauaugccuuauaugaauaaaauagauauaaugucuucgacuugaaucauaguggcuuuuaaauggauggcaaaauuuuguugcccuuauaaaaacauauuccaauagguugaagauucuaaaaauaaaaguacugaaguugcauaaaucuuuuaaaauuacccacucuuuaucagaaaaaugaaaccaaaauuccauuauuaucauucaauaauucuuuucuuugcaguaugaauuacugucuuuaaagaguuucuaaauauacauauuuucucuguaaucaucacugagaauauagaucuuggucuuguuuuggagucuuuuguguaauuguuuuguuuugauuguuguuguucuuugugagacaagaggcugcccuugaaccuccaaugaucaucuaauuucugagugccaugauuccaggcuauggcacuacaccugguuacaaaacuguuuagcuagcaaguuaggguauaagauagucagaaugaucaaaauuguguagcucaggaugacaaagucuaauuuauucuucauuucagauaauuuuuugcauuaauuuuagucugaaacaaugcauaguuuagauggaaauuuuuccaaaucgugguaguuucaauucucagacucuugauuguguaccuagagcaucaccuauaggaaggucagggucugggauuguaauucuguguggauuuuaauucucuuuggauuuggcccacauuguuuugaaccuuucaccuuuaaaauguuuuuaagcugauaaggauguauugaucuccuucaaguguuuuggcaauugccgugucuccuucuuuuguauauagcucauuaguuuagugaaaaugauaucuuuacccaagaaguuuuuaggguccuuggugaaauuuuacaguuucccucagaucauuguauguuauuguucauuguuuaugacuuaauuauuuuacuuuguuugugugaguguuuugccuguguguaugccugguaccucgagaagaucagaagaggguauuggauccccauacugaaguuacagaugguugugaaccaccauguauauaggugcuuggaccuaaaucccggguccucugccagaaaacaagugcucuuaaugcugggccaucuuuccguauccagaugguuacgucucaucuuaaauguuccccuccauagucaguauauuugguacuaucuugcuugggcuuuuaaucuucuuacuuaacuggcauauaugagaauauagauaguuuguuuucaguacugaaucuaaggucucauacaugcaaaagugcuguaucccagcccuuugagaacuguuaaauguaacuuugcaucugauaguuacaacaguuguaacagucagacuuguuuauaucugaggauuuucuuuugacuugaaauccucuguuaauuuauagucacccacaaagagcugcuuuguuuucuuuccaacaacuauaggucuuguuuagugaauguauuuuauuuauacaagacauuuaagaacaauauuuuaggcaucuaccaaaaauggcagacagauaaagccuuauucuuuuaauagcuuccccuuuacuuugaagaaaucaaaauguuaacaugguuaagcuccaguugcaguugcuguggcaguuccagguuugguuuuagcuucuuagggacuggaagaacuguuggcuucuuacaccaucugauggguuagauaccuccgccuucuccucaagcuuugacacuucaguauuuuaaagcuagugugacuaugugacaugugggcugugugccacuuauuaacaguguccccuucuguguuuucuaggguccuggaugcuguucugauauugcaguuucuuuucacuauguugaugggacaacuauguaugaauuagaauaccucguuuaucaucuucguccauaugguuauuuauauagauaucaaccugccuuaccugagaauauacugaaagaaauuaaucaaguaaacagaaaggaagauacaaaaauaaaauuaggcaaccccugaaagcagaacauaaguggucuacauugcacugaaggacucuugccuuucuacggaacccugaaaucccagugaggaacucaccugaagugaacauuccauauagaaaucuuucaaauggaugacuauaaacugaagcauuuaaagagcugugaaguuugcuaaaacguguuuugauacaguaauauauaaauauaaauaaauauauaugaagaauuuguguuuuuaaauggugacagaagagcuagaaagacucuguuucugacuguucccaacaguguauguuguuaucacuacaguuggagugguuaguuuauaaucaccuucugcaccacaccaguuagaacacaaugcugaacagaucugccuuaaagaaagaaagaaagaacuguugcucaguguuguuucucagcugauauguguaugcuacaaaccagccuuccaguugccgaaugaaaacuuuccugugauuauauuauuuauaauuggcaguguuuccucaagaagaauaagaagggcacuuaccccaaagugcaguaauuaaccacauuuccaauuauuccgagccuugacuccauuagauacuuaguucuaaagauaaucaacccgauaccaaguccccauuguccccuuuccaaauguuugacccugaauaccauuuuucacuauuaaugcuaauuuacucaaagcauuggcagcauucuguaaaucaugcauuuucaaauauguuguuccccgauucacccauuguuaauuguagguaacaauuaaauuuaaugcuguuuggacaagcuuuucuuguauuugguaccucucucaggaauuauuauuuagacgucuuuaucaacuauauaauuguuccuuuuauuuuccauccuguggagaugagacuuguuugugccuuucauagcuuguuuaaagcacuuuuaaaauuaauuuuuaugucugauguggcagguaacacuggcaaguauuuuugaaugcagcuuuuggccagaauuaauauaaagcacgauccaguaaaggguacuuaaacaaucuaaaaugucauauaauuaacagcauauuuccugcugacuucuuauuugaggauaaccuugccagcaguaauuccaacagaacagaaccccauucagacugcagaagcaaccuguaucacucuaaugaaacuggcuguuuaaauagaguuucugaaaggauagaaccuuaccuuguuuuggucaucaucaauacugaauguagaacagaauauuuuacagauuucccauaaaauuauuuuuaauuguuaaugauuuauauuucauuaugcuaauuuugccugauuaguacaccguugagucuauagcuuggcuaaauaauaaauauaaauaauuuauacuuacugugccaaaaccacaaccuuuauagaugauauacuugacaggauguuuguuucauuggcuaguauggaucacucugucccuguaaugaaaauacaaagccaaauuuacaaauuuaauuugguuuagguucuuacgguggcgccaucuaccaacauccuaggcuuccuagucuguguuguacacagcucuuuaccgugguuuggauaugaauuugucucuauuccauaugugcuucucuucucuacuagcagaguaaaugauuuauccuagucauccaaaacccuuaacauuuacucauaggaaaugagcgcugcagugaagccgggcgcuaaagccaagcagccuggcuuuuaaguuccuccuccauuacuguucauguaaccuugaacuuaauuucucugugccuccauuuccucaacuauaaauuaggaauaaugauacuaccuaccucacaagauuuuaaugaggauuauagaaaugaauauacauaagguuauuagagcacugucuggcucagaaaagggcaugauuuuaaguauaagguuuuauucuguuaccuuggaguauaaauaauuuaauguagauaaaugaaauuaucaaaucagaucugaaggaaaugucuugcacauuuccuauaauacggaauaugugguauucaucuagugccugcuguaugccagauauugcucuuuaccuguacacuuguguuaauccucauaaauuggguguuagucccauacuauaggugaggagacugaggcuauucaaguaauguuuccacugucacaaagcuaguaaguaagaaggcugggaucuauaaucaaaaccuguguuuuguuuguauuauuguuagccuuaggguuagucguaugaauauaugaauauguggaauaauuacacacauguaugaauaguacguaacuucuggaacuacuggccaguaauagucaaaauuggucaaacagcuaaaugggucuguuuauuguuaaguugugacucuuguacuccagcuauaaguuuguugagguggagggcucaagguuggauuuuuagcauggggcccuagaguaugcauucuucccagauaccuucuagugauuaaaguagcauugcugagagcuuguuggagcuugugcuugucuucaccccagccuggaccugugucagaaacuccaagacagggccuagcacuuugguuugaaaaaauaauuuuaccaauccucugcugagaaccauugccgguuuaccuacaugauuuuggugcaaaucgucuuuggaacacacucaggauuucugcccaggagagaggcauuuuucaaagacucugaaacauguuuuaaauuagugugguccaggaucauacuauauuaaaaauaaaaucuuguaaaguuuaaagggucugugcaucauugguuuuggcaaaauucuuuacuucucuauaauggcuauuaccaagaccuuaaaguguguaauucuacacguuuauucauuucacacugaguagcaaguguucagugaguacuaauauguacauaugaauucaauaaagcauauguaaaugaauaucaugaaaauuuccacuaguuacugaaauuugcaauagaaauggaaaaauacugcuuuacaauaugccaaguauuuucugcuaguuuauacuaucaguuuugucaccuauccuaugaccuaaugaagcaaaaaaauucucccaaauauuugguagagcacauuaaacaagauuuuauggugaaaugauuacuucacuaucuuaaagaucucugucaugaguaauuguagugugguuucaagucaagacuuuauuuuaauaaagucuuauguuaucuauuaauauguuuguguuuuucuacuggggaguucauagauacaaagcagguuuuugccccagaguuuugacuguuugaacauaucuaaauuucagagaucaguuuguuacuauaaaaugauucaaaaauaaaucauugacuacuucauucuuugucgugagggaggugcuugggauugagcacggcaguguuugcugacugguuguuuucugaguuguuucuugagguuugauuuuugcuuuguuuuguuucuacacccuuagccuggcaaacuguauugcuagacugaggcccuguuacacuugaaagacauccccacuugguuugucagauccuaccuggcugcgcucuugcacucucgguuucauucugguuuugauaguugcuuuaugcuuagcuucaagcuacucggagugcugucuucuugcaguugauuugggugaucagaauguuuaucauuuaugaucguuuuaaaucuaccacagguuucccaugagacuaaauauccaacaauagucggcuugcuuucaggcuacuugcccuaauugaauguacaaccuaaaacaauucuacaucucuaauuaagaaagcaaaguuauuuucccuccucuuaaaagcaaaaggcaaacacauugccuucauuucuauuguuuuguauuaggacuuacaaaaacaugagaaauaugggagacaagcugugguauauguuacacuaauguaaccucuauugguuaaagauggcuuacaguuacauaucagagcuauaucaaaaaucuucccaccgguggaaaugagaacuuuguacagauucucuuuagagaagcaacuggaaaagcggcguccgggcuaaauguacuuaguucaucucccuuaccucuuuugagucuucaguuacauuaauuaaguuugaguaacuuugcagggcgcuauaaauuaaugaucuacaugaaguguauuauuagagggaaacuaaucuuacugcuaagcaguguguuguauuauacagugaauguuuguguuuuggaauuuaaaaauaauuuaaaguaauagugucaaugaaggguuuaaaaugucuggugacuugcuuauuuuaagugaucaccauuaagucagaaaaaauguauuuuuaaauguuuuuuaaagugccuuuugagaauuuuuaaacaauugauucaaacaacuacauaaaauaaauuaccauguucaaaaauugcu

SEQ ID NO: 2843 - RNA, 2513 nt, Mus musculus
aauguccccaaaauuaacggaguugaagaugcauuuagaaaaauuuguagaaaugagggugacugucauggagccagaaagaauaaagaaguugucaauaguacuaacuaacauggaccucacuggguuuugauuuuaaacuacuagaaagguucgcugacauuuugacucucucggaccuugggauuuuuaguuuuuaggaacagacacugaaaaaaaguuuucagagauggacuggcuguguguaugaaguauaacacagaggucugauauucagcaaauacuaucuauuguuauuauagugacucagggaccaacagauggagaagguggccacagcaucccuuuccagguuaucuucucucgaugggaacaaacaaaauccaucaaggaauccuagggcucauaaacagaggcugagagagcauccugguggccugugaccaaagacuguaaaggacaugcugacuaagcagaugcuuaaacuacucugcuaggaguuucuguuugaagacaaugccauuaaaaaucauaacaugaauuuaacucuaguguaagaaauuguacaaguguaagcauguaaguuaauuaccuuuaaugccgaagacacaauuaacucacauaguaacaucugguaggccuauuugcuuuuucaaauuaggauaauuagaacugacagagugccuucauucuaauuucccauucuuaucgcccauagauuauuuuugaguucgcuuuuuuuguuguagcaggguuguuuuuuuuucucuuuucacuaacaucacaaauuuguuucauguuaaaugaccguaguuguaaucaucauuguaacacuguuaaaaauagugauuuauguuacguugaaacugcauuauaaguaucauauaauauucaugaaacaggaugaaaaaugaguuuccugaagaauuucugauuaauucaaucuacuauuucuagcucuucaaacaaggcccacaauacaauagacaaguuauugacuugaaagagugaaugagcuugccugucgcugccggaugcuucucucagguggugcauaaaaagauauuucuuggaagauggccacuaugcaguugcauaggacagcuucccugaucucugugucaaaauucugaaagaagauaaaaauuguccagguucuucacagcuagugaaguggaugcuaggaugcuaggaugcuuuacagaagaaauaucuaaggaugaucauucuagcuguauacaccaauccaggagauccucagacaauuucaggauauuaccaguuuaaauucaaguacaccaaaaauggaccaaucauggacuuuauaagcaaaaaucaaaacaauaaaucuaguacaacaucugcugacagcaagaaagcaagcauuccccucauucggaagauuuaugucuuaaugcaaaaucuaggaccauuaccuaaagcuguuugucugaccaggaaacuuuuuuacuaugaugaaguuacacccccaaauuaccaaccaccagguuuuaaggauggugacugugaaggaguaauauuugaugggaacccuacauacuuaaaugugggagaagucccaacaccuuuucacacccucagauuaaaagugaccacugagaaggaacgaauggaaaauauugauucaaccauacuaaaaccaaaagaaucaagaacacaauuugaaaaaauucuaagggacaaagaugauguagaagaugaaaaaucauaauaauuuugacauuaaaacuaaaaugaacgaacagaaugaaaacucuggagcuucugaaaucaaagaaccaaauuuagauuguaaggaagaagaaacuaugcaauucaaaaagagccaaaguccuucaauuucucauugucagguugaacaguuagucaguaaaacaucugaacuugaugugucugaaagcaaaacaagaagcggaaaaaucuuucagaguaaaaugguaaauggaaauaaucaacaaggacaaacgucuaaagaaaauuggaagagaggucuucgucaauuugggaaaacaguccuucacgucuuggaaucuagucaagagucagugcugaagaaaaggagaguuagugaaccaaaggaacauaccuaaaaauuauuuuucuuaugcaaauuugcaguucucaacauuuaaacuaacaugcuguauuauuugaaggugugccuucuguaccucugaaaauuauuuuguaguucauaguuauuaaacuaauaaaaguuuuagcuauuauauuguguuuaccugagauaaauccaagggaacuuuugacuaaacaaaaauacaaaugucauugauucugcucauauccacugaauacaaccugccuucuauuuuaaagaaagcuuuuuuaaaaaaauguguuaaguuuuaagacccucuaaaaccauuucugaaguguuuauucugacuuuaaaauucuguaaggauacacuuuuuacuuguuaaaacuguaccauuuacuugaugcuauuaaaacaauguuugcuauuuuga

SEQ ID NO: 2844 - RNA, 19529 nt, Mus musculus
ccuagccccuccuuccuggggcgaacugcgcaagcgcacgcgcaggcucucccgguacggagcucagcugaugcaguuguugugcuaccccucccccgcagcucucccggcugcacucuaccggcgcucggcccggccccgggaccgggacgcugugacccuguccugcggcccgcacgcaccggagcaucccgggaccgcgcagcacuccgcgugcgggugagcgacccgggccguggggcccacguccccugcccgagcggugagggaggccgcggcgagccgggugcgggguugucaccgcgggggccuuggcuucgcucccgggguggcucgggcggcgccagggcccuugaucugagcggccgaguagcucuggggcuugacaguuguaguugcaaggugacucggauguugauuucuuccggggguuuguuugccugugaugcccuuugaaaagcgcucguuuccgucucccuugagccccucagaacuaaccccaggucugcacacaaacaggugacacaucucaguugcaugcgcugcugaauuuaucuuuuucccaguuucuagagcaucugagaaccguguugaguucacaagaccgcgguauaaacauugagagcccggggaggagacgaaggggaucuaccacucccuuuaaaaaccucaaguaaguuuccaaaaugacagggguuacacuugucaauagccucaagaaaagcuaagcaagaaggcuaggauucaagugacugcuuaaucugguguguacccaaacccaccuucagcagaauaugucaagguuacugugggucugaguaaggcagccagcggagaccagaaccacuuagcugucccuagccuuuugccauaaaggcucccauuugugggacacaguuuucaccccugugaugacaccacguguugucuagugucagcugauucuaaaccacccuguguacuccaaagcuuccaaggucacaguguaaggagccgguacugauuacaauucaccccugugcaccuguggcugccaaguguuggcuuggcucugacucgcugucauugagccacaguaagauacuguguguguguaagucacaaucacugauauuucugagcuaugguacacaguguguacacagaacuucugaaaguauauuuauucauuuuuuuuuacuccuuuucuauaugacucaaguuuuuaaauuuaauauugcugucuacacagugagugaauucaacaaguagcauucagauuuugaaaagcagauaugaauuuccuucaucuggggugaccugaaucacuuaguaucauuuuauuuuuuaaugaaaaauauuaaauuaaaaguaguaucugugauuguguaguucguauuuugaaucugauaagugauggauaaccgcagggagaauggaauuguaccauuuaaaauuuuuguuugcuuuuucuauuauuuugucucucagaaaaccggcauguuguauuauguggcuuuucauguucuuuucagucauguacuucuaggguuuuauugacaacuaaaggaguaugaauuuaagugagugaaaugagucacuuugaaguuagcuggugauauacauaucuguuguaacaggccaacaaguucaccugcagugccaacugguuuauaguuaaaauauguuuuucucuacaaaaaacuaaaaccauauuucuguuuugaacaugcuaagaaagccuagcaucuccauugacacuguaaacuuuugccaacuguuaccauuuuaaacauuguucacauuacaagucuuacaggauuugguuucauaauguucuguuagaaaaguacuuucugaaugcuacaaaugguuuccuuguaucagacauuacuuugguugaacauaauuuuaauccuacaaguaauuugcauuugccuaacccuguaaauauaucccauagggucugagacucuuuuuuuccacauggaauuuacugucagauuuuucuuuuucauuagacaugggaaagucucuuucucacuuaccuuugcauucaaauaaagaagauggcuaugauggcguuacaucgacagacaauaugagaaauggauugguuagcagugaagugcacaacgaagacggaagaaauggagaugucucucaguucccauauguggaauuuacuggaagagauagugucacuugucccacuugccaaggaacaggaagaauuccuagggguacguguuguagcauuggcuguccucuuaaaggauuccaaacauuugcucaaacaauguaaaaucuauagucuuaagcacuucuauuuucagagauucaaaguuuaccaguuuuguuuagucagaaacacaaaagcaaacaauuaguaccauuccuaaagcaguaauagaagugacuuaagcacauauaacuuuuuuuugucuugcuugucugcuguuauagcuccuaugcaccuaugcaccccugaggauuuuagucauuuuuaugucauuggaagccauaucacagucauuuugccacaguggauguuagcagcuaaguuguucaguaacucauuaucuaaacaauaaguugcuuccaccucaauauuucuaaaagaaaaucuauaguguaugaagaaaagcaagaggggaaaaugagccugagguuugccauggagaagacaggaggaagaguccuaucccugcuauuugucgggcgcuagaauugcucucacagaaaggaaaaauagugagguuauguuguacuccucuccuucuguaauugguagaagucaauaggugacccuggagagacccuaaagaaggacaaagugacugcaugggaaacucgagucucuagaaagugccuuggguuaagugggguuuguugcauaggcuacugaauggugguuuuaucuuucuggggguaggagcugcuuaagaauaguugaagaaauuaauacaccaacguggaagggugggaauaggauuucuguccaucuagccauguguuugagguguggccaggaggcuuuuugguggccugggcggggauuguggcaaguagauaaucaaggagcacugcaaagagguuguuguuguuuguuuuucuauccaacaauuuaaagaauaaacuaaccacuuauuaaaauaggcauaaaaaauugagugcacaugccagaagugagaugaagaacucaguuucagacauguguuugaggauguugguuuccaucaaagugaguuucuaauaggcaaguuguaagggucugaauucgagagcauaucuuagcuucugucacccauguaugguggcacuugaaguggaacuuaagacaggaaaguucugcucagcaauuuggguagaagacaaggaagagacuguagcgugacuucauugugaacucuggaacagggcagcguuggagggacaggagcagaagagggggcagcucgguggggaggcggaagucuuaauuguggaguccuagaagauaagcagagagggugcacagagaaagaggaagagccacugcuagugcugaugacacaugaaguuguguggggacugaggggugcccauugguuuggugauguggaggccauuccccaauggccucuuuaagaguacuuagaggggcuggagagauggcucaguggguaagagcacugacugcucuuccaaaggucaugaguucaaaucccagcaaccacaugguggcucacaaccauccuuaauaagaucugacgcccucuucugaugugucugaagacagcuccaguguacuuagauauaauaauaaauaaaucuuuaaaaaaaaaagaagaauuaaaaaaaagaguacuuugaguaguugcaagaacauguguagacagugucauagugaaacaaacaaacaaacaaaaaaauccuuuuaugagcucuuacaugcucaaaaggugugaguaauggaacaucuuauagggagaaaggcauuuugugcauuuugcucuaggacaugagggugagaggugaucucuuguaagauggaugaauaccagauguaugcaugcugacagaagugauccauagagagcguccugguaacagaggagauggguacuuaugggagcaaauagaugguacagagugcauaagugcagaacagugcccugcagagggcacagggagcuucuccaguagggauguagaagcagggagguagguagauacugcuaaaucaaacucuugaggcagagcaacugugaaauagagggcagauggggcuguuacacauaccagccaaagguguaagagccgguccuaugacaaaucucuaagucaccagcagcauugccaaauagcacuuaguggaaaaguuucugcugggccuaagggagcaagauauuucacaaugaaacucuagaaaaaugucuauauauuauuugcaugaacuuauucugugucuagaaaaguuggcaggauaacagaagcccaugggaagcacucuaggaacaaagagauuuuguuauuugcuugaucgguugguuucagaaacagaaugcaggggguguggccucaucgcuuccuccucaacauacaggaaaggaaugugagauacuuguaccccuucuuucuuuagugcuaugaguuaaaugaacuuaacucuuucuucccucugcuuucuguccuguaacuuaauguaggacaucugaaaacucuauucagggucuguuagggacauucucuccaugugcugcauuaugagccaagaaugaagauaaaagggggcgguccugagaacaugaggagugaugaguuuugaaauugucauuuuaggguguaaacuaggaaaugugaacuaggaaaugagugauugcaguugagaacagugagcuuuugaaagcuugggauuuagaguagccguuuugguccagcuauugaggaucaaugaaugggcagcaccaauguguuucuucuacccuuagugaacuuagucugaugaauggaaaacaguggaaaacuguagaugagagaagcacguguaaguuaaggucccccggaagccagggcuuuucagggguuuuuugguuuuuguuuuuuaaccagcagauuaaaggauaguagagcccucauuauaguauuuuuguuuaguaugaaaaaagugucuucucuaacacugaauaauuucugaagacaugaauaacaguuuacuaaagggcuaaggagagaaguauucugcuaguuuugaaacaaauuucuaauaaagugucacuauauuuuaguuauucaugucaaugcauuuuuaaaccugcaucuuuuacuuuuaggacaagaaaaccaacugguggcauugauuccauauagugaucagcgguuacggccaagaagaacguaugugauuauaagauuucuuccuuuauuguuguuuguauaguuuuacuuucaaacuuuauauaaguaauuacucuaguuaggacauuuaagaagaagaauaugucugguuguuaaguuaugccauccugaaugauaauagucauuagcagauauguggacauuuuaagagaagcaaagggagucuugaauguucuacucuaaagaagccaaaacucagcgcuccuggcaaauauuuuugagaauagcuuguuacaaugaaaagaacagagauugcagaaaacccacaguggccuugagaacgucauaaaaggcugaguauucaugugggucaaacaaaucuggaccgucccauuacuugaugguagaaccacaugagcaacaugaaucuacaguaaaguagaagaacgugaacucaggaaaaugcugaaaaaaugaaagacacacaaaaaagcauauaaaaacuuaaauauauauaaaauuuaaacuguagaaugcacagcaguagcuuaagugagacauugaaggguuuagaaaucaagcaacugauaggagucuaugagauccgauuucacaggcccuuaaaauaucuagaaaaauacuuguucuauaaaauuggaaauguacaauaaaaguaagauacccuagaaaauacaaggaaaguggauuaaacaggaggcacguaaacauggucuauguuagucagugcucuuuugcugugaagagacaccaugacuaugccacuucuuaugaaagaagaccuuccuuugauuguugcuggcuuacaguuucauuuucagggguguagucccuuaucagcauggcgggaacaucacagcauggagacaggcacugugguggaguagcugagaguucuacaucugaaucuacagagagcaggaagagagcacuaggccugacaugggcuuuuugaaaccucaaagcccaccccuagugacagaguucuccaacaaggccacaucuacuccaacaaggccacaccuccuaauccaucucaaauagagucauuucuuauucaaaccaucauacauacauaaugaaaagcuuugagcaaaguagcagaaaauaaagaaagcuaaacauguauguaacauucuguauuuucuaucaaaccacauaggagucaaucuuuuauugaaguuucgucuguugcuauguauuguaaugcuaaauccuauacaugaaggucuauacguacaagggacuucuacuguuuauaagcuuuuguuguucaaacccuauuccuugauuaaaaaaaaaaaaaacuauugguugaauaaaaaugucuauaagccaguuacuggagggauuagagguagguggguuuucagugaccugguuagagagagaggggaaagcaggaggaaggacaagagagagagaaagagagggagggaaggaaagacggagcgagagaaggagggagggagggggcagggacgcugccauaagaggagauggggaugagcgcauggccaggaaaaacagcaggugcacagcuggggaggcagccaggccugcaguuaggagaguagacuagcgguuacagcucaguaauugucaaagcgaaauaaaauaaccaugguccgagucucauuuauuuguaagcuagucagggguaagcuuaaauugguuaccaucuuuggcucaggaauuucaauuuugaaaaauauauauuaaagguaguuaucaaauauaguaagagcagccaggcauuaugguacacaccuguaaucccagcaccagaaaguagaugcaaaaaggucagaaguucaaggcucuaagcucagcucuaaguuuaaggucucucuaggcuuucuaagacccuguauccaguaacacaaagcaaaaaguguguguguacacaguuaaauaaauaaaaccaccuaauaacauauaggagaucuagcaauguuaagaucuuugaucacaaucauuuuuaaauuccuuuugugccuaugguguuuucugccuauugguauauuguaggcauaacaaaugggaguuguuguucauuggugacuuggggcucauagcuguaaagauuuaaggaaccccucagugaaagaguaggaagaagcugguuuguuccacccaccagcauggacucaguggugggauuuggugagauucuguucauuugcuuuaguucuuuuuagcaagccauuuucuuuuucuuaggaagcuagaauaacuagaaaaauuauuaggauauuuuaaacagauguuauaagguagauggaugcaguuaacuuaguuggggcauaggaaguuugaggggaggagagacugggcaaaaugacaggucaccaggaagggcaaggauggaggacucagaaugaaauaggccuuucacagagcgccauauguucacgugaccaagaaaucugaagccauagucuugaguguaacauuggagagcauacacauuucagaggcauuagauggauaguaaaugcagguuaguugucuuuuugucuuauaugugcccaauacugccacuugucucagguaaacagaacagcguuagguugaucaguguaaacaguaucuguaaaacugcgugcauuagugcuucgugacgagcacucaggguuuaucagggcagggagugaggcuauccagagcaaggccugcugcagugaauccagaugaaggggugaauucugggcuuguaaaggguucuaauuuaaaaucuggauugaaaaucacucauuauaaguaaugaaucaguucauuauaaguaauuguuucauuauaagucugagaucucauuuucuaaaauugacaauuaagcuucuaaagagauuauuuuaacccuuaucuaauagucuuagagugaauauuuuguaaacuuaaauguauuuucuuggggguauaugugguaaauuucaaaugaaaauaauuuccugaaauguuguucuauguaguuuuggaugacacauauguaaggauucuauuuuccuuucagaaagcuguaugugauggcgucuguguuugucugccugcuccugucuggauuggcuguguuuuuucuuuucccucgaucuauugaggugaaguacauuggaguaaaaucagccuaugucagcuacgacgcugaaaagcgaaccauauauuuaaauaucacgguaagugcguguuugcacugaaggccuugacaccauucuugccuugcucagccgcccaguggcucugcugagagaaugaaugcuugcuaaugaccccugcugcuguaguuuacaugacucugccuuggcgauuccacuaccaugucugcuucugccaaaaauggaaaggaagcuccguuuuuguacauugggaaucauuuagcauugaagaugucuuuuguaggaagaucaaguaaacauuuucugguaaaggggaaaaaugcuguccauuuacuuuucaacauuugauuccaaauagguaacaaggugcuagccguugacucaaaggaugugaugaguacaacacuuuugcuuucuaaccuuuuaugaaagaaaaauugucagucuuaacagacuuguacucgacucuauucaagauggaguuuauaugaugaccugauuguuuuaaugugaaaauggcuauggguuuacaacacaugugacuuugaaaaaaggauuauauauccuuccaacuuugaaacuucacagcucugcucccugcauuuacacacacauuagccuuuggcuguaaagaacauggugugcuaaccacuguauugggacggggagguguguaaccaccugugccaucacgguggcucacaccuucaaguucagagugugcuguggucucuugggaaguguucuuaagaguaugucauuuccuuuuaaauaacagugucaugaaacgagaaugccucuuuguauuuuaaacaaugaagcaaggauuaucacaauuuuagauauuuacucauaaucaaauuaaggaauauugaacuuuagguuagaaauaggauuucuguugagaugaagaguaggccucacuagaagauauugaaggaaaagacugacaaggucauaggucagaauuguauuauuccugccccuugagguaagugcugugcauuagugaguguuaauauugacugucagugugacaggaucuagaaccauccuggugacaagccucuggguaucgcugugggcauuagguugagguagaaugaccugccuuaacggugggcagucguguuuuaugaaaugaguuguugaacugaaccaacaauagagaaggcaaacuaagcagcagcauucaucaugcugugcuggcuaacugaggcuaugcauugugaccagccuccucaagugucugccagcgugccccacccccgccgucauggacuguaguucuuuaaacuauaguaaaugcuuuuuaucaaguauuuggucauaggaauguauaaaauaacuaauacuuccauuuauaguagcuaauuacguauggggauucccuggaccaaaccaaaccagaaacaagcucugggucuccugucccaugaguucuauuaucccaccuuguagaauuuucuucugcaguucuacagaagcaaucagcucaggucuuuuuaaacuaacucacuucugacacugaccaacugucagcagccuucagacuucacaguuuagaggcucugucccaacacccuccuccccacuuuccaugucaguuucagguucagacccccaaaacgucuaguagacuaucaguugggagucucaugaccugauccuauguuugcuuaacuucucugaacaacucauaaaacucaaaggagcaauauacuuacauucacugguuuguucaaagaggcuauuauaagggcuacaggcccacagauagaugaaaagguagaguaaaaggcagagggcagaggcuucuguccccgcggaacugaguguuccguccucccagcacagguuuucucuguggcauuggccccagccccuuuucagcucuuaugaagcauuagcugcaucagcaugacugaaggauagccaacugcagauagacaaaaauccugcucuaauguaaauaagcugagaguugucagccaggagccaaugugugucauagugccacaguacacucacuggcacugugcuacugaaauacucaaugucuaugacuagacccuugaaaaccccagaauacauaaugauuuugacucuucugugaaaacuuaauucucaacaauauauauaugcaauugcuaacaauguauauacaucccccuacuuauaaaccuuucuuuguuuuaucaagcagucucauucuuaugucugaaagauacacauaugcuccguacauuucagcugaguucacacuacauuuuucugcaugaaagacuuuuucauuggcuaauuuucaaagugauuugcucuaagaguugugaauguaaagcauauaaacauagcauauguguguguacugcuaugacuagaaggggcagggcagaagcuugaaaacagaagacgggcacugacagcucucccagaggcccugaguucaauucccagcaaccacaugguggcucacaaccaucuguaaugggaucugauacccucuucuggugugugugaagacagcaacagugugcucauacaaacaaacaaacaaacaaacagugugcucauauaaauaaauaaauaaacaaacaaaauacagcaacagugugcucauauaaacaaacaaacaauuaauuaauuaaaaaaaaagaaguagcagcaaccagcuggaaaccuggagccuuuuuaucucuucauauggauccaguauaaaucucuacaggcauguaagguaaaagccauuuuuuuuuuacauaggcugcuaaugccacucauuugguaguuguucuugccuaucaugcacaagggucugauuuagucccuauugucacacaaaaccuagcuucgugcuguaagccuguaauaggagcucuguagagcuggagaugggaaagguucaaggucauccuuagcuacauagugaggucaaagccugcaggauuguaugaaaucgugucugaaaaaaaaaaauggacuuucuuaaaaacaaaauguaaguacugaccuguuguugguagaggcauguauauaauacauaagaauuuaaauaaaaauuuaaaauguuuaguccaacuuuugcuaaaacuauaaaauauauguuuuaacauuuacuuuuccauauuuuccuguaguauauuuucugggucuuguuuucaauaauuugaaucauguucauuauacacauaguucucuauaaauguucuuuaacauuuuauuaauauuuucuuuucccaguaaaugagauauaguuccaaguaaaguccauuugguuuauaauucugaguucauauuuauguaccuauguaaacauaguguguauuuccugucucuguuuuuuugcagaacacacuaaauauaacaaauaauaacuauuauucuguugaaguugaaaacaucacugcucaaguccaguuuucaaaaaccgugauuggaaaggcucguuuaaacaacauaacuaacauuggcccacuugauaugaagcagguaagccuauucaggaguugagggggugaaauggguauucacccuguguaaugcagaauggagcggggucgggggccuccucaaagacuugacuuggaaaugugucccagaaaaguauaaaccagauuuauuaaaggaaagauuccuuuuuuuuuuuaaauuagauauuuucuuuauuuacaucaaauguuauccccuuuccugguuccccucugaaaaucccucauccucucccccuucccccugcucaccaacccacccacucacaaauccuggcccuggcauuccccuauacuggggaauagaaacuucauaggaccaagggccucuccucccauccgugaccgacuaggccauccucugcuacauaugcagcuagagccaggugucccaccauguguuuucuuugguuggugguuuagucccagggagcuuuggggguacugguuaguucauauuguuguuccuccuaugggacugcaaaucccuucagcuccuuggguccuuucucuagcuccuccauuggggacccugugcucuguccaguggauggcugugagcauccccuucuguauuugucaggcacuggcagagccucucaggaaacagcuuuaucaggcaaaagaaagauuucuaacuuugaaaauuuagacauagggguaacauguuugguguuuggauccuauccucuguuuauguguuuuucuugauaguuguuguuuuugcuuucagauugauuauacgguacccacaguuauugcagaggaaaugaguuacauguaguaaguuuuggauuuuaguaucuuuaccuuuuuguuuucuuaauuuuuauaagauuaucaauuaaaaggaccacauauugcaaugcuugcccuauucucuaaacaugcuuuucuuuauacagucuacagcauagauaacacagaugcauagauaagauagauagauaaagccaucaaauucaucuuuauuuccauaauuguguguauguaugugugugugugugugugugugugugugugagagagagagagagagagagagagagagagagagggagaaaacauuauauauuguuauuuaguuacuauauauucuuggugcuuuaauauaggaguacugaaauuucuaauguauaagaauacuuucccauggacuuguacuucuguauauguugcauuugugaagacacacacacacacgcauuuguucaaggcgggguugaaguugaauucuuccucuaucagucucuaccuuauucucuaaggcaggccaugugacuaaaaaucuagagcucauugauuuggugaggcuggcuggcaagcaagccucuaauagccuguuuccaacucuagucccaaguuucugagugcauccugccuugccuggcuuucugccugaaggcuuggcacccaaacgcaagcccucaugccuacaaagcaaguguuuucccgccgaagccaccccccuagcacgacuuuuaauagugucucgacaggcacaguaacauggcccagaaucccaggcauuacagaggcugagaugacgaagguuucugcggccaacauagggagauuucaucucauaggaaaaaacaaaaucacuauucagagucucuauuagguuuaauagaacuuuacauugauaauguaaugacagugcucuuucuauuuuaauuucuuuaacagugauuucuguacacugcucuccaucaaagugcacaacauaguacucaugaugcaguaaguauggccaugccugcaaagguagcacuugcuaagacugugcucauaaugucugcuaggguauguaaacccaugaaagccaucucagcuuggcuuacagacuuacgggagugcuauguaaaauguaguguuuuggaauuuagcuaccuagaauguguuugcucagagccacagagauuaaaagccugcagagauuguaggaguucaggcaaauggcaggguuagcucagaggauggucacacagcuauuccucccugaccuuguacguaaaccuacagcaaugaagagaaguaaugcuuuggguuuauaaauugguuauuaccuauuuacauaaaauauuauugcuuauauuugauauuuuuguccuuggcugacauuuaauuuuccauuuuccuaugaagagaggaccauaugauucuuuuaagcauguaauaaacuuuaauuacauuuauauaaauuuuaauaaauauuuuauauauucauauaaauauguuaucuguauuguacaagcagauaauuauuggauaggguuugcuauguuagcauuuuugagucuguuggaaaaauacuuccuaagaaucuauaaugucaucuuaauaucaaauguuccauaacugauaauuauaauucacaauuaaguaauuuuagggaauuaauuaacuuaugauauauaaguucauauuugauugguauuauccccagauaacccuuuuggaauaauuuuuauauaacaaauauucuuuugucuauuucauuuuuagaguuacuguaacaacagcauacuuuggacacucugagcagauaucucaggaaagguaccaguaugucgacuguggaaggaacacgacuuaccaguuggcccagucugaguaucuaaauguccuucagccacaacaauaaacucuaaaggagaugugguuagagccgaugacacaccugagacaucgucagaacugucagugaggagguacugccuagaaggacaucuuuaauuaagcacgucugaaguucacacugggaugucgagggucagcugacagacugugggccuugugcaguuccugcacucucacuuucuguguugacgauuugcuccuaccaagagccuuucguccagcuuaaguuaacugauuggcuuucuucucaccuuuguucccaaggugaaaaauugaaacuuccguagaauacaauaaauaauuauauaaaagucauagauuuaaucuauauaucuauugauaauauaguucauuccugaacauaauuugaaaaauaacuucugaagauuuuuauauaaaauuacugaaagccuauuauucauggagaacuuuuaaaaacugaccuguuuuauaaauucccauucuuacaugguagucuuucaacuauaugauaacuuagcuauuagcuaaauguuuuuagccuuuaauuucuugaaauucuacugauuugcauguuuugucuuauuucuagcuaaugguugcauaauauuuaccaaccauaccauucggccacauucuguucuacauuuuguaagaaccucucaguauguguuucauguauaacuuugugagcuuucugugugaucuucaaacauauuccuuuaauguacaauauuguaaauaaagugcauggcuuuuauacagcuuugauaaaggucaaaugaaguaguacagauuaagaauaaagcagguuguucauaaacaauaagguaggaaauugaaauuaagaaaccuauaaaauaucaguagguuccgcuacauguuggaucugacauaacauagaugcacaguaaaacauuucgaugcucuacuuuuuauauuaauuauauagaugcuuuucccagcaauuagguaucaucaauuuuaugaauguuuuagggaagaaaaccauuucuuucuagaaauuagucaaggaauaauuucauugaacacuggugacuacaucaaaauaaaaccuauaguuugcuuaaaaaauuuaaucauuacccaucauccugagucgaugcuucuagcaguuacaguaaacauuuauuuuuuaauuuugucuaacaugguuuucaaauaugauggacguauucaucuuguugcuuuauauuuccagugucauuuuugaccaaguauuuuccuuauucacccagcaaauuuccagugcauucuguuuucuuaugucagaaguuggguuuuccguuucccauacccaagugcuuccguugguugugaugugugcucuguuccucagccuggcucucaaguggaaagcagaaacucuaacggcuucacccugcccuugaagcacucgucaucuuuccuuagcagucaccugcauucgcuguaugagggagcuuuggggucacccguggucuguguguggccacccuucccguacacccagagcacccucugcagucauucacgcucuagucaagcugggcuuuguuuguuugguuuuucuuuucugugcuugcuggucaccuccauucuugaagcugcacaguuggcugguugugcuuacauuuuucaaaucaaccucauuucauuauaugcagucucuccuuuuuauguaacugucugugagucauuuguuucauuucauuuguuuugucuagaaaugucuacuccuguuacuuaaaaguuaccacugucuuuaguuuggcuacucagcugaacacuagccauaaauacgugugaggugugcaaaaucaucauccauccaucucugcagaaucgcccuuuaccuaggccucauguaguagccacuuucucugccccuuccauguguauuucaguccaggagagcacuguguucugccagaguucguggacaaggccuacugaggcaggacaguacagucaacuuuacucccagugauucaguuucaaaaaccuuuucguaacuauuuacauugaaauuucuaucucaaccaguucuaaugucuagcuuuaauaaugccugagucauuugaaaacccagccugcaacucuucaacgaaaaucaaguaacuccuggguaagccaggcugcuaacagcuguaaguuaauaaaacucaaaccaaaugaacaaacagcagcugaacaauagccauggagacaucugcaacuaugagugaagcuuugugcuuuucuuaggucugguuuagcuaggucugacuucgggcagggaggaagaguagguauuaauauaguuuuauaugagcaccaccagagcuuagccagggacaugaugaagacauuaccauguugccccaugcucacagggguaaauucuguucuacacuaacccagcacugccccaggcucuguguggacaacacacuggcuguugcucuucugucugcuuuucuuauguaauuucucaacaggacacugggaggauuugguuuaaaauuauauauuaguaaauccuucaguugcagccagaagcugcuucuccgacucucuucuuaucugugcccuaucaauuacaauguccauuggcaagccauggugacucagguuaguacaauuacacauugaaaaaguggccggcaagguggggcagcgguugaggaugguggccaccaagcuugaugaccugaguucaaucuuuguaccccacagaaggcggagagaacuggcacucuucucggaugaccguucacggacaguacaauaccacauauauaguguacacacacauacaaaugugucgaugcccauucacaaacaguacaguacacgcacacacagacacauacaaaugcaugaaaaaauaaaguaaaaguuuuugaaguuaauagugauggcuaagauuuugguagcuuugaguugcuaucugaaauauuucuaaaaguaaauuaaacgauguagaauccuucagaaccaaagcuggagcuuaauuuuuauguguuaauauuuaauacuucacaaucauuccaauaaaaauaaaacugacauuuuuggugugaauuauuuauaaguaagauuauuacauuugagauuugaaauacagagcugaaaauacuagacaugagauaaauuucuugaaauugcuugaaagacuaucuugccugaggugacauuucauagaacauaacuguauuuuguuaucaguuuuccuuugacuccuguuuacccggucuuaaugaaguaauucuuuuuucuuaaaaccuauuaaaagaguaaaauauaacugacuucagaucuuauaauuugcacuuaggaaaugguggugaaguguaaaaggaugugggagguugacauccaaacaccgucuaaguaacauuaggacaauuggaacuuggcccuaaugggccuugugguuuuuagccuacuauggaauaauuuuggcuauuauguuggcaggugugccgacuuuuccauucugccuuuuaaagugcuuaaaucaacugguuguuaacacauugcgucuuauuuuagaagauaguuucauucauauguuuuuaaaauaggaguaccuuuuacauuuucaaauacauuuuugucuucuuugauaaguaauaagagcuaaacauuuagccauugguuuauaaucaaaugguaaaccgugaugccugagacacuaaaaugccauagcugcuuggcucaaagugugucuuagagugggcagccuuauuccucugacuuugugaaacuagauuuuaaaugaaacauuuaucuuuaacuuucuaaagaaaauuaguacauaucuuagaaagcugaauaaaaaaaaucacuauuucuucaaaguuguaauuuuagauuaaaauaaauguauuugugauauacuuacuuggcucaaaaauuuaacuucuauaucaaagaccuauuuacauuacagucuucauucacaguuucugguugcaacuacuuugugugguuuuuagcuugcuuagagaacagguuucacagaagagcucugacgcuuaucuuuaaauucgauaaaagcaacagcaaugggauuacuguaggaacacaaauagaauuuccauguuuuaagcuguucuuguuccuuuuuacauguguuaacacagacuccaagcugaagauacagugugguugggguucaacccucaaagcagugcauagacaacguagcaauauuaugaggagcuucauaguuaagucuuaacuauucuagaaggaaguuguugccuucuguuuaauuacauucaugaaauguguuuaagugaaauauuuucaggauauuuuguaugcuguaaaacaaaaaaggaauuguauugugccaauggccaaagguaauauuacuaccauguagaugaugacaguucaaauugucccacgucacccagaaguuuagaaacuagaagucugggagacaccacaucaguuguauugggugauucuuaagugcuguacacgcuauucaucuugucaauguccagcacaagaaggagcgaugccaggcaagcugcaaagaugcagaauuucaugacgcaggcuggugucagacauaaguaucagccagucauguccguguguuuuaucuuagaguuucacuuagagcuucacccuuaagaguuggaaaaugauuugggaugugauaguauuccuaagcucugacagucgauucggaugguggaauagagaauguaagguccguucuguaugcuugcucuuuagcgaccuccauuauguuacaucuguuaaauucauuauuuguacaguucugaauuauuaugauugcuguucauguagggaaacaugguuaugauaggaacaagaauagaaauguccccaaugcuauuuuuuaaauucacuuguaacuguuacucuuauacuuguguaugacaaaauaaaauuuguaaaaaacacuuuagcaugaaaaauaaaauuuguaucaacaaaguau

SEQ ID NO: 2845 - RNA, 27414 nt, Mus musculus
ggagagcggcuaggaggccgggccagggaaggaagcgcgcggcgcgccuugucccugacggcgauccguagcgcugggagucagcggcggaaacauggcggccgugucgguccuagcgaaaguuucuaccgaggccuugcggugcuagugcgggaggccucgggcucacguccccacaucaccuccgcguucuggcucggaggcuccgcgcccuuuggcucugcgagcuucgcagcggaaagagcgaggcucgcuggcgaccgcugacucggguaaggggcauccgggagccgaggggcggcggagggcuggggcgccgcccaggguccggcugagccggccaggccccgccccgucggccuccuggugggaucgaugcucgggggcuggcgaccgccaagggagggcgugccucggugucccgccucacccugacccgggagucgcguggugucgccucgucccagagcuaagggguagcggaacagccagggucccgagcccacuucuccaucucucgcuagaucgagcccuaacgggagagaaguuaccauagcugcucaaaaaggagaguccgaguugccauucuucuaguuaagaggugggccgaaagaguuauuagcaggaacucagagaaacuaggcugcaggucuccaacuccugacggcucaguguuguucuuucagguuuggacauuuccccuacgaggaacagacauagauuuccacugaaggauuaugaaagcgauacauugugucuugaaguccauugucuuaggacaccaugagggcacuuuucuguuuuggaagaaauuuggugaauuaagugaagguuggaguaaagccaagagcagacaagccaaugauuccuggacucucacuuaaguacuagugcuagcuguggcuuauuagaaagugguuuauuuuaucugcauuucuuaaguaguuuuuucuauuauuagucagucuccucuccccgccccccccccuucggaauugaauguuaacuugauuacagacugcuggauacugagcgugcauuguggaagacagaucuccccagagacuuugugaccugugaagaaugcagacauuaaacaaauggugaagaaaagaguaguuuuacuuuuccauuucagagagagugauccgagaggcgauucuccuacgaaaagaauuguaagcccacaccugaaugaaggguuugacagauaaagggcagauagggcuaggaggaggaaaaggaauauguccagagagggcacgccauuucuguaguucauaauugaaguguaguuggaauaaaagugagaggaagagcaguaacagauggggcaguuauuccuguccacuguguagcacuuuauaaaggcacugaaaaguuuacacuguaauacugugagggguggaaagccaauagagaauuuugcauaguggagcauaacacgauaaaauucgggucuuaaaaacacacuuuaagaagggcagaaguugauagggaagggaaaaaaaaaaaaaaggaacauguuuaagaaugaggucauugucaccaaaauuuagguggugauuuuuuggcggauaagaaguaguagaaaugugaaagagaugcuuagggaaagagaaaucaagaacgugugaggauuaacucaugggucaagaagugugggggaagguuaaaggaguagauaggacuauaguggggucaaagccagcgccuccccaaugcuaaguaugcuuucugaguuaugaccccagccggagaucuuucuaauggacuuuagcagugacuugcucauugacuccauucugcuuuuauuugccucuggagucuuccaucaaaucauuagggaaggcagcucaaguaaaaacagucacaaugcuuuuaaaauuuguuuucauuucuaguuaaggcuauuuuuaaaagucagaauggguaaaaaccuuuaaaacuaaggcucauaagaaugugacugcacaauauuucaugguacagcuguaguucuuuuucaaaauuacauaauauauggaagcaauuuagauugcucaaagccuaggguugggauuaagcauggguuagcaaugaacaacuuucaagagaaucauggagaaagcacugacuugugaaaaaaauauggauuccuagacuuuagaagccaagggaaguuucagaaggcgauaguacucaucaguaugaaggcuucuaaagaaaacguggagacuccuguaaggauuccaucauguucaggaacuugcggaucauucuagaaguugccagagcaguugcacugagggaaucacaccuuucagcauuuugaagugaguguaugagaacuugaucaaacauuagcugugaggagggaggaaacugaaugugguagacaagauggggagaacaaagauuuuuuucuguuguuucuuuacccauugguaguuuuaaaagccgaccuaguaagugaauaagcacuuaaguacuagugaauaaagcuuaaguacuagugaauaaaggagaaaagagaguuuggagagagaauggcguucuggaacaggaaggauuuauacagggaaggggacucuggcugacaugcagagaugcagagaaagguggauuugugcuauugggaaccuaaggaaguuucuuuuuuaugaccuuauaggaagcagucauguggcuaaaauacagugaaaugugagugucaagaggguguuuccugagugugcagugaauuuuuuuuucucccucuaguaguacuuauuuuaauccuacaaucuaccgccagcauuuaagucuuucccucucuuucucgcucuguguaguauaggcauaauauuuuaugaauuuuuuuguaguccagaucuuaucgguuuguuacacuuuuguuuguuuguuuuuccgagacgguuucucuguauagccuuggcuguccuggaacucacucuguagaccaggcuggccucaaacucagaaaucugccugccuccgcuucccaagugcugggauuaaaggugugugccaccacgcccagacaguuuguuacacuuaugaaaaaacauccacuauaaacaacaacaacaaaauaccagacauuuucauuaauuccacauggcaagaagugcuuucauggaaacccaauagaggaaaguuacuuugaauaucugaugaauagauuuauaaauaaaaauauguuuuggaacauaagaaaguagauauagaaauagcacuugaaauaugcuuggaauccuacaguugucucccaggcauugcuccccagccaaaggcuggguagagguuaauucuaaguuagcucaugugucuggugagagugccuuuuagugcaucucuauuaggaaaguuuaaauaaacugauccccuauguguggguuuggugaugugguucaagccuaaugccuuguucaucguaggaaagcacucuuagcacugauauguagcccuagaccacaaacuauuuguuuucugaauauaugaguuuuugaguguuauauggcuaagcuauugcaauagaucuguucuuacaguauacugaagaacuaccuacuggauggaucaguacuugugugugugugugucuguguguguguguucauacacagcucagugagugcaugugcaauggcauucuuguagagggcggaggacaacuuauaggaguugguucucuucuuccaccagaccgccauugcaccucagucauuguacuuauguagucaggcuucacaggugagcuagcucauugacccucacaguguauuuuuuuuuuaaccauuuuuguauuuuaagucaaaguuaugggagcacuuagguugaaauaauuauuuggguccuagaaaauaauugcuguagugacuuuuugagaagguagacuugaaguuuucuuacuuuaccaugaacacuuacugguaagcgguccaguauuuggguugucaguaagaaguucagcaauugauuuacuaaauagaugaucuauauauuugagaaguaagugauuaacccagugauuuauuuucguaggagugaaagcacaagaauuauggugcagcuuuugggacugaauaaccguauauagaguuaaauguuauauagaguuaaauguuacuucuaguuaagaauuagcuaaacaauauaaagacugauauuuuauagcauuuuagaaugguuuuguaaaaagauguggcggauuacaguaguaauucucuguguccuagugcuuuccaauuagaaguaauagugaagcccuucauuccauuugaaaggugagugagauuucagugugucaaaggcaagugcuuaugaucucaacucaacuaaauauucaaaucgggauagguuagacaacuucagcauuaacacugguuaguacugacagagaagacuccacuuacacuucaugaugcaauuuuaucaguaugaauaaagaucacgggcauuuuccuuuguguaacuugcagaguuuguaugauuauuaagauauaugcaauuaggauuugaacuggacggcagaaaaaccuuaguuuuucucugauucacuuacuuaguauaaagaagauggcacaaaauauuauauauacuuaacugugaaauaucuuuccuucucuuuaggucauuacaaagaaaacuucugagagaauguuggaguaggcauuaccaacaccuuggcuuuauugaaugaaauacaggaaguuaauuuuugugccucuugggacccuccagugccagauuacaugugcagaucacugcgauacuguguuagucauugucucuaucuagcaaugacuaggcuggaagaaguaaauagagaagugaacaugcauuccuccgugcgguaccucggcuaucuagccaggaucaacuuacuuguggccauauguuuaggccuuuauguaagaugggaaaaaacagcaaauuccuuaauuuuggugauuuuuauccucggccucuuuguucuugggaucgccagcauacucuacuauuacuuuucaauggaagcagccaguuuaagucucuccaaucucugguuuggauuucugcuuggccuucuguguuuucuugauaauucauccuuuaaaagugaugugaaagaagaaacaaccaaauauuugcuucugacaucuauaguuuuaaggauauugugugcuuugguggagagaauuucuggauauguccgccaucggccuacuuuacuaaccacaguggaguuucuggaacuuguuggguuugccaucgccagcacaacuauguugguggagaagucucugaguguuauuuugcugguuauggcuuuggccaugcucauuaucgaccugagaaugaagucuuuucuagcuauuccaaacuuaaucauuuuuucaguauuguuauuuuucucuucauuggaaacuccccaaaauccaauugcuuuugcauguuuuuuuauuugccugguaacugauccuuuucuugacauuuauuuuaguggacuuucaguaacugagagguggaaaccuuuucugcaucgugggagaauuugcaggagacuuucugugcuuuucacugcaaugauugagcuuacauucuucauccuuucagcauuuaaacuuagagacacucaucucugguauuuugugauaccagguuuuuccauuuucggauuuuucuggaugauuugccauauuauuuuucuuuuaacucuuuggggauuucauacuaaguugaaugacugccauaaaguguauaucaaccacagggcagauaacaauagccuugacagaaucauggcauccaaagggaugcgucauuuuugcuuaauuucagagcaguuaguuuuuuuuagucuucuugcaacggcaauuuugggagcagucuccuggcagguaagcucauggguuuuuguuuauuuucuuaugucagugcuaaugauaacugauacgauccuagguagaggugcuaaaugcugacgaucucaggauaccuaugcccuuaaaagcaauucuuucuguaaugacaggaagagacuagcaugaaaagaauuuaaucauaaacuguuucuauuguaacaaacuauauaauuugaguacuucaguuugggaugugggcauacaagagcaacucuucuuggugcaauucuuugcuuuguaccaauguguugcugcuacguguacuagagauggaaguguuaacgggagcuagaaagccuugccugggcauggggcuucuauucagugugggcugccggccucaaggaaucugugugggagucaaccccguggugaaaacuuccgcagggcagcuuccucauucugccagcuugcuguagcuagggacuuucagaacuaaaugaugucggaacucugcaagaacuuaccuccucuucuucuuucugaguuggccacuuucccagucauaacuacauuuucucugccaagucagcuucauuccugcagggcuccuucccagggcaugaaauucuguuaaccaaguccuuucuuggucacuagauguuuuuucugcucugcauauaucaguggauuucaaguaaaguauguguaccaaugggagugaguacacacaagcuuucuaaggaaucucucagcaaagauaaugucagaaaaaucaaucuccagguuguaacuuucagugggauuguuuccuaaaguugaccuauuugagaaaaucauucaaguugacccuuaagugguaucucauuuggguuuuaauuuauaggugccuaaugaaaguugugucauuuuguaugcucuuacauuuucaacauauuuucaaauaucccuucgaauuucuucuuugaccucuggguuauuuuugucuuuauugugggaaaucuuaauauuuguggauuuuccaacaucagccuuguugauuuuugauuuaucuuuauaguuggaagacacaauuuguaugaauuuagccuuuuaacaaagacuuguuuaugaucuaaaaaaagguuagagugcuauugagccaagucaagcuggguagugauguucuuauaucaauauccuugaugguuuucuaucuaaucuaucaauguugagagauauuaaaauguguacuuccucauuuaaggcauuauuaguguguguguuuguuguguguguguacguagguagguauagguguagaugugcaugcugcagaggccagacaggcguuagagcuguguuugugagccaucugauguagguuuuaaaacuccuuguuacuugauuuuuaucacgauagauggcauaguuuaguaguuucaauaaaaacuccaugaccugccugcaaagcuuaaaacaguaacuguagaaaaagugugcugaaccuuguucuuggucucugagcauuugagucacgugaaaucuguuuacguucugaagccugggagucagugauugggggggcaguuaggauuauacuuugcuaaaagucucaugggaugaccugggauucagugauugggggggcaguuaggauuauacuuugcuaaaagucucaugggaugaccugggauucagugauuugggggggcaguuaggauuauacuuugcuaaaagucucaugggaugaccugggauucagugauugggggggcaguuaggauuauacuuugcuaaaagucucaugggaugaccugggagucuuugggggggcaguuaggauuauacuuugcuaaaagucucaugggaugaccugggaguccucgucagcaauacaccuguuaaaugcuuguuaauuuagcucuucaaaacuaauguaaacccaccuggauagauuuacauuucccaguuggcugcuacuugauaacaguuguacgugauguugacauuuugccuuacagaaacuuagacuuuucagcauaguuuuugcuuaauugauuauagaaagauuccaaacccuuuacucuacccaguauucugugaaguguaacuauacuuagagcaaaaaagaagaggaggaggaagaagagaaggaaagggaagaggaaggaggaggaggaggaggaggaggaggaggaggagaaauaauaauaguacugaaagagcaucauuucuacacgugucuaugaaacccuugucucucaaucucacacacccuuuaaccuguaugugugaguucuccguggacuucugcuaaagugcaaauaacauucauaugaaacauaauuugggaaacacccacugguucuacacaaguugcaguuauucaaaugauucaaaucagaacauuacacagugaaagggaaacaauuaaggccuucauugaggaaaacuauuuuggagagagugacauugcuaauccaauuacauucucagcuauuacaaauuauuuaaauuggaucuuaacagauauuuaaauugaacuauuuuuacuuaacauuucuaaauauuguuccuaauauucucauucuuucucucucucgcucucucucgcucucucgcgcacaugcacacacacacacacacacacaaccuuaccacauuucuguaagaauaauacugaaguguuaaacuuuuuuucuuauauuucauuaauuuauccuuuaauugauuucuacuggaaaguuuuuccacugguuggguggggacagaccuaauccaacaaagaaaaauaagaaagaaacuuuucagcagaugaguuugucagcuacugucaggauacauaaaaguagagaugacauaaccaacuccucaguuauuuuucuuuuaugacuuuuuaaaaaaauuuuaacuaagaaguugucacaaacuccauuuaaguagauuugauuuuuguuaguuuuucacucuauuauugucagaaugggucaagaguuucauuccaaguuacuuucauuaaagagcuggaauuucauauuaguuacuguugugguucauaaucucacucuuacuuugagaggcaccugacagcugcuguuucccaguuuguauuauguucacugccugcuguuugcuucugucuuaagcuuucccuuuaaauaagucaacuagaaaggcacaauagcauagcauaccuaguguugcuuuuauggcaguugauaagaaggcuaaaagggagacugaaucccacuuaaaacccacaccauuuuuagacauauuuagacaugcucucugaaauauuucacuuaaacuuucauaugccuuccuuugcuaaccacugccauuugaagauuccauggggauuugaugcagcuuuuuguggaagcccguuucacaccaacuagaaaauccauaauacagcuaauuucacuguaggugaaagagggaccaguccugaauaugauggagucauaguauaagccuugcauucaaagaagucugucaguacagcgcaacuucacuucuagcaagacagaagggccggccugucaucacuuagcaugggagcgggacuuuccacuuugcugcugaauuagaaguucaguguuuccaucuguucguuuguuuguuucacuuacuugccucaguuuagguuacaaaggggacauuauuuuuguuuaaagccaaaauuuuaucaauuuuucuagaaacuguaaaacaggauguccuauguguuccuguggcagugacacacaguaggaaauguauaaagaaaaugacauuuauuuuugcuguguuaagauugggaaguccuauuucaguaguagaaguugggggaggcggugugaaagggaaggguuuagacgugucuuucacagcuuugaauccuuauguaagagucauucauucaucugugaaggucuauuguaaguucuguauccuuacacuugcaguuaguccucaucuccuaagauugcuguacugggaaugaaguuuccugaguaugcuuugagggaacauauugaaacuacuucagagcaguagauguuuuucccucacucacccaccugaaacagugguccaaguaguguuuucuucauaaaguaugacugugauacaguucccaacagauaacuucugagcaguguauugugagcaucauagcauacacuuucacaaaucuaaauuaugugucacuuacucugcuuggccuauugaugccaucagcaaacaaaauguggggcucuugcugguaaaugugaccuaccacuguaggggaaagagggacgguccugaguaugauguaguaaaccuuuuaauauguaggaagcacagcuaaauauguggaccacuaacacucauuuacuguuggcugugugcugcuauauguaauuuuaggacggacaguacagguuuauuuacauacagcaaaacaaugcgcuauacuauguuacaagacaguaggaaauguucaguuccauuaugaucaaugggacacgaauggauaacuuguuuacaugcacagaauugguguauauggcccauaauugacugcaauauuguuacuaugugcauaacuauuguuuccucuucaccugauucuccauccuuuccuugugugauaguguaugcugcuaaucaggguagagguagguggaccuccauguguuagagugacaaguuacagucaagcuaaaacaacauccugagacccgguuucaaagaacaaaaaugcaaaacagcucaccaaucaaugagaaaaaaccuacuagaauaucuucucuauuuuaauaagaccugcccuuuguaaacuguccuguguauguauaaguguguugaauucuugcaacugcuggagguagcuaucauuacuguucgugaugaggaagcuuggccguuguagcugcuuugaaucgaggaagccuccacucagccuuuacucuccagggcuguuguccuugcuuuccuugcuuucacacccggcaagggcagagaaugaauuacuucaucuaacugcuuuguugguuauagggaagcaucgguaagacuugcuugagaucauuucuggaacugugauuucacuuuuuaaagcuuugcauuuuuugugugugguuuugucucuuuugagagcacucagucacaggauagauuucuaaugcuuuuauuaggacauugaugauuguacaucaagucuccuauguaauaaucauuagacauuuagauaaaaauauaguucuuuagauuucuauucuuuugcuucugauuacuucggaauuuuguugagggcuagagagauauggcuuugcuauuaaaaagugauuacuagccgggcgugguggugcacgccuuuaguccuagcacuugggaggcagaggcaggcagauuucugaguucuaggccagccuggccuacaaagugaguuccaggagagccagggcuauacagagaaacccugucucaaaaaaccaaaaaaaaaaaaaaaaaaaaaaaagugauuacuaugcaaccaugaaaacaagaguucugaucccaacuugacaaauacaguguuucucaaaccccuaugaguccagcuucaaggagucuggcuuucucuucuggccuauaaacacauagguacauguaauugcacacacauguacacauacacucacagcuacauauaaacuaaauuuuuaaaagauaaaaucuuuuguguaguuauuuuuaauucaacaagcacaagcacuuuaauccaauaagaagaaacaaaauguuuugaaauuaugugacauguauuacauaagaaauauguauaaauuauacggcaauuauauaaaguguaguauauuuacacugaaaggauuuuuaauaccauuaagcuggcaaauggaaauguaaauauauacaaauuaauggccuuccagaaauguuauauauuaccccuuuuaaguaaaaagcaggccuauauguacacacaaauauauauuugugauuaaaauacuaaaaaaacauuauguguauauuuuguuugcauacaugucugugaacuauguguguaucugcagaggucagaggaagguauuagaucccaugaagcuggaguuacaaaacaucgugaacucuuuugugggugcugggaauugaacguggauccugugcaagaacaaguguucuuaacugcucagucaccucucuccaaccucuauguuuauaacuauguauacauauauaugugauauauguuuuauauuaugaaguauggagauagucuaauagacuauuugaagggauuuaaucauuuauacaguucauauuuugcaauguucauagcugauuauuuuacacuaaaugaucauaacgugcuauaaucuauauuauaaaauugauaaacuacaauguaccaaauuggucaguguaucuguuuuuuuauuaugaauacauuuucuccuuuugcuaugaugagccaguccuuaggguugacauuuuuuccugcauauaggccaauuauuuaugcagcaaugaaagaauauggaaucgugccaguauuaaaaagauauaauaaauggguacuucccuccuccugcuuuuuaauauuuaauauuuuuauuauuuaauauuggcuuuuaaaauucuuuucugucugccagcugcuuuaaagauauuuaaaugugcuuaauauuuuuuguuguuaugaugugcaauuuagacaaauugaguuugggguuuuuuaaagguuaguuauuauauaaaaaugaaauuaacuuuuacuugacuuuccuuaagguuuuauucuccuaguuucuggaugcccugaacucuucaugggacuugauagugagucuuuccugaagcacccucuuugauaaaguaguagucaugguauuuggaauaaugauccacauauggguugaacauggagaaaugguuuuuguuuuuucucuuucacaucagaguuguuacauuuuuguuuucaguuuggauggaagguuauuuaacaaaauuuuaaaacuaugugcuguguuuugcuacaauuucuaaaaaacuuagaguucugucauugcucugguaauucgucugugucugcagauugugcuuuuacuuacgauaguuuuagauuaucaguuguguuuuuacuuagugaaaauagcgguuaaaaacugagucaauacacaugcauagaaauauccacaaacuguguaaccuguuuuuuguauuucuuccagccaaccaauggaaucuucuugagcauguuucucauugucuugccgcuggaguccauggcucaugggcucuuccaugaacuuggcaacugcuuagggggaaccucuguuggauacgcuauugugaucccuaccaacuucugcagguacugucaucugcuauacucaauaguaacugcuugaguguuggcauugucucaaugauuuugguagauuauuuuuccacaacuuuauugcuguagaauauagugcucuuacaauuguuccuugugucuaaagcuaggcuguaagugauaauguaguuuucaggauuaaauaucaauaccuugauagauacgucuagccuuguauuuuagcuaggcucagaaagucugggugagcuugaaaggacaggcuccuccucaaauggagugucaugaaaaucccgugaacaccucagggucuuuaucuaaaauaauaaugggaauaucucucgucuuggagggacuauuuguagagcugguaugauuuaggauguagaaauacucuggucuaugaaaaauucuguacaaaaaugaaagauuaguaauugaaucuauuaaaaauuaauuuuauuauaguuucauucuuauaauuuuuuaccuugaguuaguaaauuuggaaugcauuacaaagauccuguguuuuucacuacagaaauuaaauaugagaucacacuauauacugcuuccccuguuuuauguguaaacuuaguuuucucaagaaaauguccuuuccuuuguucuugaaacaguuuguacaaucuugauuuuaaaaauuuuuauucagugucugucacgagauaauguuaucagccuuacaaauaagaaaugcaaguuuuagaaaccaugcuuugauuuuuucuaaacuuaacuguuaacaugaaaggaacuacaggagagaaaccugcccuucaauuagcaugguuggugauggauagucauucuagaugauggaugagaauguaauagaauacuucuuuuuaaagauuuauuuauguauuuuaugucuguggcugcuuugucugcauguacauuugcacaccagaagacagcuugaaacaguuaugagcugcugugugggugcugggaauugaacucagguccuuuugaagagcggugagugcucuuaaccacugagccaucucuucaguccuguacuaugagcaaucuaagcuuaucccugacuaguuuaccaauaaaugagacucagacuaugguuauuuuauuuggcuuuacaauuacugaaggucaccccuaaucuacucuucuaacugcaggccuggcuaccuccccagagguguaccccuagauacuugcuguuucuccuggucaugugcucauggcuucuuucugacaucuucuuuccuucugaucucuccuccuccaagcaggucacuccuaacccaccuaccucugaacccuccaguaauuggcuguagccaguuacccuaaccaauaguuuuaaaucaagcaacaagguaaaguucagucuguucguauuggcaacucagggaaaguccucuuaucuuucuuguccuggugaguaguuauguaucuaaaucaauuucuaucgcaaccuaaaauuaccgucugagacccagaauagcuucuuaaauccuaaacaacuuaagcuuuagucuucaaccccagcagaggccugagaagaaaguaaauauuacuuguaugcaggaagcacaaggauguagcuccuuccaaaaaaauaaaauggcagagacagcugaccacuuggacaguccccaggauucucuauagugcuagaacaugugucuucagccuucuggcccagaacaucugacagaucguuugugaagcaggaauuaugaaggacuugcuuacccugucuuggaagagcuuggaaagcaacuuccagaauucugucuacagauaaaguuagagcauuuucuuucccaguggcuaguuugccacaauugaauuaacuccauauggaggccuuucgaagcuaucaucuguuucuaauuugaguggagcuacugccagaagcugcuaugucccaaugucaaaaaggccuuaccuugauagaaaacaucuuaaaugccgccugcugugagucucugagguuuugaguauuaucuaucuauucauagcauaucugaacaagcaaauguugcuugucuccagcuuccuauuaucuguauaacccaggauguauaucuguaauaauccaaacgagaguuuaauaugucuugaguuugauugacuggcuaguaacuugcauugcuaaauuauccuaaacaguuagugagagcagcuauaaaaaggacugggauuaaaacuuguacuuuuaaaugaguugcauaggcacaaugccuaucuaagagcugaaacauacauauauuauguuguaacagaauuagucuuaaaugugucucaauauacaaagauuuauaccaaugaaaaaccuuaaaccuguaucaauaaacaaaaaucugaaccaguguaacaaaauauaaccuuauuauuauaucaucauacaaaauuuuguaccaguguaacauuauggcuauaaaaugcuuuugcuuuaagaguaaauucaauaaucuacauacauuugucuaacuucuuauaauauuuauauaucccccuucuccuuucaauccccuuucccuuaccuaggaaagaaagauagaaaucccugagucuaugcuuucuauuuuauuuccuccuuaucccaaaccauaauuauuuguaauaucccuuaaaaugacaauauaucuauaacucauaaaauaaccaaaaccauccacccgaacuuaagggccuggagugucauucuucuuguaaugcuuccugcugauuuguggcaaagaauucccuuugggagagacccagggaaauuagaaaacuguuaagaguuaagacuauagcaaaggcuauagcuuuuauugucuaaucucuguaugcugagaaagugcaaguguaauugaaguccugauuggaacagucugaaaggcuggaccaaaugagcuagcuaaauauuuccuagaagcaaggaaacagcuuccaugcaguugagguaggaucaggcagggagcuggaacaacaggucucucaucucagcaucccaaggcugaauucugucagggauuuucaucuccuauuuucaucuucuaugucaauuucucaucuucuauucugcaauauacaaacuuuacaaggaacacauagcucugugaagacaucuguauaaaauaugcagguugcucagagcaauuaaguaugauuuccugcucuuucuuugaacagguaaagaacaauugcguuucuuuagaaguuaguuugaucacauaaucaacccacaauauaaaucuccauucaugccauaugaaagaauggugugcaguaauaguccugagaauuuuguagcccacaagacuuacuggucaugcaagacgaagaaguucugacuggagccauauauaugucccagucagauccagaauaagauuuucuaaaaaccagcauuuuuuuuuucuacuuuugcagcccugauggccagccaacacugcuuccgccagaacauguacaggaguuaaauuugaggucuacuggcaugcucaaugccauccaaagauuuuuugcauaucauaugauugagaccuauggaugugacuauuccacaagugggcugucuuuugauacucugcauuccaaacugaaagcuuuccuugaacuucggacaguggauggaccuagacaugauacauauguuuuauauuacaguggacacacccauggcucaggagagugggcccucgcagguaaguuuacuuuuguccauuguggaauauauguauucauggaauauuuacauagagacauuaaaguucuccgcucccugcggcuucacagaugaccaagguuauaugguuccuuuuaauuuugccaggaauuccuacuucauuuuaguaagcuacaacuaggauaugagaaugguuuccuguauaguuuuuagagggaaaaauaaaaugauugacuugagacuuagaaccucucugccuuuaaaaguauuuucaaaaucauuccacaucguaauaccuuuuagaagcugauaaacucuugacuaauacuucuuagugcuuacauguucuaaguucagauguuaauaauguuuucacaugugaaguauuacuggacuuagagugucaggccaugcgguaggaaaaaaaaaaacaacuuugguuuaccuguauauggaaaaagaaaauacuuuauuuucaagacagguuccaaagaaguauuucaugaguuguuuagucuuccuaaugauaauaaagauuucauuacuuguagacuuuguuuuguggauuauuaccggcccagaaccuaagagaacuuaggauguaguaguaggggcauccuuaauuaaugccuagguaugaaaauucaugacauauauuaugaaaaaguaagacaguuuucuuuauuuuagauugaaaauauaucauuuagauuuagauccacccuaguuuuaaauugagaucaaaacgauagucauaaaauguaagcuuaggcauugugaugucugaacgucacugccaacugucuugauuuaguagugagcagcagacuaggaaagcaccucagggugugcuuuauggcauuuccagagacgaggaucccuaggcccaaggagaauguccaugaguguaggugcugcagccugauggucuggagggcugagugaaguaaaaaggaaggagccaggcagccgagguaguuugcucugcuucugcacugucaggaaugagucgcucugcgcugcugcuccagcaguacucacggaaaccucggaacccaggagccaagaacuucuggacauuguuucuguccuaagccuugucacauagaugcaaagaugaucauaccuacacucagugggagacaccacgccagacagagacagggcugccaguaggaaacaggccuagauagcagauggcuuuaagcccgcuugugcccacuaguuucaugucugacucgugacugagguuauaucauaaaggaaagcagacuuuuaguuuuguuuuguuuguuuuuuuuuugcaauuuaauauuaaguaaugcaauggcuacuuuaggaguaaaggcaaacauuggacacauuuaaguaucaguacugugccuaguacuuaguacacauaauuagaugugcuuuuccuauagucuucagucuguugucaccuuacaguuuucaaaggaugaaguggaagcugaaggcaguauguaacuuauucugaucaucccaagcucugcccaacgccuggcauauuuuuuacucugucucacguugccaccaucgcagucaacacaguucuaaagaaguggcacgcccugguuaaguagagaguuugcuaccauggcucaccauuguaaagaaacaugaguaggcucacacguucauuuccuguacuguagcuuuggaaugacaguccagaaaagagcuuucucuagguggggaauagggcucuguaucuuccaacucagagcacgcuagaaaaguccuaguccuuucaaaacccuacagaauaaaauuucagacuagaggaaggaacugaauguuauaaaugcaauauguauaguaaacauuguaaacuaacuuuauugaguauccacaaaccuuaauuuaaauguacuauaagacauuauuaucucuuucuguguugcucggucuugucuguaguauguggacucaaaaugaucuuccugacuuugccucuugaguggagucuagcacuagaggugugccccuucacacucaaguggcuaagaaaauaauuuuugaaauaaguuuuuaacguguacuuccauuaaggauuaaaccuaauauaaauguuuuucagaaagguugcauuuucuucuuaaauauuuuaaaauuuauuucaagcccuucuuuaaaaauaaaugcuacacauucaucuuaauaauacuuauaucaccuuucucuuuucuggaaggaaaaaaaagauauaauagagagcaucuaaauucgguauuguugaguuuuagaaacuacaagaaaaccaaggaaaagcuacucccaggcuucagugcugcucuaccucuuguugaugcuacaagaaaaugaggcuagaaugugccgacgugcugaaauagccuugagugccaugcuaggcaugauguucugugcaggguggaguuugugucauugcuuguagucuauguguucuaucuaguccgguguccagagacauauaauaggucuggaaauuaugaaaacuuagcuuguggacguuuucugaaaaacuggaagaauacuagauagaaguacaugggaacauguauugaagucuugucucgaaaacauuuugcaugagugcuagagcaauguauacgucgcgugcauucacugccuuccucguaaccagcugaugauugguuauacauagauacugugacauagccugacuugugaaguccuaguaccagcagaguugcaaauuauaaaagauacucuuauuacuuugauaguuuagcaaagaugauacuuucucuuaguagaaaaauguauucuaaaaauaguuuguuggauuuuugcuaguaauuccagcaugcuaaagcuuuuucugauugugaaaguaucaguugcucuguggagaguacuagcaggcuuugcaacaggccgaagaaaugaaaagauaagaaugaaauugauucugccugccuuugguaugggugcuggacagagacuucuggagucucacaucagcucccauguuuuguaacauugaagcacaguuuuggaaagaaguagucagauaagaaacaauuaccuuaguccuguuggcacaacagagcugaggcauauuacagugggcggcaaaguccauacaguuuauccauaccauggggucuguugacuuacaaacagugcucgagacaagggucuacggauaaagauggagauaaguuuaaugcuggccccaaacaccauagaggccacgcacacuguuguaaaguacagagagcaucucccgcaaggauggcuuuuauggccuagaaguaaagggaaagagucugggauaaacaaaacaucaauucuggaagauacggguaaggucuggcucaucacacagaucaccggggucuaaacugcauccauugccagcauuccaggaggaggacaggucaaacaucucuuucauuugaaaggcgucuccagugcuuaugugcaugcacaagcacauuuugcccucuacaguugcuccauuuaaaauuuauggaaaacagaaaaaaaguguuuuguguugggaaaggcaacagauuuccaaauacccaguaauaccuccugcuauaauuucugcagauaagcuucuguguuguaccuuguccuuaugauaacauaaaaauucccucauaaaauuuuuguaaguuuuauuuuauucuaaaauuuucuuaagauuauucuauaguuuauuuccauuccccuuguuuuagaguuuguauuaccuuagcagugguuaauguuuguaagcucgccucuacuucuggucuuuucuugggauagguuacuagaauuaaaaugauugugcccuuuuaccauugagacagccagggauagaauguggugaggacagcugccucaggcacaaagcugaagggagaaguaugcaauucuuuaauuucuuguacuuagaaagacgaaaaacucuaccaaaagacucauaaaacugacaaaaauuuagcauguuagcaggauucaaaccaacauagcuuuuuguguaucaguagugaacucagucuagacaauaucacugacaauagacucagaaaauaaaaagagcaaaacaaaacuguaggacuaaucuuaccuaaggaagacaaagacuaccuauaauauacagcuaagaaaucaacuacagaaagcagucgaagauaggaaauucuauguccauagauugaagaauuauaucauacugcaaaagcaaucaacagauuauuccaguucccaguaaaauacuaaugaauuucuuuauaaauaagaaaaaaaucuaaauccuaaaauuuguaagugaggacucaguaaaaccauggaacuagacauuuuguagguagaaauaaggauauauugaggaccucaaacugccagagcuguuggaggguggguagagagaauaacuacuacagaaacggccuugccaauuuuauggggaccaguuguguguguggggggaggggcaguggcugacagagaagucugggaguuugaguagcuggcaguugggugggggucagaauagccugggagcugguguggggacuuugcucuguaacaggcuuguuugaguuaaucagguacuagacagccuucuagggguagcuggccucggggagguggauggggcaaaggauaagggaagacaugacuuuccugacaagcuuuacaaggguucugacaagugcuggguuuaaauuuuguuugucugcucaucauucuucuguuuccugggucaaaauccagccaaggaauaagcauagacaucaggacaucagcggcaggcagcagugcccagcaaacaaaauucacaugaaaacacaaauacuuuaauaaccaagcaggcugaggaaaaagagagcugccuguagucuguaguauaggugcuggaaguguaaacucuguucuaucuaucagcuuuguaucugcagcagugacucuuccuuaucagcguggcuuggagugcugugcauccaugguguuuccuucuagagacugagaagcccagcacgcccgcagcaguuaacagcgugcucgcucaguuucugugucguuuaacagcccccaguaucuccuccugccccucuccucgcuucccucccaucucuccauccugucuguauucuuaagagaauauuuucgaugccucugcacucugaaguccagguaaccucagaaccuggaagggcuguuguguugaauuuuggcauuauuaagcuguuauuacucaauuugggggaaaguuuccuucauuuauuaggugccuacuuuacuuaagaacguaaagaaaacuugggguuuuuuuuuguuuguuuguuuuugcaaugcuauauauaacaggaauuaauacauuaugucuguauagggccaguuuacuauguugaguuggcauugucuagaaauuaaaaacuacauuagauaguuuaaauuucauuuuuuuccaauuuguaaaaaggcuauagccugucuaaaauaugcaagguuuuaucugcguggaugagaucauagaaacuaaugaagucuuuuuuaaauacuggggaaaaaacuuauucauaauaauaaauauaauauuuuaauguuguauucuuuaaaaaaaugcaaaaauccacagugagccagauagaaacauguuacuuuagaguguuggaccugggggauuucuguguuccuucggggguuuuucagguauagcucugcuuuauauguaaacacacccagaaguucuucuccaggcuuaggaagcgcuaaggauuucugaggaguggcccugguccucacucaggagggccugcuuuugaaggcacagguggauuggauuaccaagugauuuuuguauagagcaguuauuuggagacauuuacaucuugggcuguagaaccccuguaaucacaguagcugugaaaagcaauacaaaacaaaacuggaaaaggugugguuguauucaaguguucuuugugggaauaaucaugaaaauggaauuuuucuauauauuuaauguuucuuaaaaccuccuuuugauuuuuuuccuauguaaaaauguaauaucaauucucaggucauaaaagccaggugacagcuugcauuugggauuaagagcucuuguuucuacccaaguuuagaauguuugcuuugcugcaauuuuacuuuucuuuuacuaaauuuauguacagagagucagucucuagcuugcaguaguucggcguaaugaguuuacaguggugcaaaagccggauguagucacugaaagcauuuguucuguucugcugcuuucccagggcagcagugugacauaaugcagggaugcugcguagugucagcuagccucagacccugccagucacagucacgaugauagacagcuaaugcucaauggaaaguauugugccgcuuggcuuuccuguuuauguuuaguagguaagguauguugaaugcaguuucaacuuacaguguuuaaaaaauaacuuagauuucucuuugcaaaucaaggaacauauuagggcucaaauuauguuuuaaaaaaguaucugaaaacauacuuuuuaaaaaaauacuuuuuuuuaauaauucaguuauugccccuucccauucugcccucccacaguucuucauguaauuucuccucccccugucuccaagagguuguuacccccuccucagugcccccccccacucccccuugaaaguuagacuccucuuuucccacugaggccagaccaggcagaccucugcuguauauguguccugagcuuugcaccagcucguauaugcugccugauuauuggugguucagugucagagagaucucaaggguccauguuaguugagacuaguggucuuucuaugggguugucuuccuccucagcuucuuccagccuuuccauaauucaacuacagcagucccugacuucaguuuaaugguuggguguaagucugucacagucaucugcuaguuggaccucucagaggacagccaugcuaggcuccugucuguaaacacaccauagcauuaguaauagugucaggccuuggaaccuccccuagagauggaucccaauuuagccugucgcugaaucucuuuucacucaagcucuucuccauuuuugucuaugcaguucuuuuagacaggaacaauucugggucgggguuuuugacuguggggugguaaccacaucccuccacuugaugcccugucuuugugcuggagguagauucuacaaguucccuuuccccgcugucaggcauuucaucuaaggucucucccuuugaguccugagagucucucaccucucaggucuguggugcuuucuagagccccccaccccacucccauucauucugcucacucucagggcuucucuccugucuccccuuuccccauaccugaucauaguccccucuucuccucccucucucuucucccacccaucucccuuccuuccuuugccccuaugauugcuuucuucucccucccaagugggauugaaguguccucacuugggcccuucugcuuuuuaaccuucuugaguucuguggauuguauccuaguuauucuguauauuuuggcuaauauccacuuaucaggaguauauaucaugcauauucuuuugggucugaguuaucucacucaagaugagauuuucuaguuccauccauuugccuacaaaacucaugauguccucauucuuaauagcugaauaguauuccauuguguaaaugaaccacauuuucuguauccauuccucuguuguggggacaucuggguuguuuccaaauucuggcuaccacaaagaaggcugcuaugaacauaguggaacaugugccccuguggcaugguggggcagcaaagauacuuuuuuaaagguaucucuuuuuuuguuaucgcuguuguuuaaguauucuaaaaauuuaaagaaacagacuuaagaaaccaccgcuauagcaacuguauucuuguccacagguggagacauacuucgccuugauacgcuuuuagaaugguggagagagaagaacgguuccuucuguucccggcuuaucaucaucuuagacagcgagaauucaaccccaugggugaaagaagugagaaagauuaaugaccaguauguugcaguucagggagcugagcuggcgaagacaguagauauugaagaagcugacccgccacagcugggugacuuuacuagagacuggguagaauacaacuguaacuccacaaacaacaucugcuggacugagaaggggcgcacagugagggccguguauggcgugucaaagcgcuggagcgacuacacgcugcaccugccgacaggaagcgauguggccaagcacuggauguuacacuucccucggguuacguauccguuagugcacuuggccaacugguuauguggccugaaccucuuuugggucugcaaagcuuguuuuaggugcuugaaaagguuaaaaaugaguugguuucuuccuacagugcuggacacaggacaaggcuuuaaacuugucaaaucuuaauguggacaucaaggaaggcuauuauugagaguucauguuaccauuuaucaguaacuugccauuuuuuguaugcuguauuuuuauuuguggaaaguaucuugcuacauuuguagcuguucucacuuugucuuuucuuaaguaauuaugggauguggaagauauugggaauaugcaugauuuuauacuaaaaguauauggagggucaugaaaaugcugaauguaaauguguaagagauguuaaaaguaacagugcacuuucaaauaacuuuccauuugucuccaaugaaaagaaacacaguugucugugcucuggaguggccaauggacaauuccuaaugccuuauuuucuaggcacccguuagagaauguagaccagacaaguguguuuuaagagaacuaccaguuuacuuaguaggagauucuuucaugugugugauucauauagguuuggccccaggacuguuugcagaaguauaaauacuuggagcaggaagagaccugcucauaaugacugcaaaaugcccuuuuaccaccacacccagaugucuuggcuaugaccuuuacaguacagcagaaaagccccaacugccuuugagaugaaagcauuguuaauguagguaacaauaagagcuuacaugcuacaaaguguuccuucaugguuagugagggacuuugaaaauacugguaaauuuaagaguccuucucaggguaauuuuguuuucuuaaugaguaguauuuccagcuacaaauuccuuucaaguaaauugccauucuuuucaaaaaguacacacuuacaaaaauaaauguaucaguuucucauugaccgauucuuccugucuuacguauuuaugaggaguuaguacucugccaugaaaguugcuuuucaguccuauuguaauaacuuuuuucugcugaaggucaaggaugggaacagaucauuuuguuguuguuguuguuauauaccuguauuguauuauguaaaaaaguauucauuuuggcaguuuuagguaagcauaaugguaugguuguaauuuguaaacuuuaauucaguguuuuguuggaguaaaguaggcgcugaucaggauaucuccuuaagagguaagucacuuccuguccccuuccaauuauccuuacauucuagauuuucaucuuugaaagagggagguauaauuaaaguggagauuagacuuuguuaccauggugacuucucaccguugaagccauuuuuccaugcccagagagggaagguaacggaugcaucuaccauuuucuaccaaugacuugaaaacugacauuuuauuuagaaagaagucacaccaucagggaacuuguauacuguuaucuaugcagcauugcuacagccuauuucuauguuuugaauauuguacucuuaauacuuugaauaauauuuuguuaaaaauuaauuuuucauuuaaugugaaauuaagaguuccugaauauuuuacuguauuaaaaguggaaguuauacaaaaugccuuugcuuuuagaguuuauguuugguggcauguugauuugaaaauauuuccuuauuccagaauacugaagaauugauacaauauugaaaguuaguggcauccuauauacaauauuuuuuuuaaaaaaugaaucuuguuuuacaacuagaaauacagauaguaaauuucacugaauaaaucauucauuugugugcaucuugaauuucagaugggugccauuucacaucaguuuuguauaauuuuuagguucuucagguccacaauuaaauaaggaaacuagcguugagauguuaccuugcugugcacauaucuguguaucaggagcuaggcuccccuaccuaaguggaaaggcauugcucucucuagcucuaauccuacaauuccuuucuuccuuuccauaugaaacaacucuauacacagccauggguauugucuaugaucuaauuauucuaaguauuuuucugugauugauuuuauuacaccuucccaaaugcucuuaauaauuuaacauagaaauuuguauuuuauaaauuaugaaacuaaggcaguggacucuuacaaaaaugacagaauaauaaacugcucugaagcuaauuugagacc

SEQ ID NO: 2846 - RNA, 52556 nt, Mus musculus
acauuucauuuucuuuaugaaccaauuacauaugguggacauacugaaugagaaugucauaaaggaacuggcacuguuugguaaugggcagucgccugcaucucuggaucugugggaaugaacuuaugaaaugaagggacaugaucaggugaaaugaaaaauucuaaaagucaaauucuaaauuaauuccaagacuuuaagcuuuuugugaaacacaccaaagaucaaaagcucuucaguuuacaaguaacagacaaagaauauuagaaaauuuaaauuuuuuaauaaaugugcuuuguucacaaaaugugaaaaaauacaucaaacacaaauguacauuuucagguacucuaccuccagccacuuuguaacuauaguaaaaucacaugaucuguucaccauccugaugagcccaaccaaccacaugauucucaucuggcuuuuuccuuccuuccuuccuuccuuccuuccuuccuuccuuccuuuuuuuuuuuuuuuuuuuuuuuuuuuuuuuuuuuuuuuucugagacaugguuuucuuugaguagccuuggcugucccagaacuugcuuugaagaccaggcuggcuggccuugaagucauagcucugccucccaagugcugggacuaacggcuuaagcccccaucacuuggcccaauuaucauguuuugaaauacuaaguuauuuuggagaaauugugugaaugugacaggaaauuccuuaaacuaucaauauccaggugaaauaauuuuagcguaccuauacaauauuugaaggaccuauuaacuucacugguuauuacuuauauaccucaacccauaaugacugcuuauguuucaacacuuucacauggaacuggccuguggaauauguauugguguaaguuuuaaucugaguaagcugaguuuacagugaaaaaaaaugacaucaaaucaaaucaauuuauacuaaauaguaguagaucuuauaaagagauauuuuuaaguacuuaacauauaucaugcaaacuuuggaccaaaagcaaacucaaucucaguuaacaaccagaagaauuuauagcaccaacauuuuugcugugacauaaaaguugucucaaaggugauaccuagaccaaccuuccaaaguacuguuucauuuucuuucaaagcaauuucauuugguguauuguuuccuuugcucugaggauuguaaugaguuaacaaaacagacaagaaaacagaaugguaagagagaugcuaccagaacauauuuuuguuuuauccugaacacagcgccucuucaaucuuuugucuucuuuucuuuugagggaguuuuaaaccauuauccuguagugccuaaauggaaagaaacucuaguaaugaugggacuaugugcuauugaaaguaaaugaaaauuucaaguuacuuaugacaucuuuuaacaauuaauguuuauugcauuuagacaacugacuuuucuaaaguuaguuauaaucaaguuacuuucauuaauuuagcaugugaaacugaacaugaaauauuggauacauacaaugaacacauaucuuaaaguguaagcuuauguauuucuaaauaaaauuugacauucaaaguuaacuauugcaauucacaauaagcacaaaaacauccauuuuaccagaguaaagaagugcaguuuaugaaauuuaggaucaacuacugaaaaugaaaguuucuuuuaaaaauacauaugcacacauacaacacacacauacauacacgcucauacaacauuaaccaugaaaucugaaacugugauauuucagugcaaaaaccucaguaugagguaauuuuaauguaauaaccacuugaaaaaaauccacacaguggcacucuuuaaaaugauaguuuacaugacauaugacaauugcuggcugacaagacaauguggacuaaauguucuuaacuguuuaaucuugucuuguuuggacauauauuucuaguuaaucauuugcuucugauucagaaacacagaaaggcauuuaucaauguggaaagggaaauuucccacagccaacuaauuguuuauauagucaaagaaaauuuucugcuagggcuuagaaagaauuaggauaacaaaaggacaagaccauuuuaugagauuaucaguagaggguuaauuuaaaaaaauguuaauguaauucugaacuuauagugcagcaccgcccuaaaggacaggugaggacccucucagagcuggucacagcagaauauaaccguuuacacgugcaacccuuucacaaagguguuccaggccaguguuggguaugauacauugcuucuugcuuaaacagaacauucuguaaaugcagucuaagcuuuaaaaaaauaaaaauuugcuuucacagguaaauauacugaacaccaagaccuguaucaguaagaaugucauagaaauacuacuuuggcaaugguguuugcuguacuguguucauuagaauacauucuuugggaaauaucucuuccaaugucuaauguuuccgaaugagcuuaauauaaaaauuugucaccaauuucaaaaaguucaggaauacuggauuguuagaugaaacugaguagaaacuguuuucugcagaagguaacaauuuaaagaaaaagacaaauauguaccacaaacaacuacaccaaccuaugugaaauauucaacuugugagucaucaaagugcaaucuacagcuuucuacacaucuugagguuccucaugacaaggguguaaagucaacacuaaacugaagagggaaauacauaguacauuaggcuuuacaacagcacuaaagagagaaaagguaccuuuugaaucuuaaugcaaaaugcuaaaguaacagugguuucugcuaagacagagucacucugcaugaaacuuuaagcuuccuauauaagaauaaauuuugaaauccagaaguagaaaaaauagcaaacucuguaaacguuugcauuucuucuaugcaaaccaggcuuuaaauacugaguucauguuaguauucugauuaguguaagcauuuaguuuaggaaucuggaauggaagggcuuuuugcuuuuacauuagcuuaaaaguaagaugggauccucuaacucauaaaauggaauagagcuggcuuggcuuucuccagaaucggaaucauaaggagcuucggggagcuccgugaaaccguaugcgaguuguucaucuucuagaucugaucggacauagcaggaaguguuagaauacuccuccucuucuacacuguugaaaucuugaggaauauacaacaucccuggauaguuccugcuaaccaagucacuugugguuuuaagggagguuuuucuaaaagccaugagaugcauaugagaaaauuuugaauacuugaagcgcuuaaaacccagggauucuauagcaaucuuccagcucuucaucaucauagcgugccgguucugaugggaggaaucgggagugaugaugagcaauaagccguucaggacuaacagcucaugggcuuucuugcagcaaauccaucgcugguagggugauggaaaauaggaaagaaggagagagaagacaaccacaugaaaaaguucccccggaagagcaucaauaggauuucucagcugcuucagaaaagcaucuauagcaucuugugcaagcuggaguggcugcugcagcugcagguucaggaagucacacuuauacacacucuguagaaaaaaacaaaacaaaacaacaacaacaaaaacaaaaacaaagaaggcagaguaagaauuccacagugugguacuguaugcccguaaucccaguacucaggaaccugagcuaaggacugcaugucggaagccagucugucugggugacauagggagacucugccucagaaaaaacaaaacaaaacaaacaaacaaaaaaacaacaaaacaaugucaagaauaugugcaccuugauccguaagcuucacaccaugguauuuaacaucucacagcuuuuguauagaauuuagcauucauuacuuauuccuucuaacucgacacagauuuucauuccuuccuauuuauuuauucauuuuuaaaaaauuuacuugagacaaggucuccagugguucaggguagccucaaaucuugaagucaaagcuaacccugggcuucugaacccaacuucucucacguauugggauugcgcauguguacuaccacacccuguucucaacuaaacuuaaaaaaccugaguaauuaagucuccccgauuucuaaucacauucuauacagcaaacaaauacacacaaacugucucacacaccacuacauuagggauacuuuaaagcaucuauuuggaauuuaauuuggauaagaacauacaagaguguuucauuucuaauguuguucacauuuguauucaguuuaucaauagcuagcuaaauaagcaaauauauauauuugccaagugcuuugucacagugauggaaguguaagugacagauaacuuuguauaugcagaaugaugcuagcacccuuuaaaggucaguaaaaugcuuuguacuguacuaacuccaaacauuuaaaaaugauaacacuuuuacucuuaaaaaauuaauuucugcauacuguacauuaaguuuaauuaaugccaucaaaugauuacagaaaacaacaaagaaauaaauauuucauaauuggcuaggcgcuaaacucuauagaaaauuggaauaagaaaguccuacagguuuuaggggauagccccauggguaaaagcauuugccaugauagccugaagaccugagcuuuauccccuagaacucacauaaaaagcugauguacacacccuagagccuuaguacuccuaaaauaagauggaaggcuaagacaggagauucuuuccuauguaguacaaaggcagucagacaccuaaaaguccuaagcaauacugcuacacagacaucuuuguaaccuacaaauuuuuaaauuacaauguucuuuuuucgacaguauacuuccaaauccuggcuuucuagauauacagaagguacaaaacaaagaaaauaaaauaugaucauauugguuagcuaaacauuuucagaaauaauuugcuaguugguagaaaguaaguauauguuugcuauuuuaagaauguaaagauagugcuuuuccuuguuaaggacacaaguuaaaaacagagucuguaaauaaaaccacauaccucuacagcagguacaauaucuaugccaacaguuaaaaauucuucaaacuucaaaaauggauuaaagcagcugccaacaucaaguaaucugaucuuuccugaggcuugaagcaaccuaaaaacagggacaugguuuaaaaagcacucugaacauaauacaugcaaaacuccaugcaagaagaacaguucucuguagacgaggagcucuucacucuuaggagggcuggaaggaaugcuguugguauugguaugucuaugcauuccauguuaaggaguaacgccuggaacuuccauuuaccacuauacagucuaucuuuaagagaacagcuguaaaaggugaggccauguuuucuauuucuugaacuguuuuaauguaugguauauuauaguggagucuaacagcugcuccuuuguuuaaacuucgguagcauacccuggcaugaagccacugagugcauuuuauacucacagaagaaaguaaagaacaacaacaacaacaacaacaacaacaccccacaaauagcaagcuauuauugugaaauuuuuuuuuucauagcuaagacccauacauuagauuuuugagaauguuuuguauagaaaagaaugaacucaaaucaauucucaauagucaauccaauugaaauuucaccuuaauuugucucaaugacuuaaaugagcaaaaggaaaacaauuaauaaaauagaauucuuuaaaacacugaauuuucuuauaguuugcaaguauucuucauuuccaaaacaagauaaagcaaaacaaaacaaagcagaaaauguguuagcaaauuuaaucacaaguucaguaugguucuacuggaguagccuuuguuagucccaaauccaggcugaauaaaaaccauaaaauaguaugacaguuucaacuuugaagauaugccauuuaacuaauauaauaauuuucuaaaaaauuuaugaguauacccugaaaauauaaagaaaaaacaauauaaauaauuauguaaagacagaauuuuauuuagggcuaaaguauagagauuuguuuagcuuuguucugugccuuggcuaacauuugcucuagaauagcuuuaaacuacaaaucuaaaaguguuuuuuuuuuuucuagagaagaaauguaauaaguggguuauauauucagcuaagacuuugauguacuaacauagaaauaaaaaaucaucuguuuuauuucaaguuauauguaauaaacuucuuuacuauaguauacaacaguagauaguacccaaaauaagaaucaauuaaaaaagacuuuuauaaauaaaauguaaauuuuaaaacguaccuaaacaaaguuagaggaguauaggguauuagcaauuucuccaagugaagugugugugugugugagugucuguguguguguaaaugaaacagcuuguucugacuagaaaaucaagauaaaugucagcuucuauaagaaauagccagacaccacguucucagugacaugaacugcucuggagacuugaaaggugaccuucuguaccacacagcugaccuaaggugaauucugucauauguaaacuggacuaugccuauaguaaauaaucacuugccaagugaauuaccuugucagucuuugaaauaugacaauacacugguugaaggaagauagaagccagcaaauucuuguggcauaaguuacacaugcucaggcagaccacagagucuagacaacagccagagaaacgccuuagcagauacuugugcaaauuucaauauccagaugacagcagucagaacaaaugagaaucuauaauauauguaauauuguauaucacucaaucaccauucuaaccccuauuugaggguuguagagugccaaaaucgcagcccauugcuacauguuuggcuuucagaacacugugugcaaaaaaacaaaaaacaaaaacaaaacaacaacugcgggugcagagaggggcuaauccccucaucuaagagaaaccaauuuguuccccauucucccucauuauggaaaauuaagaacauuucuuguccaaaacagaacuugaaguucucuaaaaacuaaggcuuauugagcucuggauaagauggcuuugguggaaaauuccacaccuguccucacauggugagucacagucaaaagcauaaucuuuuuacacauaugguaacaauuaaauucuagacucuuacaugaaacaaggaagcugcugucucacuucauuuccaucucuaagcuaccuccuuauaugcauauauaauuccuccaaaaaggaaaaaaaaagcacagcuguucccacuuagauaguccaccuguaauacacuuugugcaugacaucuuuugaaauuaauauucuagaauggguagcauguaaaucaugacguauaaucugaaacuuucauuuuucucuucacucaacagaaaagaacugcacauuuuaaauaaaguuaaaauaaaaacaaauuaguuuuucuaccaaacaaccagcuacuauauagaacaagccaugacuugauuugugaauagcaugcgguuuucugcuucuuguuuggguuuuagucuuaggcagugaauucaggaccuccugugcuggacagguguuuaaccacugacuuaugcucucuauucuuacaaagcuuuauacuugcaaacuacuauauauauuauuaagcaaccaaaaacaggaauauaaaaauauauaguugaaaaauuaagcauaaacuaagauaucuauaacucuacauauauuucuuuucuuuuaaaaaaucuuaacaccuguuuuuccuguugcuuagcagagaacaacgaaaaagaaguaacacuuggcaaauacuacugcucugaaugacuagaaaaaguucaugcucauguguucuaguugcugagaccacuugauauucacuuaugaaauuucuguuuuucagacuuaguagucucuuaaauacuuucuauuauuuuuaugucugcuucuuucacacacacgcagagagagagagagagaaacagagagagagagaaacagagacagggagagagagagaaagaaagagagagagagagagagagaaacagagacagggagagagagacagagacagggagagagagagagagaaagaaagagagauagagaagagagacagagagacagagagagauaguucugaugcgucacaauguccauucaccuauguuccucuguccaccaaauccuuuuccuuagucuccuuuauaccugaguuagguugccgcacuuuguauuuuauagguaugguuaucauaguguguauaguucaaucugagacccuucugaaaauaaaagaaauuuagcaaauauacaagaagacuauacaaaaauaaaacauaugaucauuccaaguuuaagcagaguagcaagugaaauuacaguaccauuagugguuaaguacucagccagcuaaaaugucuuaauugacuuucagucuuaguagccgaguaugauuauuuuuuccacugcuuuuggguuaggaacaugcaaccaaccauguucaguauacucuacuauaaaauauacuuguaugaauuuucagaaaaucaguguuagguguauggcauaaauuugaauauucuaaauaguacuauuguuuaugguaguuuuccaacaauuuucuuaugacuuaacaucaaccccuuugaugaaaaauggauuguauuuaucaaaauacaaaugauuuaaaaacaaauuuuaaaaagcauaaguauguucuacgacaaucuauaaaaaaaccuaguguuuacuacugacgacaauauucuacuuuaauggcaagacagcacugucuagugaagauucacucuuggguauaucauuugacuguaauaaccuuauaagcaauaucaaacacuagauaaagggagucacucaagcaagcacuuucucagucccaaaguuuuugccucuaggguuuaaaagaggcuauucugaagccacaaaguuucaguuaaugguuuauguuuucacuaucaauuacauuuuuauugacuaguacaacacacacacacacucucucucucucucucucucucucucucucucgcacacaucccaaaacaaaaaaugaaaacuauaacauaguugagacuagaaaaacuauuagcuuuguauuuuguaucuucuuauaauugcuaccuuuugccugaauuucauccuuccuuguugcccgauuacccuuuuuugguuucuuuucuaaauguuacucuacacccauacugaacagcugucuacauauaggcuaggauccacauaugagggaaaauguggacuuuuccuuuugaguuuggcugacuuaguguuauauauucucacucuauccauaguuuugcaaauuucaugauuucauuuuucuuuauagcuaagcaguauaccauuuuguaugcacacaacauuuucauuauugguucuucuacugagggacaucuagauuguuuuauuuccuuggauaguaaauagaagaaugacaaacauggaugugcaaauaucucagugguaggcuguggagcgcucugaauauauuucuagggggaagagucggguucuguggcagugaaugguaucuuuguggcaguuaauuucaucagauuauuugguaauaaucauccuaccuaggaugaagaagaaccucaaaguuccuuuaauuaucauuucuuauaacuagggagcagcucugaauggauagaauucagcuguacauacaaggcuggacccaucagucuucaaagcagcuccaaccccaaguccacacaggugacccuagucaacccaaagggacaacaaagaaagaaaaugacaggagagacuugaauguagcaaagagaguaguaugaagggguaggguaaacaggaagaagggagaagagagagcuuucaaaauguaucauacacaugugugaaagaacaaauuggaaaauaaguaggcaacgauuaaaacugcaaugcuauauuuuauucguucuucaacccaauucuguaaccuaugcauacaucuggacaagagcacuagagcuacuuucugcuuuaguauuuuguuaaugugauuauguuaacauuaaaauauuuauuuagaugguucaggacacugaaaagauaagucagcacacauacaggaauacaauuaauauguacuuagccagcuguguaaaacuccuaaucuauauuuccuagagcuguuucucuuaacuuuccaguuaccagcagauuuguaagauugacauuagccugcuauaaccccgccccacccccaguugagguccacaucacugacauuuagcuuuuacccuuaacagucuacaaacuucucaagguugacgaccucuuaguuguuagagccaaaaacagccaauuaguuuuuaucuuacuggugaaaacagacauuuauuucaaaagaaaacacugaagaauucauuucuuaaauuaucuuuuuauacuuuguguaaaguaucacuacguuuccauuagauuaaauuaaauugaauuucaguuaacaaaucaauaauaauuugcuuuagguaguaaaucuaaauagugauggguacauauuucacagaauuauauuaaaaauauuauaaccuuagacuaagaagauguuuaaaugauuuaaaacucuuauaaagaagguauauuuauuuuauauguuccuccaaaaaguauuuauuucaguagaaaauauuuuguacuugugauuuuccuuuaaauauaauauauuccagauauuuggaucaugauucuggucucaugacuauuucccagcugagcuguuacccagaugguauuugaauuuguauuaucauuacauucauucuugaccaauacuuugaguccuuaccagaaaggucagaauuuuggaacuuuaucuauuucuucccauuuuucaaaaguagcuugaaaaguagacacuauuggucuuuaaauuuaucuacuauuugcuuuucauauacauucauucuauauauuuuuagcuuacagcccucugaguuuaguuauuguugccaguauguucacagacacaggggauggauaaccuaagacaggccaugccucuccagaaaacuaacuccuccuccacagucagccaucuacuauaaauagcgcucagauaggaguggagccuugugagucccucucccuccaugcuggaaugcugccugacuugaucuucugcagaucucagauagggagcuacagaugcuuugaguucgugaguacaaugauccugucauaucaaaaaccacuugaccucuugaccucuaguucuuauaaucuuccacaguguucccaaagccuuguggguagggacugacuaauagaagucucauucagagcucagcacuccucagucacuuuuauguguaguuuguucaguugcgaaucucuaucagccaccacuggcuuaugaagggugugauggcuuguaacuuucaacacaaacagcagucuuauaggacgacuaucaauugagaaaaaucccuccacuaaaucuuucugaaggaaagucuggggaacauuuucuuucuuuucuuuuuuuuuuuuuaaauauuuuuuauuacauauuuuccucaauuacauuuccaaugcuaucccaaaagucccccauuuccucccccccacuucccuaaccacccauucccauuuuuuuuuggcccuggcauuccccuguacuggggcauauacaguuugcgugucuaaugggccucucuuuccagugauggccaacuaggccaucuuucgauacauaugcagcuagagucaagagcucugggguacugguuaguucauaauguugcuuuucuuuucuuuucuuuuuuuuuuuuuuuuuuuugguuugguuuuucgagacaggguuucucuguauagcccuggcuguccuggaacccacuuuguagaccaggcuggccucgaacucagaaauccaccugccucugccucccgagugcugggauuaaaggcaugcgccaccacgcccggcuuggggaacauuuuauacuggucagcacuuaagauccuaauacuuaaguggguaaaugaaguaaacaaguaauucucaaaauccuugcaaaaugagaucccaugcaaagcuauaccucaguuguugacaagcuuacaagcuucuguuucucucucucucucucucucucucucucucucucucucucucucucucucucucauuuuuuuugagauaggguuucucuguguaguucuggaacuuuugcacuauagaacaggcuggccucacacccagagauuugccugcccugcuacucaaggaauuaaaggcauguacgaucaccaucuggcuuccaaacaacauucuuguugcgcaaacacaaggaccauaucgaugaugacuuucuucucucuuauacuaaggauuaguuagcuacguguggcuauggugcauucuggaaaguaaaguagcaucacacaagcccugcuucugccacagucagcacuuaacccuucacagggcauauuuuacuucccuaauguuauaucaugucccuuguucuuuauuugauaaauugacuugugaugcauauguauauaugcacacacacauuaauacaaggaguugucaauuuauuccaguaucaauauagagaaaacaaucccaaauaaugcaaacacucaaagcaggcaaguuuacacacuggguacuuacugaacucaauucagcagucaaugugcaagagccuggagccacuuacaguuaucuauggagacaaucauacccuguccucucucacauauacuccaguuaguaauaaucauauaggaacauguguuuuccuuaauaucuaacagauuuggaucaucauagugagguacacacauuagugaaauuuuuaugaggaauacuaugcaaaaaaugagugucuuauuagcacauaaagcuuacaaauucuguaugggacaccgucuuuauuggauaagaacuaaugcccacagaaagcuuggaaagacauguacuuaaaauguaaccagguuugagggaccauuucccuuuuacuuauacaacauuuucauaucauuauuuuauugguagucaggaaaaucuauaguagugauuuuuaauauaaguaguaugauaaagauauaaaaaaguuaaacaauacugguguggugguuugaauaaugaugguccuccacaggcucauauauuugaauguuugggucccagcuugcacaguuuuuagaugaaaaauaccuagguggaacuaccuuaggcaaagucacucuaaaugcuuaguuauauaauguaaauucuggccuuuaacaaucauauuuagauacuuuccucuaaauucuacaaaaguacauuuucaccuuuacaacuaaauuagaagauaucugacuauggcaagaccugacuguagugguuaauggugacuguuugggcaucuagaauuuccuaggaacaagccccuguaccaaucuaaaggggauuaucagaaugagguuagacucugggaaggccugugauggauuaucuucauuagauuaacugagguggaaaggcccaucuuaagugugggcauuaccguacugagcuguguucuggacugaauaaaaacaagaaagcuacuuaagcacacuggcauucaucccucucugcauccuuauguggauacaagaccagcuuccucaagccccuguugcuaugucuucccuaaucaagauagacuguaaccuugaauugggaaccaaaaccaauccuucuuuaaguuaccuuuguuguguauuuuaucacagcaaugagacaaguaacuaaauacaucaacaaaucuauucuucaagaaauaacaguaaaguuagaaaaagucaugaaaaauaaccauuccuagagguuuaaaggagaggcuguagguugaaggaugucugucaugaaaacaaguugaaacgcaggcuaagagcacuaagaucugggcuaugcucccuggagcuguucuccauucugccauaccugcuucaucaggagaaaagcuuagauucuuccaggucaaauuucacugcuggagggggcuggauuggucuggaguguaggguggaaaacuuuacaguguauucucaguaaacaaagcaaacuuugauuggugcaaaaagggacaaucagcagguaggcuaggcucacguugcuaugcuagucuuggucagggugaacuuuugaaaauaaaauagauauaaaggaacuagauaugccauccgcaagaccauggcugaagaaggacuggaaaaaagugaaggguggagcuguuuugcaaacuguuuacauuucaaauguccuccucauucaacucuuacaaggacaagccaaagauggaagucaaacuggcccaaguacuagagcacaacuucuucuucuucuuuuuuaauuagauauuuucuuuauuuacauuucaaauguuaccccuuccuaguuuccccucugaaaacccccuauccugacccccucacccugcucaccaacccacccacucccacuuccuggcccuggcauuccccuauauuggggcauagaaucuucauaggacaaagggccucuccucccacugaugaccaauuaaauuaggccauccuuugcuacauaugcagcuggagccaugaguccuaccauguguuuucuuugauuggcgguuuagucccagggagcucuggggguacugacugguuaguucauauuguuguuccuccuauggggcugcaaaccucuugcaaacccagcuccuuggguccauucucuagcuccuucauugggggauucuguguagagaacaacuuguaaucuaucaguguuuggcacuacugggaauugaacuguaauagggcccuuagcacaacugacucaauaauggaagugacauucaggauguaagacagcauauagacagcaccaccugccaaaacuaaaacaaccaacuaaccuaucaaagacauuauucugaaaaagucucuaaauauacuaaccuuggcauuuggcuucuguaguuccacucugauuaacuguucuuguuaacugacauauguaaacccagaacaugguuuuuauguuuaaaagcucaucugaagaaaggcugagaaaagauccugagcagccaguguaguucuccggcuggcuaaugaagacuuuauauuggcuuaaacucaagccugaacagucuuuucaagugacuaucccacaacaguaccuagggccuuacagaugcaggcauguguucuaccacuaacuaccaacuucgaaauauucauauuucacgacacuuaagguacaagaugucucauaagucauuaaaagcuuugcaauaaucuuaaaaaugauguauucuuuccuaguuaacuaaucaaugaugugcuaauuucauuuagaugaaauuauacaucacuagguaauacuuuuaacacaguacaaggucagaguaaccuugcuaucaguucaguuuauucaaauauacuuacucaaaauuaacaguuuaauuuugcuguuuucagcauuuauuaagaauauuucuacaacuuucaaacaacuaguaaaacauaugacacaaaaauuuauucugcauuaugauauaaacauaacuuuaauagcaaugauuggaucauaauacuuauaaacuugcaagguuuuuaucuagaugcauaaagguguauguguguacauuucugaaucaacaauaacaugaugauugguuaauauuaauauuauuucuuauuucuaauuucuuaguggcuauuauaaacaauuuaacuggcuuuuaugauuuugauucuguacaaauucauaauaauuauaauauuuaauaaaccauucuuuuuaaauuuuuuauuaaggacaacaugcugcagaaacacuaaguuuucauauauuucuuaaaauaguaugauagcuuuauucuuaacauuauuauagauuugucugucucgaccuuccauauagcagaggagagaguaaccugccugcucugacuauuacccaucacaccauuuuccacugcacuccacucuacugcacuacucacauuuacacagcucccuggggaaaaugcugacgcaaauagaugaaauauacuuacucaguuauaaagucagggcuuguaaagcugagguuuguuaaaggaccuucaaguuuagaagacucgugcacguuuaaggcuggaguggucuuaguggcgaggacagcucguuuuucaucuuucucaagugcuuuucuuuucccaccauuuuggaaguacucucugcauacacuaaaaaucaaaguauuuuaaaacauuagauguggugaaguaaaaugaaaaauaaaaaaccuaaaaauaaaucacccuucauuauucaaagugugaaacuuucauaagguccuauuuuuaaaagccaaauauuacaaugauagcuauucuugguuguuaacuugacuacaucuggaauuaacuaaagcccaagugaucgggcauacuugugagggauuuuucuucacgagaucauuugagguggaaagaccuacccuaaauccagaucuucugagguaggaaccaccuuaaauuugggccaccacuucugcugacagccuacauaaaggauguggaagacggaagcacuuguacuuugccuaucugcccuugcgaaauuucccuggcuuauuccuuaauugguacucacgcuuacaucuucagggauauauaccgaagucuagcugagacauccauccuuauggacugauccacuacuggauucuuguauuucuguuggcagguugccacuguugaacugaguggcacacagccugcaagccacucuaauaaaucccauuaauuuauguauuuacuuacuuuauuuauuguuuguuuauuuguucauuggaagaugauagauauuagacagauauagaucgauguuagagagggagauagggagauagauagagucauccuaucaguucuguuccuguagagaaugcugacuaauacaauuacauuauaauuucaaauauauuauuauaaauguuaaauaguuaaaaguugcuucucccuuugccaucucuucccccauuucucugcuacaagucuagcuccagauuugcaaccuaugaccccugaccaaucaagaaaauaauacaauacuaagcauauauguaccaaacucuguuguaccaaguuuuauaaaaagcauacgaauggaauuaaagacacaaaauuaacacaaacccaguaauagcaggugacuucaaaaccuucuaauaaagaggacaucuggacaaaaacaaaccaagaaaccucaaaauuaaaggacaucauaucaaaaggcccuaggagauaccuauaauucuagaauuccacucaaacaccaaaaaauauuuauucuacucagaaacacaugaaagcuucuuuaaaguagaccacauccugggacacaaaccaaccuaaaaaaaauacagaaaacugaaauaauuccaugcauccuaucuggccauuaugcaauaaaacuuaaaaaaugacagugaauaaaacccuagggaauguagaaacucauggaaauugaacaaaucacuacggaaugaugaguggaucaaggaaaaaaaauacccagaaagaaaucaaaauauccugaaacuaaauuaaaaugaaaaccaacaaaaccuguguggcacagccaaaaaaaaaaaaaaaagacgacuuagugauacaacucaaaaauauggaaaaauaagagaaagcaaaacucagaccuacuagacaauaaguaauaacaaaaauuacaguacaaauuaaugaaauagaaguaaacaauacaaagaaucaguaaauauaaaaauuaauccuuucaaaagauaaaccagagagacauuugguucaacuagccaaaagaaacaaaugacccaaauuaacagaaccagaaaugaacaggaaacauuaccauagacuccagagaaauucagaauguuacaaaaaaaaaaaaaauacuucaaaaaaaaaaucuguacuucaaaaaaaaaucuguacuccaauagguuuggaaagugugaaagagauggauaaauuuccaagcuaucaagcauaagcuaaggagagaucuaaagccuaaacagacccagaacaaagcaggagacugaaauucuccuuuggacuaagaaaauagaaagcacauggacuaggaaaaacccaggaacaggugcauucacaggagaauucuaccaaaccuuuaaagaacuauaacuaacacuucuacucuucuguagaagcaggaauacucccaaaauuuucuugaagccugcccauaccauguaagaagacagcagcaaugaaaccaaaccaaacaaaugacaggccaauauacccagauaaacagagaugcgagcauccucaguaaaauacucucaaguuuagcauauggacauccacauaaguaguuugccaacacaaaacagucucuaugacaucuguuuugugagcuuuuuguuucacuuuguuacuuuuuggucuuaugaguuuuuuuuuuuuuuuuugauuuuauucuuuguuguuaauuuuuuauuaguuuugaagacagaaaacaaagaaacuuggaaggguaaggaggguagaggggaaauaauauggucaaaauacaaaaaagguuuugaaggaugauagacuuuauuggauucaauuuuuuuauuacagcugagaucacaucgauauacuauuugggggaagggaaagaauaagaucaaaauauacuguauaaaaauaaauuuuaaaugaaaaacaaagaucacucaccaagaucaaguuggcuucaucacggcaaugaaggauaguucaacauauuuaugccaauaaauauaauauauuguauaaaugggcuuaaagacaaaaagcucaugaucaucucaauagaugcagaaaaagccuugacaaaauaaaaauguauuuuuugaugauguuauuuugcuuuauuuaauagacuaccacuugguuuauagucauaaaacaaucaaagaccaucgcccaugaugcuuuuuaaagcauuuaucuaauguacucaaucuacuaauccacuuauauuaacacaauaaguaauucauagcuugucagccaauaucuaugauaguucauuucauaaaacuguauauaagaagaaguguuaggaaaaaaaaaguuucagaaaaauuuuccauaucuagucauaaucuuccugguuuucucugucaucaauaguugaucaccuugugaaagguauuagagcauuuccacuuaucuggaauauaaaaugacucaagggguacacaucuggggcacagcuagaaaggcugaguagcaugcuguucccuaagguggucaggccccaaaggagucuuguuagcaucaggaacaucuagccaucaccaggaaaaccagauggcaaaaggacaacauaagaacacaaucaacagccgggcgugguggcacacacccuuaaucccagcacuuggaaggcagaggcaggcagauuucugaguucaaggccagucuggucuacaaagugaguuccaggacagccagggcuacacagagaaacccugucucaaaaaaccaaaccaaccaaacaaacaaacaaaagaacacaaucaacaagagccaggguaauaugggaccaccaggauccagcuaucuugccauagcaagcccuggauuccucacuaauauuucucaacaucaagggacucaauucccuaauaaaaagacgcaggcuaacagaauagauauaaaaacaggaucuaucauucugcugcauacaagaaacacaccucaccaaugaagauagacauuaccucagaguaaagggcuggaaaaagauuuucuaagcaacagaccaaagaagcaagcuagaguagccauucuaauaacuaauagaucagaccuucaaccaaaaguaaucaaaagagauggggaagaaaacuucaugcucaaagaaaaaaauauaacaagacgacaucucaauucugaacaucuaugccccaaauacaaaagcauucacauuuguaaaagaaacauuacucaagcuuaaaucacacaucaaagcccacaaauuaauagugggagacuuuaacaccacaaucucaccaaugcacuggucauagagacagcaacuaaacagagaaauauacuaacacagguuaugaaucaaaugaaccuaacagauauauaucuacagaacauuuuacccaaacacaaaagaauauaccuuuucaauacuucaugggaccuacuccaaaccugaccaucuagcaggucauaaagauacaacaaaauugaaauaacccagccaggcuugguggcaugugccuuuaaucccagcacuugggaggcagaggcaggcagauuucugaguucgaggccagccuggucuacagagugaguuccaguacagagaaacccugucuagaaaaaaaaaaaauugaaauaacccuuuguaucuuaucagacaaccauggauuaaagcuagaauucaacaacagaaaucaaagaaagcuuacaaucuuauagaaacugaacaacucacuacugaauguguaccgaguuaaagacuaaagaaauuaggacuuucuagaauucaacaaaaaugaaggcucaacauacccaauguuuugagauaaaaugaaagcaguacuaacaagaaagucuguagcauuaagggucuucauaaagaaauuggagagauguuacuagcaauuuagcagcacaccagaaagcucuagaacaaaaagaaguaaacauaaccaagaggaguagaaggcaagaaauaaacucagggcuguaaucaacgaacuggaaacaaagagaacaauacaaagaaucuauaaauucuaagagcggguucuugagaaaaaucaacaagauagaaaaagccuuagccauucuaacuaaaaggcaaggagacaguauccaaauuaacaaaaucagaaaugaaagggggauguaacaacagacauggaggaaaucuacaucauuaggucuuaguucauaagacuguacucuacaaaauuuggaaaucuaagcaaaauggauuuuuuucuugauagauaucacuuaccacaguuaagugguaaaucaaggucagauaaacaauugaaauagaccuacaagcccuaaggaaauagaagcagucauucaaagucucccaacaaaaacagcccagggcaagaugguuuuagugaagaauucuaccagacuuaauaaagaaagagaauuugagaugaauuucccuuaugaacauugaugcaaaaauagucaauaaaguaauugcaaacugaauccaagaauacauaagguguauaccucaacacaauaaaggcaacauccagcaucaaaaauggagagaaacuuaaagcaauuccacuaaaaucagggacaagacacacugcccaauccuucuguauuuauucaacauaguacuugaaguucuagcuagugcacuaagacaacuaauggagaucaaggggauacacacuggaagggaagaagucaaauuuucacuauucacagaugauaguauacauaagugaucccaaaaacucucucagaaaacuccuacaguugauaaacaccuucagcaaaguggcuagauacaaaauuagcucaaaaaguucaguaguucuccuuuauacaaacgauaaaugggcagagaaagaaauuagggaaacaacucccuuuacaauagcuacaaauaauauaaaauaucucgggguaacucuaacuaagcaagugaaagaccugaaugacaagaucuucaagucuucaccaacuccaauuggacagagaacuaauaucuaaaauauauaaagaacucaagaaauuagacacuaacaaaccaaauaacccaguuaaaaauggguacagagcuaaacauaauacucaacagaggaaucucuaauuguugaaaauaaauguucaacguccuuaggcaucagggaaaugcaaaucacaaugacuccgagcuucuaccucacaccaaucagaauggcuaagaucaaaaacucaagggacagcagaugcuggcaaggaugugagucaagggaacccuccuccaacgcugcuaggagugcaaauguguacaaccacguuggaaaucaauuuagcacuuucucagaaaauugggaacaguucuaucucaagacccagcuauaagacuccuaggcauaugcccaaaaggugcucuaccacacuacaaagacacuugcuuaacuauguucguagcagcuuuauuuguaauagcuagaaacuagaaacagucuagcuaucccucaucagaacaauggauaaggaaaauguguuacauuuacaaaauggaaauacuauccagcuaucaaaaacaaagacaucaugaaaucugcaggcaaauggauggaacuagaaaauaacauccagagugagguagcccagauccagacaugcaugguauguccucccuuauaaguggauauuagacauaaaguacaaaauagccaugcuauaaucuacagauccauagaagcuaccuaacaaggagaguccaaggaaugaugcuugccucucacucagaagaggaaauaaaacaggcauuggagguggauggacagaaggaacugggugggaaagggugugauaaggggaauagggguggggaucaccugugggaagaguaaggagagggcugggagaaagaauggcaaucgguggagaggcaucucugucucaagcuggagacaugggauggggugguuccugggagucuacaggggugacccucucugagacuccuagcaacugggcacauggagacagacuuaagugaaccacuucuuguauccaggcaggauuuccaguagaggagggaaacauccacccacccauguuggacucaaaaguucuccuaccuacaaaaugcaaaugaauaaagauggagcagagacuaagggaaugaccaaccagugacucacccauccuaugggagagagccaaucccugacacuauuaaugauacucugcuaugcuugcagacaggagccuagcacaacugucuuccaagagucuucauucagcagcugauggagacaugcagaaacccauagccauauauuugguggagcucaggguucuaguagaaucguugggauuaggauugagggagauggagagauuaaggauaccagaagaucuacagagucaaccaacuuuggcccacugaggcucaaagggacugacucaacagccaacaagcauaaauuagcuccuuacacauucauagcagauguguaguuuggccuucaugugaguucccuaacaaauuggaguuggggcuaucucuaacccuguugccugccuuuggaucucuuuccucuagcuggaaugccuagucuggccucagugugagagaauaugcuuaguccugcugugacuugauuugccagguccuguugguaaccaugugggccuccccuucucugaugagaagggaaggagguaauggggagaagaguucuauauggaugggacugggggagaaggagaaaggggggcuucaaucgagauguaaagugaaaaaauuaaugaaaagaauaaauaaaauaaaauggcucaagaaugugaagcaacaaggucucaugugaccuuugugcacauuuaaguacauuuaugauuuuaugcauauauauauauaacaauauagauuuguuuauauaaacaguuguauuuauguguguacauauacauauacauuuaaauacacauacauguaacuauauauacauauauuauuguuacuuauauauauuuguaccaauaauaaagaaaaagaggcuuucaacuuaagaguggagagcauggguuggaggaaggugaugggagaagcuggagggaggaaaaagaagugauauaauuauauuuaguuaaaauuugaaacaaaauauaguaaaaaaugucaaauagagguaaguuuaaggacuauguaacauuuuaaauaaaugauaaaauuacuacauaauauagaaaauuaauagauuauguuuaacgcaggagaauuuuuuuugguacagaugcauguagcacauauguguguuuauguauuuaaauguauacacauacacacauuccuuuuaggacucugucuugugcuccaggcuacacugcugauguaaccuaaucaacaauuacgaauucucucaucugauuugauuaauacccuugaauggcucaaauacucagggagacacuaauuuuauugauuuuauagccuugaacacaugggcacaggguaaauuuuccugaaaagaacaccaauggcuuaugaucuaagaucaagaaucaacaaaaaauaaaauugcgaagcuucuguaaggcaaaggacacugucaacagacaaacugacaaccaacagaauaggaaaagaucauuggcaauccuacauccaauagacggcuaauauccaauauauacaaagaacucaagaaguuagacuccagagaaacaaauaacccuauuaaaaaauaggguacagagcuaaacaaagaauucucaacugagaaauaucaaauggccaagaagcaccuaaagaaauauucaacauccuuagucaucaaggaaaugcaaaucaaagaacccugagauucuaccuuauaccagucagaauggcugagaucaaaaacucagaugacagcagaugcugccaaggauguggagaaggaggaacacuccaccauugcuggugcgaaugcaagcugauacaaccacucuggaaaucaguuuggugguuccucagaaaauuggacauaguacuaccugagaacccagcuauaccacuucugggcauauacucaaaagaugcuccaacacauaacaaggacacaugcuccacuauguucauagcagccuuauuuauauuacccagaagcuagaaacaacccagaugucccucaacagaagaacggguacagaaaauguaguacuuuuacacaaugaaauacugcucagccauuaaaaacaaugacuucacgaaauuuacaaaaguggauggaacuugaaaaugucauucugggugagguaauacagccacaaaagaacacacaugguguguacucacugguaaguggcauuaggaaaaagcuuggaauaccaaugauacaacuuacagaccauaugaaggucaagaagaagaaagaccaaaguguguaugccucaguccugcuuagaaagggaaacaaaauaaucauggaagguagagggugggagggacuugggaggaagagaggaaggggagagggaaaaaagcgggggcaggaucagguaugggaggagaugggggagauauacagaagguauuacaagggauacaaauuaggaaagagacaaacaggaagaugugugugggagguaucaaaaagcuuccugucuucuucaggaaauccacaagaaacccuguagaaacucucuguacccaguccuuugaguuuuuauaagauuuccucacauacccaugauugaacucuauaaaaugugguuagacagacagggcaugaucuaaagcuaacucugugcuuaaacagagcaagaccuggauccuuuuuggucucaugaaccauucuuccguccagagcaaagaacauaacgcuuccagagugaggagggucuuccugcacacuacaaaaugguagcaucaagaaauguacucaugggcaacuagaaggcagaggguuuccaggagaguuuuaaauuuuuaauugguugcuuuugagaaggaauauggaccaggagcuucaguugaaaacagacaaacugcaucaaaauauggcacacuagaaaaguagaaauuuaaauauacaaagauuugaacaguucaaaacagaggccugaacuauuauaugguaauucaaagaguuucuaagagcagugcuaaugacuacaagacaacuaugacaagugauuuucuggauuauuccuguuaagacaacccuuucuacuuguuucaacuuaguuagcaucaaaguucagggauguaaaggugaaucauuuuaaauccacauaauuaaguuuguuucacguugcuauccuguauccaaacugaugacuagcacacagcuagucaaugaguuucuugauacuuauagcuuuccuaauauaguaagguaaugaauauaggaggacaccaugccuagguauguaaugggaccauacagguaccagaagaccaacucaaauaucuauuaacuagugaagcuaagaaggauuuacguguguaaauauaugaaaagugacuagcaaaauuuuucugcuuauaauuuguuaaaaacaaaucaaacacuuaaagcagcugagauaugaacaauuuuuccuuuuagauucuaaaaccuauuacugcuuuuauuaucauuuuuccuaccaugaaaugaaaaaaauauuuucucuauagauugcuugauauuuaaaaaauacaugguaaauaaaaauuaaagaaauaauuugccuauaacugauauuguuccuauuuaaggaggguaauggacaauguuaaucaucagccugacagauuuuagaaccauuugaaagauggcccuuugggguauuauguuaauggugaccacugaagaaggaagaagcaucuugccaauggacaggacuauucucccuggcagaagauucuaaacuauguaaguagagaaacugcacgguacacuagagaaacauucauuaucggguuuuuuugguuguuguuguuuuuuuuguuuuguuuuguuuuugacugugaauaaacuacaaccagcugcuaccagugccugcugcucugacuuucacacuaugauggacuguaccucgaaccaugagccauaggaaacccuucccccuuuaaguugcuuuagucagaguauuuuaucagagcaaccagaagagaaacuaagauaggaauugguacagaaguaggccugauaaaucuauuuaguucuuagacaacuggaacuguguuguagcuagaauguggaagaguuugaaacucuagauuagaaaagccaaaacauuaucuaugugccuccauaaaaaauauguacuuaauaaauaugcaauuaauuacggaugccuuucaacuucuaaauagaaauagaauuaaaggccaaagcuguguaaugggucaacaagaugacuccauuguuaaaagugcuguggcccaagcuuagucuccggauccuugggugcaaggagaaaaacauccgucaggaguuaucuucugauguccccucuccacaacugaaaacugugggugaggaaagcaagacagaguagguuaaugaaaucauacaugauaggaacuaagaaccacugaagcucaacuagcacagccuaggagacgugagcguugcucuuucuguggcugugauaaaauucucuugacaaaagcaaucugaggaagaaaggguuuacugugugucacaguucaugguaguugugaagucaaggcaacagaagccugacacagcuguucaggcucugcauucauacucaagaaauagacaacagagcuggcaagauggcucagggaaugaagagaaguagagcagaucaaaugaacuggaaaggaagaacgaaaacuuggcaugcacagagaaucuugugaauaucuaucuggacaauccaagauaaacaaucaugaacuaacaagaauaguaauaaaauuauguuaaguggugauauauauaaaacacaaaaaugagauguagccauaaacauuuuacacaaauacauacacuagccuauuagaauauauaaggaaaguuuauauauuuauaacaacaacaauaaaacaccuaaaaguaaaaccacuauauagaaauccuugaacuacuggcuaaaaacuagaacaaaucaaauaaacuacuuuauuucaugggcaagaugaugcaauauugugaaggcaucaguuuuuacaauuuauaauuucauccuaagaaauuaagaaaauaaguaaaccaguugauucuaaaauauacagugaaaaaauaaucaagaaaacucugggaagguuuauaaaaggguggacaggauagaugacacagaacaagaucauguaagccuaugacuaaaacacuggcaucagucagaaaucaauauacauaacaugaaaaaaauuacaggacaaaaucaacuaugagguaaacaguaaagcagguaggcaucaggauauaacacuaugaucuaguuuuucgcauaagcgauguuggagaaaugggaaaucuuauggggaaaguuauuuagggagacaaaacagaaguacugguucacacuagcuaaacuccaaacaggugaaauauauaaauacaaaaaauugaaauuauaaaaauacuagaacaaaaugaauaaauagugaguaggaauuccuauagucugcaauucagaaaaucuuucuaaauauauuuuaauugguacaguaaggaagaacauuuauaauauacaguacaacaauucaauaugcugucaauauuuauauuucuacuuuaugauauuuaagagugccacagguauaaaauacugauuauguuguucuauccaaaaauccaauagucucaaaacccaggaaaagucaguuuaauaugauccugaaggcagggaaaagcugauguucucugaagauagguaggagaaauuuuuuaguuauuaaagggaauuacuccauucagacuuugaacuggcuaggugagaccaaagguuaucuguuuuacuugucuaacaguuaaaaucaagaccuucaguucaauacagcagacuucaauauuguaggagucaguucuuuauaaccaaucuacuaguauuacaaucuauuaguaauacaugcauauguaaguguagguaugggucacauacacauacauacacacauauugcuucaauuucucuagaaacaucuaauauaauacuaaaugacauaaucucuacaauuaauuuaaaaaggcaggaaacaauauauaacuugcuacccucuacagguaagaaagaauagauguuggagggaaaauuaauacaaacacuauggaaaucaguguggcggguccucgaagcauuaauaaucuacuaccauaugaagugacuguauuuccuaugacaugaucacugcugcucuacacuagcuaggaugugaaaacaccuagaugacuaacaacuaauaacuguaaaauguuuauaccuauaugcaacgacaauuuauucagcuguaaagaaaaugaaaugaugaaaauucaguuaaauagauggagcugaaacacauuucacuaagaacaacaacccagauccagggugaaaauauucuauauucucauauguggauauuugcaucaaauuuuuauguuuguauguuuaaccuggaguacccguagaauccagaaaaccaaaaggaaacaauggcuguggagauaaaagaaaaaucuucagcagaaggcacaacacaggugauaugaauaggaaaacugaauggguagggaaguuuacauggagaaagagagggcugggaguggagagcuggggggugggggaggacugaggugugaguggggaaugaaauagcuaacauucagaauguuugagaaguucauauaaaaccuaguauuuuauaagcaucauauauaugugauauauaucauauauaauauucacauauuauauauauauacauacauauauacacacacacauauaauacacacacacacacacacacauuuuuuuuuccauguaagaguuuaauggaguuacccuacacaagggauuccucccagaaaccagagugccaaauaagucuagugauuuguaugagauaauuucuuggaaauguuggauaguggcauuccagacaccccacagacaacagaggcuacugucugcucuagacugcucacuagaacuuaagaguaagguccugcugcugaagauaccauacuuuggucacaagauagguauaucaaguuguaacugacaagaagacuccucuguucuaguugacuuucauagcacuggaggcugcuaugaaggcugcuggggugacaucaccaacacugugcacugcaauaguuaaauggcauggcaagaucuauccauggguguaagaguggcacgaagcuugugaggguaaucagccacuuucugauuaagaauuuaagacuauuccacaugaagaacugcaugccugggccuaucaauuugaccuaauauccauacuugggaagcacccaagccgcacgugucaacuuacuauuguaauuaugcuaagugaacauaauaucaaacuaccgacagugucauaauuugcuauugguaugauaaacaccaugaccuaaaguaacuuguccacugcucucucucaguguuaggaccccuccuggcuugaaccugugcaggucuagugcguccugcugaagucucuaugaguuacuugguaguauauuguuucuagcuggguuacugugucuguuuccccaccaaaccccugguaucagguaacuccuagguuuaucucagcuuacauaucccaaucacagucaaugaugauggaggucaagguaugaacuaaaggcaggacucuggaagaagaaacugaagcaaagcauaccaaggcauaguacuuaauagcuuucucuccagggcuggcucagucugcuuucuuuuauaacccagacccaucugccuaaguaccuaagggugguacugcccaaugcucuggaauuaacaaccuaucaggaaaaugccccauaggcuuuucucaguugauguucccucgucccagaugauccugguuuguguuaagcuaacaaaaauaucugaccagcacaucuagauauaugguaauuuuacauaguacuuuaauuuuaaacuuaaaguuagaugguaaacuacuucuaggcacaagaccuuguccuggacuauaguugcuauagccagguacacaccacugaaauaaacucaugucccuuuuccagcagcuaucagcuacaaauagguuuuugguuaggggcaggacccuguguccacuccucucucucagugcuaggaccccaccuggcuugaaccugugcaggucuagugcguccugcugaagucucuaugaguuacuugguaguauauuguuucuagcuggguuacugugucuguuuccccaccaaaccccugguaucagguaacuccuuuggaacucuuuuuuuuuuuuaauuuauuuuucuuaauuagguauuuucuucauuuacauuucaaaugcuaucccaaaagucccccagacccuccccaccccauuccccuaccaacccacucccacuucuuggcccuggcauucccccauacugaggcauauaaaguuugcaagaccaaggggccucucuuuccacugauggcugacuaggccaucuucugcuacauaugcagcuagagacacaagcuccggguacugguuaguucauauuguuguuccaccuauagggucacaaaccccuuuagcuccuuggguacuuucucuagcuccuccauuggggcccuguguuccauccaauagcugacugugagcauccacuucuguguuugccaggcacugggauagccuuacaagagacagcuauaucaggguccuuucagcaaaaucuugcugguguacgcaauggugucaguguuuggaggcugauuaugggauggaucccuggauauggcagucucuagaugguccauccuuucgucucagcuccaaacuuuguaacuccuuccauggguguuuuguucccaauucuaugggcauauauccagaagaugcuccaacuuauaagaaggacacaugcuccacuauguucauagcugccuuauuuauaauagccagaagcuggaaagaacacagaugucccucaacagaggaauggauacagaaaaugugguacauuuacacaagggaauacuacucagcuauuaaaaagaaugaauauaugaaauuccuaggcaaacggauggaccuggagggcaucauucugagugagguaacacauucacaaaggaacucacacaauauguacucacugauaaguggauauuagccccaaaccuaggauacccaagauauaagauacaauuugcuaaacacaugaaacucaagaagaaugaaaagcaaacuguggaacucuuuuuuauauuguauauauauuuuaaaaauguuucuauguaguagguuuccaaauggcuuucagcguuaguuaucucucugaauauucccucccucauguaauaauaaugcuaauuucuauuaccuauuccuugaaagauucccuucugucccaaugguccuuaccaauuaccuagccucuguggguauuccaaaugaaacauaaauauguaaaauuuaaaagcucuaauccacaucugagucaaacccuacaaugucuguccuuccggauuaacccuucuggaaguuacuuucuuugucuuccaauggucuccaggaccauccauucacuugcaaauuuccuuuucucuuaacaacugaacaaugaauguucuauuauguaugcauaucacacuuucauuauccauuuuuaguuuauaggugccagggcuguuucuauucccugacuacugagaacagaagagcaaucaacaaggaugagcaagugucucuggauuagacagaguccuuuacauacgcucaguggucucucgguagagccacuuucagcuucuuaagaaaucugcacacugauuuccauagaggcuguuaccaguaagaacucccaccaacaguggaguaaacauccccuaucucugcagccucucagucauccacuucaucugcauugcuauuuuuguuguuuccuuguuguuuucuuuuuuaucuuagccaucgugacuaggauaagauauuaaaauaucuaggucugauuaggccuagauaagacaucaaauaauucaguuuaaaaaggaguuuaaaaaaggaguguuauggcugagaucauuuaaagaggguucaacauccauaugacagguuccugcaucagggaaaugcuaauuaacacuuugagauuucaccuauuaauuuuuaagauuaugccugaguacucucuuuauacuauaucuacccuguacucucccacuaacaccucucaugcccucucaauuucaugaccuucuuuaauuaguaguauuggggggggggggcguguaauccagaacaaaauguguauauaagaggcuaugcugucuuuauauauaguuuuauuuuaaauuauguauaauuuacuucccuguuaauaauuuuaacacacacaugaggugggugagacugguaggauaugagaacgguggauccauaugcucuucuuaaguggaauuuggugugaggcaugcuuguaucuguaacuuccacuuguauaaugaaucugucuugcauucacuguccuuucuuuuuuuucuuuucaacuuauuuuuuuccaagaggcacuauauuuucaugugaucagaaagauaauuuuuaagucaaauugcuaagaaagaaagaaagaaagaaagaaagaaagaaagaaagaaagaaagaaagaaagaaagagagagauagauauggauuuaacuacagcuucuaagaguaacugccaaguacaaaguuguggauuuaacaaacaaacaaaaacaaaagauugacccuaccauaagacauaccuuuuaaaacuacauguaagaggguagaacaagagacuugugagacaugccugggcuauacagaaagcucuugauccagaagaaaguauguguguaagacuugucucuauuuaaauauaaagucuucaaaaaauauuaaaauaucaguuuuauguaauuuuaauuuaauuucuuuuccucuugauaaauaaaagaaaucuguguuacuuucaaaguuaguaaggacuucaaacacuacuggacaaaaucgcuuucauuuaaacauacuuaaaauuuuauacaaauuuguuguguuaaauaagacugauuuauuuauuccacuaagauuuuauuaguaauuuaguuggaauaauuuaguguauuucuuuuauaaaaauaguuacauuucaaauauaauaugaaauaaauaaacacagaaaaauauuucaauaagucauuuuauguauauguccaaagauauaaaaacauauucuuuccugaacaauuugaaagcaguuuacaaauagcaugucauuuucucccuggauucauugcuccuagggagaaaauucuucuguauagccacaacaccauuaucguuaggacaauuaucaguaaucuucuaauuuacuaaaaacaucuaguucauaaauucaaauaucuuucuuacugccuccagaauggaucuuacauuuuugucaugggggucauuagaauggccccuagaggcucauacauuugaauacuccacaacugcuccccaguugcugaaaccaguuggaaaggauuaggaaaguccuucccaguuagcaugcucaugcucaaggcugcgcacucucucugucucucucugugucucucugucucugucacucugccucaaggcuguugucucagcauggaagcucugacuacugcucugugccaugccugccugccacugccaugcuccugaccacgauggucauggacgaacacucuggaacccugauccccaauuccaugcuuccuuuuauccucugcuuagguuguggugcuuugucccagcaguagaaaagcaacucugacaagacgcuaagcuuguucuaacgaaguuagaccuugguaguucuaucucuuuacauucuuauauugauuuuuauacaacuguauuuuugcgaaaaugucaguuuuguagaaaaccucauauaguuuauuuuugauuguuguuuaaaaauggcuaacugcauuguugaaauacucuaaauagcucacugauuuuccucuuucuuucuuuccuucuuucuuucuuucuucuuucuuucuuuuuuuggaggggguaucuugcuuuucucuauuuuuuacucauauauguuuguaaugguuaugcuaaggcuuucuuugcuuguuuuagcauauaauuuauuugcaggucagcuccuuuugauucuaggucauuuacucugcuucauucuauaugugguaguuuguuaaacauugccacugugcuuauaagacacugccauaaauauuuuccccagaaaggacauacauuuuucccucucucuaauacaggagccuaggaugaaagaaggaacacuuggauccaucagaaguaauuggucuggaauggagcuaaauuaccucuuuagagagcaucaguuuccauuugguuucagauucuuugagagugaaugaucuauguaugcagagagacagcucuuaaaggaaagagcacagagauucuucucuguguuuucauuccauuccuagccccucaugcugcugcugugcacaaaucaggaauaaaauaugaggaauuauaccugugauuugguuagaguccaaucugcccaugugggaaccucagggucccacuacuauguaagccugacugacuaucccuacucagaaacacuacaacaaaugcucucccauuuaggaaaggcuuauuauuucuaguuucuucauuccuuuaagccacugugcaucguuucuccuucagauguugaaaauaaaauacuugguuuuuagauuauaaagugcuauuaagcacuucuugccccccugguuuguuugguuuuuuuuuuuuucaauuuuuuuauuagauauuuucuucauuuacaauucaaaugcuaccccaaaagucccuuauacccuccccacucccaccccugcucuccaacccacccacucccacuuccuggcccugguauuccccuguauuggggcauauaaucuuugcgagaccaagggccucuccuaccaauaauggccaauuaggccauccucugcuacauaugcagcuagagauaugagcucaggggguacugauuaguucauaguauuguuccuccuauaggguugcagaccccuucagcuccuuggguacuuucucuagcgccuucauuggggcccugucuuccaucaaauagcugacugugagcauccacuucuauauuugccaggcacucuugcccccuguuuuaacauaacuugaaaacuguuuuaucuuaaaacaacuuugcuauuugguguauucaggauucagauuucugugauuguuuccucuugguccuuggggauuuuuguuuuuguuuuuguuuuucaagacaggguucucuguguagcccuggcuuuccuggaacucacucuguauaugaggcuggccuagaacucagagaucugcuugccucugccucccaugugcugggauuaaaggcguguaccaccauacccaccuaccuuuuggugccuuuuaaucaugcuuucaauauuauuuauuucuuauaaagugaaaguugggucuagaggauuuauacaugucaaauauuuuuuacacacacaaaaaaucuuauuagaugaaauugcaucugcaucuacgagcaggcuucugaacguuuauaauaaaugccaccaacugguugagguggugcuuguagauccuuaagauaugcauuuauacuuuucuuuguaguuaguaauaauguauggaaugacauuuuagcuugacaaucaaugaagucuuuaauaguauuugaacuaaauuuauuucuguuuauuaaauaucacauuugcagaugcaaaguuaguuaaguauucuuuaauacuuauuuccugucaucauuuuguaaaucaguguuuuccuuuacaaauagauccuaaguauauauuccccaaaacugcugugguguguuuauuuaaaauucuuucuguuggagcaauuuuuacaauagauagucuguguguacugacaauugucauugugagcuguggguuugaaaugugcaguacuacuguacucucgugugugcacugauuccauccuuuaaucauuuggcugugguuguugcugcuuuguuuccugggggugugaggguggagagacaauuauaauuccaucuagccaaugagaaucaaucaaagcuugccuuuucuuuuuugagcaauuuacuucuauccaguacaaagcaaguccuuacuuuccuugccuaaagccuacaaucuaacuuuucagaguccuguuuucuuuuaaugaaagguagaauuugaaaguaacauaagauggacggcugggugucuuuuauauuauaucaacaucuuuuuuuugugaagagaauuagaaacacauaugagaaggaggcagcgaggaagagagacuaaacguccuuaaugccaaaugcucccaaauccaguguuuauugagcacugacaaggucacaaauggaaaauuuaccacauucauaaucagaauauuaaaaagacuguacacacuagaggcaagacaaggcaauaauagguuugauaaacuguggaucaaauggauagaucauauuuuauaaaaaguuuagacaaaauuaggcauguggggaaagaaguauuuucacuaagaaagacaacugaaauaaaccuagaccaaauaagacacaaagaaaaagaggaucuuaaaagugaccuacaaaagugccuguucauaaaauacucaccuacaacaccauucaaugcgaccuucacccucacaaguuuuugcccagugauuaucugccagauuuuucauugcaacagcauauucgcaaaguguuuccgcaucuucacaguguucucgccagaucuuaucaaagucucccacuguauacaaaaaaagaugaacuaaauuaacuuuauuuaaaaauguaugagcuaauuuuaagaaaauauaguuuacaaaugaaguauacaaaaaucaucaauaaacuuaauuaaugaaguuuuaaauacuacuuuauaacugauuaucugcaaucaaaauugauugcuuuaaacagauuuguaaaauugaacacacaaacacagggggcggggagaaagggagagagagagggagagggagagggacagagagcuacauaugagcuauccauucauaaagcaaauccauguugguaggguacaacuaugucuggaaaucaagcauucauuuucacaguaucuuuggguuauacagccuugaaaaagaaagaccaccacaaacaccuguuuuauacuuagucuagauauauugcauauuuauauauucuauguccucugcucuacccauuacgcuuggaucaaugcaugcuacaagcuucuccaaaguguugggcuuuugcuaauauucugaauaacaacuauaagcaagugcccagaagucacauguuucauuugcuaaaauguuuucuuugcaagcacaaggacuugagguuccauugccacagaaacaacccuggugugcuaaugaaaguuuauaauccaagagauggggagagagagagacccaucugggaccucucuggcuuacugacuauggcuggcaggccaaccuaguccaguuggccaguuccagugcagggauauaccucaacuccaaaaacaguaaaaauauaagguggaugguagcugaggaaugacaccuaaaacuguccuguguuccacacaugcacauaaacagacacacacacacagguuacuauccaguuauuacuuuuuagauuuuaagucauucaucaucacauuuaagacgaaauuucaaaggucacugugaagacugauaaugacugaagaauuauuuggccaaaugaaguucauuugccuagcaggguaaagaauuaaaauuaucugaguaccuugguucaucaucuuuaaacaaggaaauugaauccuaucacacaauauauaaaucuagguauuuauguaguaauaaaauauacauguauaagaaauagccaucugugcaguuaauuauauuuaaaacucuuuuucaaagcaagauuaagucuuucuuuuuucuguaacagaaaauaaauaaaaauagcuuaaauuuaacaaucaacacauuuauucaaauuugaaaaauagccaaauaauuuuauuuacuggauauuuuaguuccacagacuaguagauacugaauugaaaaccuauuuaauaucucuccaauuuugacuaucuccauaaaaacaaguaaggguacaaacauauucauacacacauuguucagcuaaaaugacuauaguaucaauaaauuacagacuuaguacugauuuuaauuucaaaguaaaugaaaacuaagaguaccagaguguuauacccuuaauagauuaauauuuucaauaguuauuaauauuugugaagggacugagcucuuaauuuguuacacaucaaguuagcauuauuugugucccuaaaaagcacacaaaaucuuugugaauucugaacaacuucuuucuuagagacaucugucagauacagugguuugaaacuauaaaccaagagaucucaagcagcacucugguuagcacuccuucucuacacucugggcacucauaacauuacucuucuugaauuuaccuaucagacaugauacuaaaugauucaauacaguauagcauaguuuugaaaguacuuauuauuugaguucuagaccuuaaaccuguaaaggcucuuugaaguuguuucacuacccuauauaacacauauauuauguuuguaaaugugagucauuugaauaacaauccauuaucaaauguauuucaaagaacuucuuugugcugaaaauggauuucauuccuguaagacgugauuuacaugguagauaaaacuuaaagacuuggauacuuguacuuuauuuagaagagaguccuaaccauaguaguaagggaaugggaagagggggaggggagaggggaagggaguagggagaggagaggagaggagaggagaggagaggagaggagaggagaggagaggagaggagaggagaggagaggagaggagaggagaggauuaaaacuacaaagaaggagaaaaagcuaaccacaguacaggggaguucuaggaacauugcuggugaggauaccccauccacuaugcuacuaguucuaaagggcauuguaaagggcaggaagcuugagcacuaaccauccuguuucccauuacucggggagugugaaaacguugaauucuaauacagugcuggagaaagguaacagaaaaauaguacacacucaaagcagaacucuugucauggauggugacucaccuaaauuuauccauuacaccugagaacuaaggguagcgaugugagacacuacugcccucuauuaaaacuucuucguguccuuaccacgucaucuuagagucugaaacuuccuuuccucuauaauuaacuguuagcuacaagaugcaaaggcgauuguaacuacagagagccuacuucccuauagcauuuuagaaggccucugcauacuucacauuaaccaaaacugucuuuaagucguccuuuucaucauacuucacauuaaccaaaacugucuuuaagucguccuuuucaucauacuucacauuaaccaaaacugucuuuaagucguccuuuucaugucuuuugagguucauuaucugcuuaucuaacauuuuaaaggauucaauucguauguacuugauugacaucaauuacaaacaacuuaauauuguaauauuuucauuagcagucagguuuacagucucaaugugugccgagacugaaagcuaauauguguaagcauagugaacuuuauauaaaugagaauaaacaaugaaauuuuauuuuuuaauucuuauaucauauuugcugaaaaugauuucuuuuaaaaaauguuuccuuauuguguguguguguguguguguguguguguguguguguguguaugcagguggcuguaaaggccaaaagaaggagguguuagaucaaaugaacuggaauuuuuaggcaguugugagccaccuuacuuaagagccaagagccaaguguggauucucugaagagcagcaacuucucuuaauuacugagccaucuccagccccugggugggggaaauguuaaaugcuacaugaaauaguaaaguuaaacaggaaggaaaacagaggagaguacaaaagaaacaaaauguuagugaggcuguaacaaaacggaccugaaccuaauacauuucuauucuauuauuuauuuauuuaacuuuauucgcuguauaucccacucauucccacuuccucuacuacuauuccucuacuuuccucucucaacuucaugucuacuuaggcuguguguucauugguguaggcccaucuacaggaacacggacagccucuggcauaagaaacuggauucuccucccucugcagccacugaugucaauagcuccauccaugcuggaacuggggcuggcuuguaucgugcaggucucgugcauacaauccaagcuacaguggguacaugucugugacagcacuguguugugucaucauugcaucauugcacacacauauauacacauacaguucaugauuaaaaaagaauaaacucagagaaauaucaauaauaacuuguuuaacuacaguuguaaaaucaacuuaaucauaugauuuaucuuccaaaauucuagaacaaaguucacaauaccaugucuucuacuucuacuuuuauauuuucuuuauauuuauauuucuaaauacccauuaaaaagcaacaaaacaaaacuaacuuacaguuuuaaacaugaguaaugacaacauuccaaaucaaguucaauacagaaaucgaugagccaauuauucucaaccuguguccuauagcaagauaacaguuuucaaguaaacaaguaaacucaucuuuacaugcaaaacauuuguuucaacuaaagaacagaaaagccugacagccuauuuuuaaaaauaauggcuacuaaaaaagaagaguauaucuaauuuuaaaacauugcuguauuuuuaauuauuuuaauauuaauuugcuauuaccuugcaacugucuuuguaaaaaaucaacuacaguuaaaugaguuauggaauuauccacuuuugcccugacaauucucucaugaacaaauucucugauguucuaagcuacagugcacuauguacuggauacuaucuuucuuucacaaauuaacuguucucccacuaucugacauaguacauuuauuuucuuugaaacauauaugaaaucauauuuuugagaggguuuaucugccuuucauuugauuaucucauaacaaucgcucaauacaaugcaucugccucaugcaagugcuugucauuuacucccaaauguuaccuauuaaaaacaguugugguccccaccccaaaagcauaaagggaaaaggaaacaauauguuugauuuauaacuuacauaaguuccagaaauuaacuguggugcccaguugagcgaggcaaaauauuuaaaguguuuucuauauuaaaaaccaguaaacaucaauuauaaaauacaaacaaccagcugcucaacuagaacucaguccauaggcccuugucaacagggacucaacgagucugaggguuucacaacugacacaguucuaaccgaucucugaauccaaggguuagagugcugaauccaagccuuuccugugcauguuaacauucucacgaugauuacaacguuuuugucucucucugucugcuuacugcagguggaagaggagucccaucuauugaguucuuuaguaguuguucacaaguacuuuuaagaaaaucuuuacacuuaaggaaauaauuugaguaaaaccaauaaauuauaaguucuuauaggugaggaaagucaaucugcauuauugcuuucugagaucaucuaauuagaaauuauaaucuucucaauaacuaucuucauuuucauuuuuaaagaguauaaauauaaagcaaaaaucugaaauuuaaugaguaaaacuaugacaaauuuaugacuauauuuauaaaucacaaaugguaaucaauuaauauaaaauauauagacucauaaaacucaauaccaaaauuauaucaaucuuuuuaaaagugggugaaggaacuaaagcuacuuuuuuuuccuaauuagacauacaaaaggauuaucaggcauaugcacagauggucaucaucacuaguaauuaaguaaauacuaauuaaaacuacaauguaauggcuaacauaaaaaagaagcaacuacuacauguggagaaaagggagccuauguacuauguacauagagaguacaguucagccauaaaguuucuucaaaccaucccaaagcuuccaccccguuccucucucccucucucuguauauaugagaaacaaaacccauauguaaaagagauuuuguaaucucaugaucacugugauauuaaucacaagauacagaaaaaaaaaaacccuaaguguuuaucaguguguaacaaacuaaagaauuaugggacauacauauauaaugaagcauuauucaacuuaaaaaaggaaauccugccacuaggucaugaaauacacaaucacagaaauauauauaauauguauauuauauauuuauuuauucauuuauuuauuauauauaaaauaauuaaagaagaggucaugauaaauugauuauauaaguuuuagguauauacuuugcuauuuugaugaaaauauaccuuauauaaugauuccucagcccaucugacauccauuacguaauaguaauuuggucauguaugaccauaaaaaaauuuuacuucuuuacuaauguauacauucuaaauaguuaccauacuauauauuagcucucaaaagcuuauucuuucauaacugaguuuuuaccauuugaccaaugucugugucuucaucuuuuccuccuucuuccugaaaccugaugagcauacacuacuuuguauuucuuuaagcccccugccucagauuccacauauaaaugaucuaugauacacacacacacacacacacacacacacacacacacacacacauaucuacagguacaauuuacucuacuguaucuuuaugaagcagcuuucuguaagaaacauuuauaauuaagaaacuucauucagggggcuggagagauagcuaagaaacuuagagugcuggcugcucuuccagaggucuugguucaacucccagcaaccacauggugguucacaaccaucuguaaugggaucugaagcccucuucuagugugucuaaagacaacuacaguguagugauggaccuaaaauaaauaaauaaaucuuuuuuaaaaagaaaaaaacaaacuucauccaaacuauaaaagucuuugacuacuuccuauaagggagacaguguaagaaagucaggaccuuguuacuuguuucucuuuugugaaaaauaauauauguacauauauaugaauacaaagaucacuugguugguguaauaucaaacuugcaaauaagaugacuuaugaaaagcuuuccagagcuuaaucuguauaaguagggaauugcugcacaaguaggaaccagcaaugcucagacaacucuucgguauaagaguaauaauuuauucuuuuuuuuuuuuauuauugguuauguuguuuacauuucaaauguuaucccccuucccagcuucccuucuacaaacccccuaucuccucccuuugcuucuaugagggugcuucccuacccacccacccacccccaccucacguguccuaagcuagggcaucaagccuucacaggaccaagggccucuccucccauugaugacugacuaggccacuacauaugcaguuggagccaugggucgcuccauguguacucuuugguuggugguucagucccugagagcucugggaggucugguugguugauauaguuguucuuccuauggguuaauuuauucuaagcagcuccugagauggacaugaauaaagcugcauuugcgguaccaggaagcaguguaccagugguucucagauacuauauuuuuaacuaucauaaacuugaccuucaaaauuuaacagaaugauaaaagaccauaaaauuuuuaugugugaacuuaggauauacaaauauaaacagaugcacaaacaauuaccauacuucaauauaaacuuauauccauuaaaauauuuuuaacuuuuauaggcuaaaaauauuuuuuuuuaaauuggacugagucauauaaaggaaucaaugaguaagcagagcagaguaacaagaaagagaaagaauagaauucauuucaaaccacaaagcaaagcuaguuccaugcgacuugucaaaugcuauaguaccuguguucuccaguauuuguaguuuuaaguauauaaaaggaggaauguucaaaauagguugcaucacuaaauggggaugaagucaucaaucuacucaacaagagagcauguuuacuaguuguuccuauacaggaaucuucaaucuacgugaggaacagugugguguuaggguuaguuagacaaaaggcagaguucuagcgaaaggauuacgcgaggugggaaagagauaaguaauccacaugccaacuguggcaugcacaaacacagguacuuauuuaaacagaaucugugcuaaccgguaagaaaccagccucaaugacuagcuguaggauuuuaaaaggacuagagauuucuaauuuuaaaccaaaguauuugaguuaucuauuuagggaccaccaccaccaucaucauuauuauuauuaaucaucauuaucauuauuaucucuaucgucacguuauauaguucaggcugaccucaaacucuacaacuucaugcuucaaaguguuaagugcuaggacuaaaggcauguuucuccaugcuuggguaacagcuagaauucucaauugucaaggaaacaauacauaguuaaacuucuuggguaucaguacuccucguuucaagaugaauauucuaguaaugauauaggaaugggaaugggauguggcaaaggauaagauccaagaacaaaccaauucuuaaugcugucuugaagguauacaaguaggacagcuacaaacaccaccucugauauucauguaacuugaagaugguugggauccugcuaguuuuuuuuuuuuccauuuuuuauuagguauuucgcucauuuacauuugcaaugcuauaccaaaagucccccauagccacccacccccucuccccuacccacccacuccccuuuuauggcccugguguuccccuguacuggggcauauaaaguuugcguguccaaugggccucucuuuccagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauaugguagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuugggauccugcuaguuuuagaaauucgcaagaacuacuaaaaaugggagcuccaaugauuucuuaaugccuuugucagugauuaaagucuuaaaugugagauuauucuuucaacagcacaguaugauuuuaaguuauuuuguuauaugugacaguuuccauucuaugacagaaaagguauuuccaagcaauggauuguucuaaauuaauauaaugcuauaagagauuuauguacagaggcuguuugaaacauuuaccuguauuaaugagauauuaauauaggugugauuaaauaaucuuaguucaguguccuaccccacaaagugguaaaacaguuaccugcaucagaaacagacaagaaacaguuaaacagauucuaauauccaacuuauggaauugcuuucugggggccuaagaaucggcauuuuaaaguuaacagacuagugaugcucacuaaugcgcaagaaacaucacauuagggcuggggugaagcucagagguuaagaacacugacuguucuuccagagguccugaguucaauucccagcaagcacaugguggcucacaaccaucuguagcaagagcugacacccccuucuggugugucugaagacagcuacaguauacuaacuuacauaaaaugaauaaauaauucuuuaaaaaaaaaaaaaagggaagaagcaucaucacauuagauacaggaagcuacaaacaggagauacacaaaacacugcacuuaggccaauguugacauucaaaaccaaucaguuucuuaaagaauggaauaauccuaauugucucuuuccuugaagacuuuagcuugucacuuugaguacuuuuauuguaaauaaggcauaaauaguagguaugcuugugcaggguuacagccuagcacugaggaaacucaacuucuggggcugcucccuguguucugggccagcuccacggucuucuuucacccucacccacugcaggcuccaagcagcacugagcacaucacagucagucucuuggcagugcguuugcuggguuaugcauuguccuccauacagagggcuuccaaucuucuacuuccaaagaacacauccauacucaagcacuguccccauccuuacucuacgccaucugucugucugcuguguucucgcagcacucugaauaaaccauauauaauguacuucuaagcuggaggcuuaauggcugccuacacuuucccagucaaagaaucuuacauuaucauugucuuuuccucucuuguuuuaugaaaacuucuuauucuacccuucaaaauauucuuaauuuuuuguuucaccaucaugacuauuuauuaugucuuuaucaacucuaaaucagaugagcguccauagccaccuaacucaccuccacuagauuacuuccuauuauagacuauugugcuuccacuucaguguugaguuuuugacuacuguauacuuauggaguuuugaguugugaagugucauagacaguuauacccuacagaauuccaaagauaacacuuaaaauggaccaaaggccaaaaccacaacauuuggggguuuguuugauuauuggcuuuuagccugauaaauaccaaaagaacuuacauuuauacuucgguauuuaucuucugaacucuauccaccuuccuugcagagguacaacagagacauaaugauaaaaucaaauagguaacaugcacugcacagcuacugugugcuccucacucaaucaacagcaucugugcuccuguuacugauaauccuuaguguuacugauguuaaaugaaauuauccuuucauuuccucccugcaaaaaaugucuagggcuaaguuaacuagacuuuugauggagagucuacauauuuuagcaaacaagcaaagauucucauaugcaugugugcauacacacacacuuuucugauucuauaucaugaguauuaauuaggagaaaacaugaaaagaaaacugugaaaacucacuugaaaauaaaguaagcaaaaagaacuaguucaaauuguauuggaggucacagaguuggucaauuuauuaacacagcuguggagauaacacugaaggaaaaguuuaaguuaaaaugguucaugguucuaauuuuuaaaacaauucaaauauuguacuucaugcaaaacaucaauauuauaaguuaauucuauuaauuuuaaggcuguuuugguuuuaguuuuaaaugaucucuaauuuaaaguuaccauuucucccacauuuuucucaucucaaguguuugcuacaaaugaugugagagcuagagagacggcuccaucacugacgugcuugccuuguucugaccuguguucugauccccaacaccauauaaaagaccaggcaccagucugccuagccuaauuagugaguucuagguucagagagagaccucugaugaagacacugaugcugacaucuagccaucacagguauaugcacauauacauaccuguacaaucacaaacauacaucauacacacacacacccccaaacuacaaagaaagcaaaaacaaaacugaaaaccuacauggccccaguuuaguucuuagucagguacacugaucaaguaagucugacuaaucaacaaaguccuuguuuggaaagcaaaauuaagcuagcaauuucuuauaaauaaacugucuauauacccucuaaucaaauuaaaauauucuaaguugcuauagaagucuaauuucaaaauucuguauagcaaagauauuaaauaccugauauggcaagcauacuuuccuucaucuaaacucaaucuggaaguaaaaguaguuccaagugcaguaaacagacggacucaccuccguaacacagcucccuuuccccaaccaagcccgcucaucaucgucaacucucaccagucggacagaucacaacaauggagggaaaaacccaccacagcaggaagggccuguuuucauuuuucucucuauugcauuuccaauccaaugucagagauguagacaaggaagacuuuauucuacccuacauucuuuagcuuuacuuguauucuuacuuuucaguaacugcuguuuucccuuucauucugccccagucuauucauuaccaguauaucccugagaaaacuauacucccuauugcuccacucccauagacagccccuacccgucaauuuauauccuuuuuccuuucucaacuuuuacuguuacuuccuuaucuucacguucuuuuauauucuaacaucuaugccaacaauauuaggauaagagaugagauggacacucuauuucccauaaaauaguaugcacuaauggucaacuacuucaucuucaugaaaguuacuuugaucuuaauuaaauuaaauuuggaauaugcacuaaaucuggcuaguacauuuccuguuccuaaggaagauacaaagacuguagaucugagauaaaaaugcagagaauguaaaaagaucagccaugcuugagaaccauuagugaaaauuauggcuuacauuccaauauuuuaagugagaauuuacugcauucccuaauaagaaaacuguuaugagcuuauagaauacauuuaugacugaagaccaucgguacaauacuaugccuucaaaauaaaacaucuaaaucauugauggaauucagggcauuaaaaugccaaaagaauugcuucauucaaauucuuagacuaucaggaaaucucuaccugcccaagucacaucagaucauuuguuucugaacuacugaauugcucuccauucugguaauuucuaaguaucaauccucauuaugaaccaaguguuccccuaguuagaauuugggcguaaggacauguuuaaacaugugagacuaagcaugcauaaacagcagcuuaaagagauaaugacacauuagcaguguguuaaguggaaccuauucguuuaugaauaaaugaauaacaaugaaauuauuacaaaaagguuaagaauagaaacugaauuacauacuagucauuuucuuuuaaaagaugcacagaaaauuuguacaaaauggcaugauaaauugaagaaaaguggguccacuuauuucuucauuucuucaaacaacauaaaaaccacuagagaauggcauuauguaagugcauuuugugacuaucaagaaugaugcaacuguugcuaugguaaccacucauuuuauugaauugagguugggaauuaaaguaucuucaauaaaaaaaaauucaauaccuuaauaugcuugccaagguucuucuauuaguaccuaucaaacaauagcuauuagccaucuuuggggauaucaaauggccucuauuaaaagccagggcuaaguugucaaggaaagaacuuugaauaguguuaagaauaaaaugcaucaacgacacucaaaggaagauagacuugacugaacuuucagaguaauugaaaagugugcauaacugaaaagugacaugaucucacaagucuuuguuccuucacugucauaauuucucuuuuaaccuaaauuauuaacuaguuaaaagacugacauuagaacgcugcugaguuuucauuuugcaauuaagcuaaagaaaaaucugcugaaaguagcccauuuuaacacuuuaugagaauuuuuuuccugaacacaugaagaauaaugcaaagugucaccuuccgaaucuuauaaaguugcuuuguuugagagcccccauuuacaaaaugccaggauaauucauaaaauucaacuauagacacuguuccggcauaugcgccagacgaaaagcugcccccauggaagagcggggucugcaccucuggccagcuucgaaggcaccggcaucuuucagagucucugugcuuagagacucuucaaaccugcacagucucuuaagaaccugccccagaucucuuccuggacugucuccacaaacuugaagauggagcugcgguggaggggagcuaccugccacccucuccccagugaaacacggcaggcgaagcaccuugagauccuccgcugggccugcugacuucgcagcccuggaugcccaggcaggggaggccucggcacggccuugccaaggagcgaagaggaagaggggcuguugccaagcgggcugaacaacaggcugguccagcgcagaagagcgaggggcagcuucgcuccugccagucucucgguggagucacccccacccccaccccucuucgggucuuaccugaaagccccucccucccucugagcggcggcucggugacaguggucucagcccaccgcuggggacagggccuaggcggguggcgacugcccauuagggcuccgggagccgaccgcaggaggccggccggccgaucgcggccugggcagacgugccgcccccgugugugucaaugguggccuguggggcugaaaagagcugacccagccgggggacgcgccuccccucccccgaugccuguuuaccuucgcgguacuucuugcggagccgccgaugaacgcucuucaccaccccggacagcuucuccugcuccagcuuccgcuccugcucccggggcugcgcggcguucgggggccgcuguccgcgcgcugcgccucggccacccggccccggcuccauagcgcugccgccgccgccgcugccgcugccgccgccgccccucgggccccgcggucucuccccggacggaggagguggggaagaggaggcagcagcagaggcagcaaccggaggaggccgaggagccacagcua

SEQ ID NO: 2847 - RNA, 1010 nt, Mus musculus
cuuacuccuuggaggucauguaggccaugagauucacaacucuacuguuguaguauauucauugucauaccaggaaaugagcuuuacaaaguugucuuugagagcaaugccagccccagcaucaaauguggaagagugggaguugcuguugaagacacgagagacaaccugguccucaauguaguccaagauggccuucagugggcucucagaugccugcuucaccaccuucuugaugucaucauacuuggcagguuucuccaagcagaauaucagauccacaauggauacauuguggguaggaacacagaagcccaugccagugagcuucauguucagcucugggaugaccuugccuacauccuugucagcaccaguggaugcaagagaugauguucugggcagccccacgaccaucacaccacagcuuuccagaggggccauccacagucuucugcguggcagugaugguauggaccauggucaugagcccuuccacaaugccaaaguugucauggaugaccuuggccaggggggcuaagcaguugguggugcaggaugcauugcugacaaucuugagugaguugucauauuucuugugguucacaccuaucacaaacauggggacaucagcagaaggggcggagaugaugacccuuuuggccccacccuucaagugggccccggccuucuccaugguggugaagacaccaguagacuccacaacauacucagcaccggccucaccccauuugauguuagcggggucucacuccuggaagauggugaugggcuuuccauugauaacaagcuucccauucucggccuugacucugccauugaauuugccguggguagagucauacuggaacauguagaccauguaguugaggucaaugaaggggucguuggugccaacaaucuccacuuugccauguggagagcagauggcagcccuguuaaccagaugcccaauucagccaaauccauucacaccgaccuucaccauu

SEQ ID NO: 2848 - RNA, 1107 nt, Mus musculus
ggaguucaauuuuuuuuuuuuuaacugucaaacugggcaguuuuauauuccuuuacaacuuaguaaauacuugaugacugcacgugggguaaggcugcucggugguucagaaagaccccagggacgguguuuuccugacaggguguggucuucaguagugaguggaaugacguguaugagugacgucacugucagaccagcaagaccgcauuuaugcacccaucguucucaggauuguugguaacuugggcguacuuuccccaaauaaccuugccuccuugugucacaaggcccagcucgcucacauucacuucaauaacuguaccuuuggugaucacacccaggguuguauauaauggggaugauggauucuuuuucacaccgagaauaggcaggcaaaagguagcuuucagcucagggugugugacaugggcuuuuuugaaacguagacccauaggccuaaugaaccuuucauauuuaggugguuuucuuguaaagccaucgccaacagagcagacuuuaguuuccauucucuuucaugccuucuuuuuccuuuuuccugaucgaauaacuuucaauacuucuguuucuccuugggcacgaacuuuggguagagggaccucccauuuucccgccuuuucuuuccguuucugcuuaauccuguugggaaguacuuuugcucucgacuggcccucucuguccagcagauaggcggagacugcucccugcggaaucuucucuucauccuucugcuugggguuucucuucucaugcaucuuaauagucuuuuucauuuguauuuucucagcauggcgcuguuuaugguagagcuuagccuucaggccaaucauuuuuuuuugccuucuuugaacguucaugggccucccaaccuucuuucuuucucuuuuucucaugguaguccaaacgauauccauaucguuugcggugcaauucaauauauucauuuuguggcaugaugacagccgcggagcaccggucugcgaccucccgggucucaaaaaacucuuaauuucuggaugucacugguccacgagccugccucauucagcccgggacgggaaaggguaguccuuuucggaguucaaa

SEQ ID NO: 2849 - RNA, 7191 nt, Mus musculus
cuuuccgucccugauucgucgccgcugaggccucagagucucgcggucuuugcguucgccagcgggcgcgaagcuguccggguuucugucgggcgguguuuugucuccucguugccgagcccucgcagauucccgggaccuccgggcccagcagcaugacgucugcuuuggagaacuacaucaaccguauccuccggcgggcugcugcgaccgcucaggcggcggcgggggcgggagggagcacgggaggcccggaguggugggcggugggcggaggacccggggucgggguucguggagggagcucccggccggccucggggcuuuuugcacccacagcacagaucucgguguaguucgaacuucucugcacacggccuuugaucgugugucccaacauccggaauaagaugcacuguuuuccuaagaacucugcguuugcaggucccccaagcagagauagcauacaacagauagaugcuucucagauuugggcuucaggucccauaccucugcuugaaaucuugucaugguguuuagagaguggcgaguagcuuuuaaaagcccgguugaauuuuuuaaguuagaauugcuguucuaaagucggggcaaaaccuaagacacauaguuaaauacagagagcuuuuaaugauacaagaauuauugguacuugauggcauuaauuaugacagagucuuggaugagaagguccuuuacuugcauaaaguaauucaacauuaauuagcacucaccuaguuuuuauuuuaaagcuuaagaaaugagucugccugacucagugucauagguuggaaacacugcuguuuaaaccagagucaagcggucacauacccuucucccaugugaugaacuguuuucgagguacaauugaaacaaguuuaaaaacuucaguuuucucccucaagagcaguggcaguguggaaucuugauucugucucuucuuuccuuuuuaaguaauuggaacucuuuccaggcugaaaguuuucagguuguauucuuuaagaaauacguuccuugacucgguucucagggacuguggcuguuauuacuucugauggcagaaugauuguggugagugacauuuccguuuuucucuuuccuuaggcuuauugauugcaaauuugagguaacauuucuggccuaguguucaggcaccacagcacaccuaguucacugcucuuaugauucacccauugauucauccauuuaaccuuagucucuuggcuaccuguacagauucucuaaucaaccuugaaggccucugaucugaaauggagagcugugcaauagcugauugguuuucuucuugugucucuuccuuaugccauuagagaccuuaaacgauuuacauauuauguguaugccccaauaaauugcuuaucgacgaggugauuuaaucugagaagugugucuucagugauuucauuguucuuccaaaaauaauaaaugguuuuggaaacuucaaguuagcuaugacuucacuggugguacaaucuuugggaccauugccuugucuaucaucuuugauugaaauauuuccuguaugaaauuuaaucccauguuaucccauucugugauuuuuuuuuuaagauuuauuuuugcucauguuuguucauguauguuugugugaauaucugcuguauguguggggguacacuacacaagaaggccagaagaacuagaguugcaggucuuugugagccacaauguaugggugcuuuggagaucaguauguacucuuaaccacugagccaucagagcuccuuaauuuuauuaauccuuuuauuguuuuucauaggccauaccagucaaagugacaaagacuaaaugcauaucaugugcuaaguaucuuguguguuauuuagucugacauacagccuugugaagaauuaccacuaagccucauguuuaaauaucuuguuucuguuacaaaagguuuacagagggaaagcggaacaaaaguauugacauugauuaguucuaucuuaucacaaagucgccugauaaaauauuuguguauaaaaugaaggugagaggacuuuucugggguuuuaugauaacuacuguuuaccaacuacuauaguaaauagucuaaguuuuucuuuccaguuucuagacuccaaguuucuauuuauucugauucuauauaguuauuuggaucauaaguuuaauggcugacccaagagauuacccagucaaauccaaaauaagcaauuucuucagaaacuugaauagcaucuguaauacuauauuuuccuagaaccauacaguuuuuccugcguauuuccuucagcuuaaguuucugauuauuucaguucuaauaugucuacuguaauauugagagaauucaguuugacauacacacaagacacaguguuggcagcaaggagauaugaaauauuaacuguaaguaucaccuaguuuacaguaacacuguuuacaacaaaggaguguaguuacuuuguaaucuggcucuggagcuguuuaccauccaugaaaucaaucuugagccauuuuuuccuggagcaucagcugcuuuauuugaagugggcaaaacaaaugcugacuggaaagaugaaggaaaguagaggugauucauggaguguauuucuucaguccaggaccuuucuggaagaagcaauauacagugaucuuuugcacugaugguuugugguucaccuuauuaacuuaaaaaaaaaaucauuuccccuuaaaucuguccuguuuugguucauucuuaagugcuaguuccuagaccgugugaggucacuuacuuuaagaauacuggugccugccugucccuugcaacucccaacaacucuacaacagugagauugaugguacagguuuuccccaucauaaaacaaguaggaggauaagcucugugucguggaauacuucuggacuacagaagauaguuuaucuucuuuuggacagaaaggaagacauaaguacuuggcugacaacugaaaugguuugauuuauauauucaggaccacauuauuuuuuguuuucuuuuucuuuuuuuuuuucuuuucagggaacacuaaaagguuuugaccagaccauuaacuugauuuuggaugaaagccaugagcggguguucagcucuucacagggaguagaacaagugguguugggguuauacauugugaggggcgacaauguguaaguacauaagucauuuugaguacauuugugcuacugguauguuugcuuuauggaagagagaguuucuccaacauacaugaugccauauguaucauagaauugugcacuuaacuuguuuuguagguagagcuuaucuuauauauaauucuaaaugcuguauguuuagaugccucaggggucaacuaaagugaucucacaaacaguugccuacugagauuuccugugucuuuacuuauuugagaaucgggguuugaaccuagaaucuuguacaugggaacaggcagucuacuacugagcugcggucucucuuuuuacaucuugagaccagaccuuccuaaguugcucagacugacuuucaacuuuagguuccccuacaaccgcagccuccuaguagccuaaaccaucauugugugugcccagauauguccacaaagggcccugcuuuuucaucacauuucuuaaagaggcuucuuaacgauuuggaaaauaucuuuuaaaaaaucucccauuugaauuauuuuaaaugguccacgcucauuuaacuguuacuauuuuuaguguaguggauguacuuaaugugugccacgaugcaccuauuguuuuguugaauuaggacccugacaguguaguuugagaaaggcuguaaccauuucgagcagugcucuucacagucacuuuuucuaaugaugggaagccucacgccucagcauuuuccacuguuacagcuacuugcuuuguauagcugugguguguuugaaaagcggcuggugaccaaagaacuaauuuaaaaauugauuuugggguuauguaguuuguuuguuugguuuugguuucugaggauaaccaggcugaccuggaacuuguuaccaacccagauuuacuucauuuuccuuuagcuucccagguguuagcauuauacauguaaucuaccuccuguggcuaacauuuaaguuuaaauacuaugaauagucaaaauaugacuagaggacagcaaaagacguuaguaacuaggugguuugaagggcuccguaagauguagggaagagacacugaacuuacuuuguggauaugcuuaagauuaauuuauuaauacuguacacuuauuuuaaaaugaacacaugcucuaggcacuuaacuuuaucugaaaacuguauuuugguaaauaugaucaacugauccuuaauuaaaauuguguuuacaaucuauaaaauagucucuggagaugacuuuuggcuuagauuauaacgugaguuauaaagagugauccagagcagagggccagguccucugaccacagcaguacugaugaaacacuggggguguguggacugaugauuacggugccuccugggucuauguacaaaaaauaauucagaauuaaacauuuacccuaaaccugcugggacuagagccugcuuucaggaacccaugaaaacaguuuuaagaauuuuugcuaauaaauggauuagggucuuguuaguagcuugcaauuagccccacuaccccauggagacuuuuguuugccucauauaaaugcugcagaucagaugucaguuuuccaaagagcugauguucagacucuucacaguaucucuuuacauauguuccuguccuaccuucacauuacuucuugagucccaugacauggguaauucaguucacuuagugaugagaugaaauggcuuuuguuuccuaccuuguauuuuugcugcaccuucucaguuccacauguuuaagaagcaugaaacaagaugcuguaguuaaugagacuuuagaaauguaugucaauuuauuuuagaaauguuuugacucuuuuuucucauauuaauaacagagcagucauuggggaaauagaugaagagacggauucugcacucgacuuggggaacauccgagcagagccucugaacuccguagcacacugagaccucaguguguagugagauguguguaaauccuguacagaagcgucuguccugagagugauguuuaggguuuuuaugaguguguaauugugcaguuugacuucauguugguacacuguaauauguaauuuaaauauuucuacauuuuuuauugggaaacauugccuaaauuaauaaaugugguuggcugguuuauuuuucuaccaaaugauacaaaaaucuaaggaucauuugaaaacuuagaaaauaccauuacuuuugguaauuuaauauuuaugggaaauuggcuguaaagagaacuuagacuauuauuguaacuuauacuaaugcaaauaauaguaauaaaagacacauuucuuuuugugguuuucuuuucuuuccuuuuuuuuuuuuuagaaauaccagauaguaaauggccgucuacagguaacugucauagaguuuaucccaaugugguacaguucuccaguaguuggaaaaauugugucuaaauuuuuagaugccuguuaaggucacaagauuugguuucugaaagaagauuuugugaauguuaaaugccauuguacuacugaauuuuuuuaaacuagagugaggaauaucucuauucaaagagcuuuuguuuaaugugggaaauuaguuaaaucaagagcagugcucucugcugucucucauuacuuaguccaugaggcaacuuuuguuguuuuguuuuuuguuuuuuuguuuuguuuguuuucucaagacaggguuuuucuguguagcccuagcuguccuggaacucacuuuguacaccaggcuggccuugaacucagaaauccgccugccucugccucccaagugcuaggauuaaaggcaugcaccaucaccucccggcuccgugaggcuacuuugauaaacuuuuuaaaaauauucauagaaacagugcuguaaggucuauuuaaacauuuuaagcauucaaggaacucaucaguuuaacguguggaccaaaauggauggguaucuuagugucagagagauguagacauccuuuuaauucaaauaaaauuugucuuucuaggauuuuucaguuuuuaaguggaaguauacaguuuucuaugaagaugcaauuaguaaaaauuuuagguuuuaaaggugaugcgcucuccauaacaguugguugccucucguguuaaaacauaaacagccacagauaauucauaaguguguagucuuggcugucuucccaauagaacuuuguuuacaaagcaggcgggcucuauuugcucugaaugccguaauuuuaucaauuaacccaaagucaguucaaaaggaaacgaugaugcgcaguuugugaguucugagaaaggcuuauggaaaaggcugucuucaggguuuagacccaaguuuguugaacacuuuaauauuuagaacucugauguaguuauuuugguuaauuaaguaaaauaaaaagcaguggggggaggggguggaaaguaauguaagguuucaggcuuggccucagcacuguccaaccuguaagcaguaauaaaaugaucgugaugacaacuucuaagccagggacaaaauagacauguagauauguaccacacuuguguaccuccuccacaucaucuugaugcaaagauuuaguaaguacacuaaacucuuuuaguaucaggauauaauguaugaggcugcauucauuuaaagcuacuacaaucaucuuuuaaaauagauauauaauuuaguuugauuuuuuuuuuccauuucuguuauucaguaaaauuucugucuguagguugcauaaugguaaggaugggggcaaaauagaacucaccagcugcauuuccuacauuagcuaaguaaccaucugcuaccaaccaguggcauuugggagauggaggaguugagaauucaaggauauaaguugucuucaagacaucuuccaaagauggaaggguuucauguuaaaacauuuuaaaaaucuagcauuuuaggucuuuuuguauuuuguguauuuuucauauauuuaaauuguucuuuaucuuuuuguagcauggauaaagauuuguuauaaaaaauuccacucuauuguccuacu

SEQ ID NO: 2850 - RNA, 5200 nt, Mus musculus
ugaacucugucuaucugcuagggcaccugccccacaccauuuacugugccucuuugacuuugccaucugccuuccugccgagagauuuccaugucgggcgggcuugccagugaauuccccucauacuccguuccgcuuggcugccugaauuuacacugccuuuugaugaaucuuugcuggaguuccagucacacucuaauugauuggucuagaugugagguucuggccauccucaucugcuuccauagcugagcgaaauggggcugucugugacagcucagugugccgcagauuggguaaguuugucugggagacuuggagccuaauaaaauaauggcaguggagcagaaggaaaagggaacugacuuaugucauuuaucuguagguaaguugaucacgguaaggggaagaaaaaaauggggagagaaucaauuuagguagcaaacauugccuguuggauucuuaguuuucaagucggaucuaaggaauagcuacugggacccaguuuaugaagugacucuguggucaguuucccagcccaggcuggcugcuacucacucuuaagcuuccuuccuggaaaugagaaccacuucaucuucacaugguagacuugaaaagacuguguguguguguguguguguguguguguguguguguguguguggacucagguaacagggacucguaaaacaucagcagauucucucucucccucccucucucucucucucucucucucucucucucucucucacacacacacacacacacacacacacacacacacacacacacaccacacacagaacuaaaacccacauauaauuuaacucuuaccaguuauuuuggaaaguacuuaaauuuuuuucuaaacuaaccuugcuauaucccaagucuuuccuacuacuuuucuacuuacaguaacuuuaaugauaaagucaagagauguagucaagaaaugggaaugucuauaauucauuaaaugugauagugggaguucccaaucagaaucauauguccccaaaagguugucagccuuuuccugcagaaauuacuggacaacuuauauuucuuuguaagaaagaaaaucagccauaaagagauaaaacaucauggaaaucaucugugucauuuaaguaaacauauugucacuaaaggagcgaauaaggacguaaguccuuucucauuaucaaucagucauauaugcauccauacuaugaaauaugaaauaggaauuugcuacagcucuggaucauaaaauaugaguuggcuagcaaccaugcauaugcacacauccacacacauacauaggugcacaucuacacacagacagauguagauacacaugcuguaagagaaaguuuaaauucccacgacacuauuuuguucaaacuaaauucucaucacaccaucagcugaauuuacauacaauauuuuacucaugguaggaugugcauacuuauguuuaggguagcuaaaugaaaaucauuuuaaaaaucaaacauuuuacuacuauaaaugaacaaacauuuaaugagguguccaguuggcacaggaacugaagagguagaaagcuagggcgugucacaguuuguuuaaccuuucucuaauugucguaccaugaacacgacaguaugcugauagccugauacaguggagugauuuguaaggauucucuuaaagaaagugggauaguucaauagacugguguucuuuccuuuccuuuacauuucuuuuauuuucaaauagccgaauuuagacuuuuuucauaaaggaaggacaauuuuuuuuuuaaagauuuucuaugcgguuuuuuuuuuuuuuuuuuuuuuuuuuuuugcuuucugaagagacagugugccaaggaaguuguaacuugagaguuggaauuucucuagagcuuugauucuccuaggucuaaguuccugguaacgauccaguggcuauuuacugauuacggcugggcugcuguuuccaacgccugcugguaucaggguagaggcauacuuauugcuagcaaggaauccauccuguaacagggucauaggaaauaacgcaagugugacacuucccaucguaucacagggugugugugugugugugugguaggggagugguucuuuaaucccuagagagauccacagagaggaagcaauuucuuuucucuccagaaauagugcugacugaacgugaagucuggauucacguaauggcuuugugacugugagaggagaugaggugacugaggacagagaggugaugcaggugugugggaagaggcaggagaggcaagauucgacgccaugacuguuacagaguaaaaagcuguguuugucaauuugcugucaagcacaaugcucugcuggcccaguggaguggcauuuugaauagaauuucuaguuuccaguuuguauauuauguucagguuuaguuacggaaauuuuaggcuauucaguuaaguaauaauuuuaugugaacacugaaaacuacaaguagugguaguauuucuguggaacauugggacacuuuguuugaaauuuaaauuugacuagauauuuuguuuuuuaaaaaauugauuaauuuuaauuuaguuuuugcagcaggguuucacuauguaguccugacuguccuggagcucacuauguagaccaggcuggccuugaacucacagagauccucuugcuucugucuccugggugauaggauuaaggcaugaaccaccuugcauuuuaucuggauauuuuaaacuuacaauauagugaagguuucuugauuuagcaaaauacuuuuuuuugucuuauuaggcaugugcuuucagaagauaaaagguaagagcauauauacagcuugaguauguguguuugacacagaacuaguaagaaaugacuggucuguccucuuccuuggagccucucaguagacccccacccagauuugagaugcuguguacaaguuaccaguggcaagaggaagauaaacuuuauuuagaaaccaaaucuuaguuucuccuuugcucgaugacugggcagcccugaagcagucaauugagucacacaguacucuaucacaguuaugagaaguuacugugucauugugggcaacagccaucauguuauauauacauaagacuuguuuaaaaaaaaagaaaacaaacaaacaaacaaacaaaccccaagaccuccauuagccuccuuuguuucacgauugugaagagccacucuuugugcucagaagccagcaaaacucuuucguguaaccaaacaccuugcugucccuuccucuccacacuguagguaggacagguacaguggcuuauggagagaggagcugucaucugucuuaccacacucccgaguuuugcuuuuaacucuggaauugaugaguaggugcuuguaaaugcacaucuuauucacauuaugaccauuaaacaagcaagaaagaacuguuuucccuuuccugagcagucagggacuuuuauuuuuaauauuuucagcuggagagagcuacagcaugugccacacaccaaauaauacuuaaugaagugcaugcuucuuuagaaggggcuucugccucccuggcaaugagcaggauauacaaauauguuacuccgcacucaaauuguaaugauacccauguagugaauguugguugagaaagcuacagguguggugagaauggcagcugugauucccaucacuguagucaagagcuuccuaacaggagaccucgcugaaguuauaaaggcagaauaggggcagagaagugucaagagguauagucaaguagaggccaugacagcugccccguguugcaauauuuuaaauguaaugaggucucuccuacugaaguugauuaagcuucugaagacaauuuguugggaguauuagugaaauaacuacaguuguuuucuucuugcuuagaaagagggggauauucucaguuuuucaacuggcaggugaggaauuuaaucccacuacaccccaaagaggcucuucugcucauuugaggcuuccaggaaagccuaguagauuuuuaaacuuuacugcgcacucaguaaauggaaauguuuggaaauggugaaauaaauugcaugcuagcuaaggccacacuuuuggagacucugacuucaguguucugggguucaccagagcuucaggguguuucuggauuccagauggucgccugacuccaauugcacuaagaguuggccacgugaggcuacuaaucugucccucauuucuuauuuacuaugaagauggaggacaaacauacuuuuaaagaccuuucaucuguauuacuaguuuaucauguagguguguaucagguaggugaacccgaggaauuuauggauuaugcagaaagcauuuaccaaucaaucuucuagcaauggaagauaguuuuuauuuuuauuaugggcauucauuucuuccuuuuaaugucaaagccucccuuguaugaagaaaauuuuaggucucucaggaacuguguggcagcacacaguuuggauggugguuuguuucagucgcaggcagcugaccuugcgcuugccugugaacacaagggaugaaagcggcucucuuagcuccucccacaauuucugaagccacucuguugcuggagugggggccaucugauggaugacugacgauuuccuuggcaauuuguguggauggcuguccuuguuugcuuuuuagaacuugucuuagugauuugcuuaggaggaauguuaauacccuaggccugggcauccauauugacucucauggucuugaccucgguaccaaccaauuuagagcacgucuccuugucacuuuggccacacagcagacaggugaugauggauacagaccacagcugcauguugccccgaagacuccgauuauuaguuuuucucaaagauguugcuuggaucuaagguaacacaauuuuuggugaguuuuuuguuuguuuguuuguuuuuguuuuuguuuuuuguuuuuuuuuuuuguuuuguuuuuccuauuugacgaggaaacaaauggucacagcaacauauacuacugugagggauaaaaccuaaucuuuuaugggagcaacaugagccagcaauuuuaauuuuuaagugugaaaaugucuuacuucugaaauagaagauagguuuggagcuaugcuuugugauucuugugaugugguuccugugauacccuacugaaucucuagu

SEQ ID NO: 2851 - RNA, 26473 nt, Mus musculus
cagugaggcaagcgccgucaggcgccaaaguggagccuuuuuuuuuuuccuuugcuuuuuuuuuuuuuuuuuuccuuugccggagucgagcgggugcugcuagcggaggcgccauauuggaagggacaaaacuccggcgacagcgagugacacaaauaaaccccuggacccguucguccccgcaacagucagggccgcgauguuguaccuagaggacuauuuggaaagugagugcgcggcgccggcgacgcggcgggcgggaucggcggcgggcgggagcgcgaguggccgggcgggcgggauggcgggagggagggggagcgggggauguuucuuucucacgguaacuggcagccucguugugagccgcccccccucccguacgcacgcacgcacgcacgcacacacgcgugacgccagcgcgucccuucgccguuggccccgcccucugacggacugugccuuugacagugauugagcagcuuccgauggaccuacgggaccgcuucacggagaugcgcgagauggaucugcaggugcagaguaaguggcgcgucuccacggccccgcgcagccccggccucccucgggcaucgccuggcggguccuccgcgcuacuuuuuucaggcugugacaaggaggcggcgggcacaccguaccguuaacacgcggggcacagcaaacacaguuguuuguguacugcauggagaugacgacacugcaccgcaguggaaacucgcgugauuuucagaagguuugcacccgagccuggauguggaaacuuggaguucugcauucagacuuaaaaguucauuacauuccgaauuucuccagagcaaagacauagaagggcaggcuagggacccuagugaacucggaaggccgaacuuugacaaguugcauauuaauggaagacacuuagagcugugaacagcguggacacuuucucagccagaaaugagugagagagaucagauuuuaaggaaaucacccgcuugcucuuuagaaaacuguagacguuugauaggcuucccuacugguuucuuguuuuguaaacacaaccacgucauucaggcuggucucacacucaauauguauaauaauccuaggcuugcucuaaucuccucaucuuccugcuucugucugccuagugcuuggcuuuucaggcauugcuagcauugauuuuuuuuucugucagugcuuggcagcuuuauaugugacuuauuuccaaaaugaaccuuguucuuuugaaaaagccagacuggaagaggcucaaagguaacuugaguuugcuaagggcuuguucucuucauucaugagccucugccgccccugccccucauuucuguaccuuuugucccugacuguacuuuucucaucucagucucugggucaucucuuggggugcauugcccaauagccucucauaaaucugugacuggaauaggugugcuuuuucucuuugacuuuaagguaguugcaguaguaaacaccugccgaagcacauuccagagggauugaguagaguuugguggcagacagauuuggguucacucuuggacaggacgacuaggacaacuccagccuugcugccuggggggcuuguuugcuuuuuuuuuuuuuuuuuaaaaacugacagucuucugaggauuuaaacuaauacagauaauuaggauguauaaugcccauuacaaauagguuuagaauaaaggauaauuuaaaacauugucaaucauucaauuuuuuuaaaauucugggauaguuuggauuuaaucuauucauaugacagugcuuucaaguuuacuuacuuuguaauccuggaguuuucggaaacaaagugaguaggcauuaaaaguaucagcaugucuaaggucagcaaguagcugaaaguaaauuguguuuuaaaaaugaagauuaacuagagcaucucagcaucuuuuguaaaaagccauccugcucugaaguugcuuaaaugauaaauauagugggcaauuuuuucuccauuuccaucacaacaaaaccccuuuuauuuauuuuuuuagcagccauccacugaggucauuauuuuugaccugggcuuuggcgaagccuuacauagaguaaauagcauguguguugagugaauaaauggugagcaacggucacauauauuaucccuuccugugagaggacgugaugaggugcuuggugcuauggagcaaguguugacucugucaucacuauuuuuauuaaaagaaguaugagaccgucccaggaguacuguuaguaagcagcucugauugccguaaccagcugacuuaaugccauuaacuuugauuucagugcggguuguggcguagauccuugucuguacaauucacucuaccuugauuacuggaaaauguuuugaaauagcaaagucaguacagaauauuucagcuuuuuaaaaacuaauguaaugaaggcaccacugcuuauaguacaaaauguguauaagcuaaaacagaguugucagaugucuuuuuuuuuuccucaaaucaaagcaguuuggucggcuaaguaugaaauguuuuauugugucagaugcaauggaucaacuagaacaaagagucagugaguucuuuaugaaugcaaagaagaauaaacccgaguggcgagaagaacagauggcauccaucaaaaaaguaagugugaugccuuggauaauuggcagucacauugggacccucuaggagagauaguaacauuacguagauaccuggauauggagugagggcacuuaugagggacuugggggcacuugguauauucuagaccagcaguucaacucaaggggcagaugaccuuuucacagggucaccaaaagccaucggaaaacacauuacgauucagaaauaaucucauggccgaggcucaccacagcaugaggaccuuuguuaaagggucacaauauugggaagguagagaagcacugguuuagagcuuccuguaauucuugcugaaguuuauuuuagcuagugcugcgggccuuaaggcuguccugcagauuagauuacagauuagauaagcucacuagugcugugugugugugggaucuggugucuuucuuuaguggugucuaggaacacaacuuucaaagauuuggcuuugguccucacugccauguagcugugugaccugggucaagucuuuuaacaugaggaagaauaaguccuuacgccuaaccuucauauaaaguuuucagggauauacagaaacauuaaucuuggaacugaaaauuucaauuguguuauuuauucuuccaucuguaaggaagauugucuguuaggaggggguaaaccagcuuuccuaagagaagugguccuggcuuguaaaaaugcccagguaugaaggagguuagagcuugcguauguuaaccuagaguucacuagccauccuuuucaacuagaaguuuuucaugcagcacaauuugaacauacccccaaaagucuaguugucuguggaaacacauaggguacuuuuuucuuuuaugaaaagaaaauuuuugguuuuuaaaaauaauauggagaaauauaaauuauaauuugagugguauuaauugauaaccuaauuuaaaacuagagcugucaaccaauuggauagcagaaaccuacagaucagaauccuuucuauggcuguaguuuugcuguaaaaauuggggcaggagagauggcucaaugauuaagaacacugacuacucuuuuagaagaccagauuuuauuuccagcauccacaugaugguucauaaccauccacaacugcaauucaagaggaucugaugcccuccucuaacuucugugggcauuuggcacacaaacaugcauucaggcagcacacuuacacacauaagauauuuuuucaaguuguuaaaauggaguguucuguguuuugauauguuagcuaacucuuagcacucuuguucuuuuauaacucccuaggaaagaggguggacuugccauaauuuucuuuuauauauguguuuucugagguuuuugagcaucuuuuaauuuuuggcauuguacuucauuucuaaugucccaacccucccgaccuuggaggcuuguuauugcuaauaugaugagcaagugauaacaagguauaguagugagaaagcauaugaguauguauguauguaugcuagaauuaccagugcuuaaaaugaaacuauuuuuccuuaggacuacuauaaagcuuuggaagaugcagaugagaaaguacaguuggcaaaccagauuuaugauuugguaaguaaaagagugugcauauuauacugugugugcuagaauucuggacuuuauuuuauuagcuuaaguguaaacugaaguguugcucccuugaucauauuuaauuugagaguucagugucugugucuugguuuccuugaggaagagucauagacguucacaguuuaguuaauaggucaagagccacacaccucagugaagacuacuguacauuuguggguaauauuuuuagaaagaacugguuuuauuuaauuaauccuauucuaccauuuugcaauuguuucuaugauaacaugugauuaagaguacuauguuagugagagucuuugguggccugaugaaaaugagaaagaggauuucccauaucacuguuuaccuagaggaugcuaauacauaguuggcaucaccugggucaucagauuacacccaaaagaaaagaaagaaaagaaaacauaaagcagacucuguguuaagugugugcuucuuguuuugauaauuuugucuuacuguuuuuuuuuuuuaauuuguuuuaacuuuguuuuuuggggguuuuuguuuuauguuuuuguuguuguuugagagagcaaacaugaaguugggugaguagggagguggggggaaaucugggaggagaggagaugggggaggagaaagaauaugaugaaauguauguaaaaaggguuuuuuuuaauaaaaagaaaagaaaggaaaaaagguguuucucucuugcaagaguaauuccaaaaguuugaaaucacugagagauacacuuaggugugcuucucagauuguugucaugaugacaucaguaccauaugauaggaagcgucuguuuuuaaugcaaagccucuucuuacuguguauuauaggaaaacuaauuucuuuuuguaucagaguaacuccauguucaguuugguugaguugaacuuugacauuuugacucuuucuuggcuuugcagugccuacuagauacaguuuuccauugaaagauacaugcgaauauaguuguuagugagcaugacacauuauagagauguuccagguucaucucucuuacuggugcacaguacucuaaccaaaagcaacuuagaggaaggaaagauuuguuucagcuuauagguuauaguuccuaguaacacuuacuaguuguugagaaaaguugggacaggaaguagaaguauaagccaugaaggaacucuacuagcuggcucauacagacuccugcuuagccagcuuauacagcugucagucacuugcccaagaaaugguaccacccacaguggauaggaccuucucgccucacuuaacaauuaccacacacacaccccuccaggcaugccuaaaggcuuaccugaucaggcugcuuuucucucagaugacucuaggcucaaguugacaguuaaagcuagcuaggacaaaggucacucacccgccuuauauaugcugcaugcaaaugcuugcauuaaacuaagaaaauuguaucagauaaguguguuuuuauguagugaaauacauuuuuaaucuugguaaagcaacaacuuguuguaaagaaacucacguaaaacaaaagggaagcuuucuugaaaagccagugcuuccugcuucgaggcuucggaaaaugcucgucauucuccucucucaucccacccccugcugaaacagucuucucaagaagccguccuccccccuucaugucuucucuucccgugggacccacuuuaguuagaguucuuugcacugacaugggugggaggguauuuccuggagcauggguaacuucucagagacuccagcacugaagaaaguggcacccacaccccccagucaccacaacugacaucagagcaaccaucaggaagggggcaaccucauaggucccucuuauccaugaugaacauuggcaggcucaauguugugcaaguaaccacagcuacagugacuucaccaguauagcccuaugaaguccagaaauauauucuuuguuucgcaucucccuaucuguggcugaaccaggacguuccaggcccuggaagggacuauauggauggauaucuauuuagggcugaacacacccuaucccauguucuuggcaucuugauuaguuacgcuucucugcauuaagugcuacaaacugcggucagaagguuucucugacugaggcugaggacagcacuaacuuguacauauuaacuugagcauuuagaaggaaauuugacaugaccauuuagcaaaaaccauaguaguauguuuuccucuagggucuuuggccuccccaucccaugaccguuugaccagauuuauaguauuuaggcauuuuuuuuccauccugggcuucaaauccaaucagaaagcugucuguuauucccauaaugucaaggcauuuuuggcccagagggggcucaucuugucugacagguugucacagcacauggcuuacaguuggguaaacacuguugaugccuuuucuccuacagcagugugcgugguguccucuggcucugggacagccuccagcucaguuccagcuugaggucucugucuagggauucuagggcucauagggaacuggcgaguaaguacuaagauauaguucuacgcggugccuguggaguuuagaagaggauuuggaaccuucggaguugaagacaggcugaugugagcuagcaaccaaacauguccccuggaaagcaguguaugcuccuaaccauugagucaucuccccagccccugcauaguagguuucaaaaauccccuuuugagauuaaauuaucuuuacauuuccucugcuuuacacugcuuacaacauuuagugacuucuauaacagugcuguucacuccuuaagaaacagggcccuuauuccuguuuguucuccggugagccaucuuaccugcugguuauuuguaucuucugugaacucuguuccccuccacuugcugccuucugaacuggagcaucgugugcaguuucuccaccucugaaauaccuuuuguguuugcgucucauuuucuuccacguuguaugugucugugugugucuguguguuuguguaugugugugugucugugugugugucuguguauguguguguguguguguguguaaucugagauucuaguggaguucuuggacuuuuguccacguuuuucauuaccuucuucaucacuaccaucucagagugcccucacuugcugugacagucccugaaguugcuugucgcgcacacaguuggagauacuagcagcugagaggcuggugccccugaaaacuugguguccucacuuuuauuuggaucguuucacuaggcauugugcaguaguccuuguguuugaauggaaucuguuucuuuucucuucuuccccaugguuacuuccuaaacagugccauuuccuacaaacaucccggcucugggcaugugaucuuggcuuucauagacaggauuacaguuugaggcuucuuagugaacauuucuucaauuauugcuaugccauuaucucuuccugucagguauacaauugucaucucuuucuguagcuuuacuuauuuaccuuuuacuccuccuccuccuccuccuccuccuccuccuccuccuccuccuccacuaccaccacccugcagucugucuguuguacuuuuaucucucugucucagaugggaucucuccauuuaguccaggcuagccuugaacuuaggaauggucacuuuuacuacaguuccuaucccuucccguaccaucuuugacuuggcuauaucacauaugcauucuauuccuuaucuucagacauugcguucuuuucuuauauuuucuugucgucuucuuguauaccacagcauuuaaacauucacuucuccccuaucuuuuaaagacacuuagacaggcacccaaacaaauauuguucuaaaauagucuuucuugaguuucucauucaggcuuuuggguguucuuuaucuucagauaauuccucaguccuuugcaacuuguauucuuuuugccaguccccaaaacuucaguugauaacuucugggccaccauagucccgauacugcuguuuaccauucucuuucuguuggcauucuugcucauguaucauuacuugaaggcuguacaaaaauguugccaccuuuguggccuuuccuggucucuaaugucagaaugaugguguuccuugauucuguccuuacccuuacucuuuuuuauucuucaaggguugcucagagaucauuuuuacccucucuuaauucucugucaagcgcaaggaagaucagcuaccauaucauacaauaaguuguugggucagaugcucuuucuauuaccuacccacauaccuuccacacaagcagagaacuacuucucaauuaccuucccaucuagucucuuaguuucauaaacgagacagcaauuccaucagcacgagcauuucugaguugcugagucauauuaucugagacugucgugucugucacuucuccccaucucuaucucagaagguccacugaugugugcuuuccacacuggggcacuaaaaguccuccucccggccuccuucccaccucuuccaccucaucgccguggacugaucuuucacucacaaguaauuucuccacuuguuuaaacugcuguaguucaaguacuucuuagaaacaggauuguaguuagaaagauuagaguauauaugcacuaaacuguaauguagguuuugacuaauguauguacuauugugaccauagucuagaaaaaauaaagagcgagcauugcuggccucuagaaacccacuuugcaccaauucuagugccugagcccucuaauauauucaucacuuacugaaaagacuuagagucgcuuucuaaaugguguuucaacuuugauuugucauguuuauucuuuuuuaaaauacaagcauuuuggggaauuuaaaacaugaaaacugcauuuucaucauuuuuaccuuuuuuucccucuaagucauccucccaugugccccccauugccuuucaaaucuaugacuucucucucucucucucucucucucucucugucucucucucucugucucuccaucucucucucucucucucucucucucucucucucucucucucucucucucucucucucuguguguguguguguguguguguaagggggagaucugauacuggcucuaucuaucauugcucauguguacauaucuuagagcuaaccacugggauugaauaaccaacuagaagagaacugauuccucuuuucucaccagcuguugauuuccuguagcucucgucuagggguugugaaacuccugacaguugguguuuauuauguagauuuacuuaagcaaucuuaagcaauaguauuguugaaauuccaugggugcagccucccuguuauguguagaagacaucuaccauuagaugucccgguccucuggcacuuaaaaucuuuucacucacccccucuuuccaugauuuuuccugaguccccacguccuaccgagcuauaaagcuuaccacccauaccagugacuagcauagcaagacauccccagugcugcacuggugacucugaccuugggagugacuaacagcugccuuguuggacucaaggcuugcucuuuaggaggaaauccaugucgcuagaguaaaccuguccacauacucauggccuuauagaccuuauagacccuagacaaggcgcuacugcugccauguuuccuaaaccaauauaauuuauaauuacacuuuuaauauuuuucuauaagcccacagauaguguugaucuuacuccucauccauggagcucuguugagcagauggaggcuauugcagagauccacaacuggugagacgaggagaaugagugaccguggggugcccggccccaguugauaaaucuaucaugcuuauucuaaagugcgcagucaucaugcuggggccuugauugaaagccauuugcauuuugcuccagacuuaguuuacuguguucugcaggcuccuccuugauccuggcuuugcucgguucuuuuuaguauucuuuuaaauaugcucucaugguuuuguuuaguuucuucaauuuagaucauuuauuuuuucuaauguauauaauuugugaaagaauuuuucuaaaggaagaguaggagauuuguucugcaaaaagagacauuuuaaaauacuaaaucuuugacuuggcaagauggcucagguuguuggcaccugcugccaagccuaaugaccuggauuuuaucccuugagccuaugugguggagggagcgagcggacucucaugaguuggccucugaccucugcaggcuuguagaauacuugaguagacuuuacuaaucugaagguucaaaaugugaaauguuccccagaaaugaagcuuuguggucguuguaaaaaauuugugcgcacaccuuuaaucccagcucuuaggaggcagagacagguggauuucugaguucgaggccagccuggucuacauagugaguuccaggacagccagggcuacacagagaaacccuguuucgaaaaaaaccaaaaaaacaaaaauuaaaaaaauuaaaaauuucacaucugauuuuauuucauaucuuaacaggcuauaggcaaagcaggauauggauauucccuuuagauuguguauauaugagaugaaaguuuguguugaguuugauucuguccucaggauaucucauugguuuauguaaagcuccccaaaucugaaaccauuugaaaucugaaacaccucugcagcccugcauagacauuucuuauaagagacacugaaccugucuguagucagauuucaugauucaguguuuuguauaaaacaauguuuucauuaugccuuuucauacuguaacacuuuauuugcuuuuaacaucauuaguaaauggauggauuccuuugaccagcacuauacugguuaugucauuuauuaaagaaagaaaccauguugucuaugaguaagaaacauuuagaaacaaaaaguuaccuugcuagauaauuuccuaaaaccuaauaauauauaagcagucauuaaacacuuguuuauauuccuuaaucaaauaucacucucuaagaaguuuuacauugcaguacccaauaaaguugauuuauaugcacucugccaaaaugacagcuuucauugauacuugagugcuuuucauagucuggcauuucucaccacucuugaauuugcuucugcuuauauaucccggccuguaccugaggugauugcaucucagacccacauucugccuguaaauuugagaguucuucaccugauacucuaaauaagaaaaacuguucugugagucugaccuuuugauuggucuucagucccugcugucuuuuaggaagaugguuagauguagcuuauguuccagggccucaaguacuugguuaagccaaagacagaauaguucacauuuucaucuaaucauagaauuuagagauggaaagaacuauuuuaugacuuaucagaggauacucugaugucauuacucucucguaccacuaccaguucaccuucuuuauuacagcaaaauccuuucauagcuaaaacucaucugcuauugcuauggauuuucucugaggaccuaauaaacuacccuuucuuuaaggucaagcuagaugucuaaauuggaaaauucgacuaucugggaagcaauuguccauguagaaacuuuuuaaaaguuauauguuaguuuaauguagguccuucacugacacauucuaaaaucugaacauugaaaaacagagagauucaauagagaaaaauaaaauauuagaacucuaaaauauuaagaaauggguuuauuguuguuuuauacaaagaggccaaguguggcuaaauucuuuauucuuaugaacaugccgaguaauguuugcuugccucagaaaaguucuagaaaaggaccauagucuaaauuuagccauugugccuggguuacaggaugauuugaagcuguagaagagagagcguuuguggagagcauuuauuguuguuagguagggaacugaucaguaagacucuugugcuuaacuuugaguuuggaaucugugacaaacacgcucucucucuuaaguagacuaauacccucauuauuaccguaaaccauccuuacaaguucagguauguguagaggggcugcaaaaaucuaagaccuugcucuacgcagcaccugugugcuccuggcagugauuagcaagaacggcucuuccauucauguggguugagggagggugugagauuucaguuguguucaauuuaucuccuuuuauaguucuugacuacuguuugcauagcuguaucuugaggguuuuagcuaaaguuuaaucaucuggucaacuuauucucugacuuuuaauuuuauuuuaguaaguauaacaaugauaaauuuaagagaaauaaucuacauuuucuaggaguugcuuaaaaaguaauuaguucacaguugcuuuugaaucaagaagccauuuccagagcugccacccucagggugguuauggcugcucuugccugcugagguaggaaauuaguuuugagaauuuuuaauucuuugaauucucuugcuucuucugagucaucuagugaacuucaucaauaauauauuuaguaaaacaauuucaaguagagagaugggaugaauuaaguguaugguguggggagaucgccugcauacacuuuagagcacccucccaggcgagacucuagcauucugccucucuagugucugugguacagacuagaccauucuuucuuucacuuggaacauacuguuugauaauguccauauuuaugauugcucuauuccaucuauuuacaugcagugugcucuucccuucgucauuucuuccuuggugucuaccucggcccagggucacauggcuaugucuuuuauucuuguacugcagaaccucucccuuugcugcauuuacauucuaucuucuucuucuggaagacucuuuauaauguuaaaaauguuaggaauuuugauuuguuggcuaaauucuaauuucacagaagaugcauuaucuucugugaaggcugggauuuuuuuuacagucuucacaugcccuccauuagcgccaaguacauaguagaaacucaauguuuauugcaaguuuaauuuuagauaaauugguggaagguuuucauugugguguuuuagaaugaauauauuuaauuauucugaguucccuuaagauuaaauuuugacaaugaaagagacacuauacuguugaguaauggauuuuguggucauucuuuuguugaaagcaagaugcuauuacaggaugcucaaaaguuaucuguguccuauuaauuggaguaacugucccaaacauaugacaccaguaggcuuuaaauauuauaacuaugacuucugccaaauucugaagaguaauuuguauguaaauauuaagugauaaccuggcuuuaaauggcugaaaaaucauaaagaaauauguugaaaguuguugcuaacauacaaaauauaagcaauaggacacuauuacuaguuuuucuauuugaauuaugugucucuacacuuaaaaagaaaaaaaaaguuuauuccuauaacaguuucagaaggaauuagauauaaaugaggaugcauuaucuacuauauguagauaauuaaaucuuaagucuguaaugcaacagcuguauaaucuugggcauguuacuuaacucaucugagccaguaggguuuauuguuuuuggugggggguugguuuuguuuguuuugcuuuacuuugcuuucuguuuucacauggaaagaggauugccuuaaauuuuagggugaggacaucuguccuagcuauuuucaugucaccuugguacaagcuggagucaucuuggaaaaggaaaccucaguugagaaaauaugcccaccagacuggccugggaacaagggucucuccugggaagagaccccaggaccaaggcaacuguuagaauagaauacccuuccugagguuucuucauuauccuaugucagggagcgcgucagcacucaggaggccaccagaucuguagcugagagagacucugggccuggcaugagcuuuugaaaccucaaagcucaaccccagugacagaccuccuccagcaaggccacaccuccuaacccuuuucucacagucccacucccuggugacaaagcauucaaauagauaagccaaauggggugccauuuuuauucagacuacugcagcaagacuggcacauucucuuaacugaugcauguggcagggcccagaacccacuccugagcacuguauggaagcagacugcacaagccaugagggacaagccaguaagcagcauccucuauggccucugcaccagcuccugccuccugaguuucuacccugacuucuaggacaauggacuaaaagucauaaauuaaaauaaaccaccccuaaaguugcucuuggucaugguguuugaucacagaaacagaaaaauaauuaggacagcauguaaagcacagggcagaguguuaccuggccuuuaguagcaucugaccugcuucuugucuuugguagguuuuguccuccucuuccucauguuaggaacaaaguacuuaauugaauaacuuacugaaaauuuguucuucauuuuauauacuguaguacauuggucauaggguuuguuauuguugagagaggcgggggggggggggguagggagaguaggagagggagggggagggaaggagagagugaguguuaguuuaaccauucacuauauagcucuggcuggccuggaaaucacuauauagacuaugcuggccuggaauuuacaauguagaucaugcuggccuggaacucagagaugccugugcaccucuuaauucccaauuacaggcauacaccaccacacccagcaacucguuuguuuuuugagauuuacuuuuguacuuuuguauuuuaauuaugcauauucuuguuuaucuguuauaugggucuauguauaugggaacagugccuguggaggcuggaauggaaccccugcaacuggggccaaaaguugugagccaucccaugugggugauggggaccuaaccucugguguucucuaagaguauaaacauuucuuacauauaccugagccauuucuccaucuucuacugucccuagucuuaacagugauccagucagccuagauuuugaaaauauuguauuguaaaaguauuguaauaaaaauaucuuuuaaagaauuugauggauauuuauuuaucuuuaaaauagcagguuuggaaagaugauaauguuugacauuaaucuuauaaauauguuaggacacuaccuaguugaaggucauaauuuuccuguuauugaaagauucauaaguaaaugauaaaaaugaaaauuggccauaacuaagccaagcuuuuucaaaaauguagauuuuaguuaaaauuuccuuuuguuuauuaauguuugcacaaacaaugguccacuucccugccuuguagcauugauugcauuugugccuuuguuggcugaguaucuucccuguuaguguaaggcaguuugcaugcaguguggccggcccuaggauaaaguugagacagaagguaacugaggcacguuuugagaaguugccgguucuccaacccucggaacccuguacuuacuuugauucucacagccccucuucugaaaaucggucacagaacauuuucuaacagauuugagacgcugcuuucuuaaaaauaagguuggggagguauuagcccaguacccuaagauguacuaagauauaaguugauugacuagucuaaagauaugaagcagacuuaccuuuuaguaaagaaauauugaaguuucgucauuaaaccguacguuagcugggccccagauuuugguguuaucuuuuuuuuuuuuuuuuugaaacagguagaucgccacuugagaaagcuggaucaggaacuggccaaguuuaaaauggagcuggaagccgauaaugcuggaauuacagaaauacuagagaggcguaaguacaauuuaugguuuuucuauucaucuuggagaguaguuuucucacaaaagccugccagaucauauaugcccuuugguggaugguagccucugggucccguaacuucuaggcuggcauugaagucuuugggucauaaacacugagagaaauaugcaggcugucagucuacucccucuuuaugaagacagcauacaaagucuuucacuuuguguuguuuucacuuugagaugggaccaugcucuauaaagcuugccgccccagccuccagaccauugugauucugagcacgugugcccacauugcagacuccgugcguguuuaauauucacauaugcuaaguuagaagagaguuagagaaagaaagaggcaaaaacguccaaguguccaccgugagagccaagccacgccuguucugugugcuucagcuggcagaauuguugagacuuugcuccucaccuguguggacugagguuuccaucgcuuccguaacacuuccucuugugcugggaagucuuuucaaaaccuccccuuaucagaagaacucauccuaauauuuuuuguuguuguuacaaacuugaugugcuuaaacuuagucccagauaucgccugggcuuaacucuggggauuccccaaaacgugagcaagacagauuuguguuuaaccaguuucacaucuucucuagccuaacuaggugagguagcaguuuguugguagggucagaggagguagucacugagugguaagggaaccaaguuaguccucagggugauuucuaugacaguccaguuaggguccaacagugcucauuccuugguacauucaccagccaguucguuucuauugccagguaguggguuucaugacuacaggguaccuaagcuguguuuacaggggcgugugaggucaacuggacaagccaggcgugugucuguuaguaaggauugcaauuuuaaauuuaaaaguagauccuugcuucacauaauuaucuucuuuauuggugauacuuuuauuccggaggaaaccuaucugaggauaauagauacuggggaacaaaaugaaauguuguaugacuaccuuugaagguuucuuucuuuuggaaaugcuguugguggcugugaguaagccuugccugccuccucacugcuucagggaguuaaugacacaaccacuaaggacccagacacaggaaacggaacggggucacauacaaacuguucauccugcccugacaucacuguaucucaacgaaucuuuaauaaguugagagaauuucuucagaaguguuuuaaagcuugggauuggggguuaugcccuuuacuguuugcaagcaaagcccuaagcucuuuuuuggaacugucaguauugcaguuaauuuuugugauugaauuucuuuguaugcaguaauauccccaucaccuagaccuuuaggauaacguauuaaaaggcuuucaauuuuguuacuagauugaauuuuuuagaucucaccauuaauagaguuguaauguccuuuuuucuauuugugugacacucagcaugaaagauucucuaauuagauauuagcauaucuugagcuguuguguacuuacggugaauacugagaagugagucuuccuccuuagagagaggacugcucaggaugcaauugaagauaguaacucucuacaugucugucuaaagugauaugccagagguuggcagucauaugugagggccaucuuguuggggguugguuuaaguggagauucuauagugacguuuaauccuggauugucucuguguccccucucuaggaucuuuggaauuagaugcuccuucgcagccagugaacaaucaccacgcucauucacauacucccguggaaaguaagucuggcucaaguacaguuuagcaccguacaugucaccuguaugugcucuuuuauuagcucuacauaagcaaaugagaaacguccuuuccuuucccuuuuuaaaaaaucggcuuuuuccaaacccagacacuauugcauaugccagcaagauuuuacugaagggacccugguguagcugacucguaugaggcuaugccagugccugguaaauacagaaguggaugcucauagucaucuauaagauggaacacagggcccccaauggagaagcuagagaaagcacccaaggagcuggaggggccugcaacccuauagguggaacaacauuaugaacuaacaaguacccccagagcucgugucucuagcugcauauguaucaaaagauggccuagucagccaucauugggaagagaggccccuuggucuugcaaacuuuauaugccccaguacaggggaacgccagggccaagaaucgggguggguggguaggggagcagggugggggaaggguauagggaauuuucgggauaguauuugaaauguauauaaagaaaauaccuaauaaaagaaaaaagaaaaacaauaggcuuuuuaucacaguuuacguguagacuuuuccauuuaagcaacauauauuuaauuugggaacaggaagucuguucuaucagcgcagaaacagauauaaaacagaucuagggagugguacgacugacccaacuauacacuucuucauguaggcccauuucuuucagccuugccuuccagugcuuagcugauauuuaucaugugauaaaaucuuguuauuagugaguuagugaaaggggauuauugguugcuacauuuuuuugacaagucaauucaauaggaaagagagguaaauuggaagcuauucuaaaugguaggcaguauauuaugauggacuuucucucgugauaaugugaaaccguaguacaucguggauugucuuuaguuuuuugcuccuaguuucuaaagugcuugaaaugucuguucucuccaugaaccacgugacaaagacuguuugcuuguccccuccuuggugagcauaaugguccauuucacaaggaaccgagaucauaacuguacugauuuauaaagggguggaaguauuccucucuguaguccccugaaguuugaaauuugugaauuuucuuuuuauucagaaaggaaauauaauccaacuucucaccaugcagcagcagaccauaucccugagaagaaauucaaaucugaagcgcugcuguccacccuuacaucugacgcuuccaaggagaacacgcugggugaguuucguuucucgaaagugguaauuugcuuguuuuguuuauguuggaguaagggauagaggagcgcucaagauuauaauccacacaugugcuaccucugaagucuacaugaugauaagaaggaaaaggaaaauugccuuguauuuuccaguugauucaaucccuaaaguauaugaagaauuuaaauuuaauuuuauauauggggaaauaauuuauuucaaucucagaaaccuuauguacucugcaaccauuuuuuuuucuucuuuacagguugucggaacaauaauuccacagcuuccugcaacaaugcuuacaaugugaacucgucccagccccuggccuccuauaacauugguucauuaucuucaggggcuggcgcaggggccaucaccauggcggcagcacaggccgugcaagcgacagcacagguaauagucguggguagaggcaagugcuacauugguucccgucacuggcaaaccucaguaggagccacuagguguuagcagagcuuucagacaucauauaguuugagcuugaaguugcccuuuuaggcuaguugguguuuuaguaauaaugcagagaaguuauuggguauagagugacgcaucaugccaucacguugacccuuuucccaguuagugcacaaguuaccuuccugucaucaugaggacaauaucugcucuuucuguaccauugggcuuuuaucuguguuggcugcaguuagcucauuucugugguuugcacauagugugaguuaagacauucuauuucccauguuuauucucagcuuagcaugaaaaagacucugaauuuuuccaugacuuaaauaaccauaacguguaacacuuaaagagaaaauacauauuuacauauauugauguugucaauacaugucuacuuaagaugaaagaagggcgaagaacaucgaguuuaaaagccaguuacgaagcauuuaagaacaaugacuuccagcugggaaaagaauuuuccauacccagagaaacagcuggcuacuccuccucaucggcacucaugacaaccuuaacccagaaugccaguuccuccgccacggacucgcggaguggcaggaagagcaaguaaguuucccauggcagugugugucuuuguucaggguuguuguguggagcuguauccauacaucuccagggauuaaccacagcaggguacagugauccaggcuaaacacuggauaggcaguuggcucucugcacugccucaccuugaaggcaggaaggaagucuuucaacuguuagagucauuuguaauuguucucaguuaguauguaagugacuucuuuuuacuuucuuuuguucuuucagauaaaucauuuugugucacuauuccuauuuguaguuuagguguuuagaaacccuguugucugagcugaaggaggaaaaaaaggugcaaaugagagaccaaaagaguuaguuauauaauaaugcauuuuaucuuuauuuuaaauguauuacuucucuacaaaaaucuccugaaagaaugaucaauguaaagucuccacagaacuauuauacaucuuaaaauugauaugaauugcccacauuuaguugaacuccuuauaauaaauuucugcauguucucuggaauagaguuggugguaaacaguuguugaauucugauacucucagauccagcuauacuugauaggcauaggacacaugccaacugauguuaggacuuugccaaauacuuuucuauauuuguacuuagguuuugauaagaacucuuuaauuuacuguaaaaacauuaacagugugagaugguguaacuauuauucuugaacacuaccaaaaauuuuaagucaaugguagauaguaaccuuaauuuagaaauuaucuuuaaaaguugaaacauuuuaagagaauuuucuucuauuuauuuuaaauagaagauuuuaagaauauuuccuucuuaaaggaacuuauucuccagaaaacaaaaauuguaaaccuagggucagaccucagcguguccuuuccuucugugucggugacgaggagucacucucggggaaccgccccagugaacaaaugcagcuaaucugccuguaauuuuuucagaaacaacaccaagucuucaagccagcagucgucguccuccuccuccucgucguccucuuccuccuuaucucuguguucaucgucuucaacuguaguacaagaaguuucccagcaagcaacuguagugcccgaaucugacuccaacagucaagucgauuggacuuacgacccaaaugaaccucgguauugcaucuguaaucagguaaaaacaucuacugcgugucuauaaaaguguagucugaagaaacaagaaagaaaacuguuuuaaaaucagcacauuuuuaugcuaacuaaaaucaagaaugguuuacuuauaauuuuugucuuauaaaaguaguauacuugcuauaaauaccaagaaucaugaauuacguguaaugccaacuuucccauacaaccuauggugagacauuugaugucacaacacauguacccugcaugcaugauguaauacaccacuggcccuguggccuacacagcagaaacuccucccugugauggugcuagagacugggagacccgugacgaaggcgcugguugacuagcuaccuguaaggccagucugugaguuuaaaggcagugcuuuucuacugaguauuuaugaaucagagagaagaagaucauauugugcgguuaugcaaugugccaacuucuuaaaugcuuguaacauacuuguaauguuuaucuaauuuucuuugaaccagguauccuauggagagauggugggaugugauaaccaagaugugaguauugcauuuuccuauauugggauguaaaaagguguagaugacugaguauuugucuuauuaauucuauuucccaguuuggcaaucagguuuucauuugggauaacuacauuauccugaugaaagcaucuacauggcuuuaaugauuuuccugcuucaguguuucaagguggcacuacucguguuagguucagauuaaauucacaaggauuacuguuggcaguucgaagugcuuucuuuucuuuccgccuaagauacuguauuuaccagaguccugguuguuuaucacauugaagaagugaaacuaaaaggaugcucagggauaauuaagaccuaaugugugguuauuucccucguuauuauagcauucggcauucucuccacaaggggcuuggacuguacaagccaucucugaugggaaacugagaggagauuugagaaaggacuccugcuuccugugcuaggaaggguauuaguuacuugauaagaacaccgugacagaaagcaacuuaaggcagggaagggugucucuugacuuacaguuccaaagggaacacaguccaucuuggcagggcacgcauggcagcaggaguguaagguuggccugguagucaggaagccaccugauucuguuucacccacccagggcaggcagaagggaggcagcaaguacaaguggaggcaggguuugaaaccuccaguccaccccagugaagcacuucuagcaaggcacccuguccuaaagguucuagaaacuuccuaaacagugcuacuagcuggggaccaacugagcuuaucaggggaauuucauauucaaaccacaaaagggauuuaauuuuggauaaagaugcauguuugauuaaauacuguuugauugucuagggauuuuggcucauuccuuaacugcccuacagcaguuuuguaccugcuacucccuuuuguaccuguuguacuucaaaggaguagcaugaaacuugugaccuuggugacaccaguggugucagaauucugauauuaacaagagucacaaggacaguuguguguguuccuucccugacagggugggugcacugugcucuugagaagggcacagucccuccccagcugucccgugcagucacuuguguguguauguggggagguguuuuaaagcaguguccucuggggucccuguaguuccuccagugcuguuguggguaucaagccuuccuguggagugaagaauuuuuuaauauuucagagaggaggguuuccuccauaucucuggauagagcaccagaaaggaaacacagccaguugauggcuuuaguuacagcuagcucauuccacuuccagagaacaauuauggcuggauauuuuuaagucuuuuacauguuuuccuucuucauguaagauucauauucuuuauucuuuggaagauggcaccgccuggcggcuguccaaguugauggcagcaaauaaauguccauucuuuagugcucagguacuagaguccaugacgucucucuuaucaaagaagcauccuuuuccuggguguccauguuuucauccaugaggcacaucugucagacucaguaacguuuagucacugccaggguccaagaaaucugaucgcacagaccuaaguuugguuaaaugaaauacuguguguccuaagcauuuuuuuuauuauuauuaucuguucuuuagaaauaccaacuccccuuuuuuuuuuaaauuuucucuuccaguguccaauagagugguuccacuauggguguguuggcuugaccgaagcgccgaaggggaagugguucuguccgcagugcaccgcugccaugaagagaagaggcagucggcacaaauagagagggacucuauugucacugcaggaaggaggaacuccagcucgccauuuuauacaggacgcuaggaggaaagacacgaggacgaagaagcagcucaucuccaggccaccacuuagaggauuacagagacaauccuauaagaucuugaacuugaauuuuaugaguuguauuuuaauaauguaaguaaauuauuuaugcacuccuggugugcuaugaauauuauuccaguuagccuuggauuauuucuguggccaacauaugcagacauuuguacuccaaccauuuucucaaaguaaugggcauucuauaauuuaaacuucaaagaauuccaacgaugaagauuuuaagaaaguauuuuauauucaacagguauauucagcugcauguacuguacuccagagcuguuauguuacacuguauauaaaugguugcaaaaaacaaaaacaaaaaacaaaauacaaacaaaaaaagucaguccuucuaaaaaggauuuaagauaaugguuuuuaagaugccuuuauaauaagcuuuguuucuuugugaaacucauucagcaggcugaaggaauugguuuaugugguaaagugggcugguguccucuagaguaccuggguacauaaacagaaacuccuguagguaaaaccugauccgugccauuagucucuauguuucugcauccagauagagugcagcucacgcucaagggggugggggcgggggcuccgggggaaagggcguuaaagugauacauuuuuauaccaaauguguuuauuuuuuugugcgaguaauccuuaaauuggaauuguauuagguguuaaaauaaaguuuuuuaaaaaauaacuuguauuuauacuuuacacacuuaauuaugaaaauuucuuaauugcaauuuauuccuaauuuucauaauccaaaaaagauuagagguuagcaugcagaaugcuauguaaucuaugauuucuauaaugauggcuggaaauuguguuaugaggauaaggaaagaacauuuuaaauguaaauuugaagugucaaauguauuuuucuagaauauuucucuggcuuugcuuugaaucuaagggauauaaaaagaaccuaauuacaguagauacaaugaaaauaauggcuauagauguuuggacuggaagcaguguggccaauaugacuuaaagagaccuuaaaauauaauuuuguuuuuaauucucugacaucgugauguggcaguuaauuaacucuuaaaucacucugggcuuugugaaaccaaaauaaugcagguugugggaugucuucaaaacacuccuaaggacuuguucuauaggugcuauuuaggugauggacuuuacauaguggagacuucacuuaauagauguucaguagauggguagaaaaauugaugaaacuucaaagaucagacuuccucuacauugaaauauaugaaauccacauaugcuuuaaugaagcccacuucugaaucuuuuagaacuuacccagaaggcaguguuaaaucuacguaaugcuaccuacguaaugauuugacagauuuucggagccucauccagcuguaagauccuggaacgcugaacugccauaggcuuacuugaugacuguugucagccccagagauggguucauacaguucuuaggauuucagcucgucaggagugugaugaccucacgauauuuuuaagccuuuaagcaguguauauaguugagcucugucagcucagucgcaugcucucuggagaugcuuggaugagaggcguuuacgugcuguaaucacacagugugacucuucuaaacucauccacccuuugaacuggcuggaggaagucaccuuauuuuaagagaaaguuccuugucaggucagggccaggggcauuccuguguucagucgcuauagcuccucccucuuguguucuacuuacugagucucuuagaaagaaagcacagaagcaagcuuugagcucaaacguugacuuucuuacaaacuauacaugaagaaauacaccaaaauuuuacauuaaagauuuagaaauuaguagaaccugucccuaaauuagauagcuauauguaaauguguaugcauacauaccauauauggccaaacauggaacuaccucacuaaagcaacauuuccagcaauuacuauucuuuguuacauuuacaccaagauauucagaaucuuuguuguacaaaaguucuguaacaguggguggcggaaaaaggcccaagugugaguucacaguuuauagguggugaaaacgaggccuuacugcuguagucuauauuuaaauguucaugguaacacauuugaagcaauaaauggcuuaauuaaaugccuac

SEQ ID NO: 2852 - RNA, 49751 nt, Mus musculus
cugugguccuuccuccagggaccucagcgucggcucgguccuccaccgccagggggcgugcgcggcuccgcgguugccgggcucauuggccgcgucgggaagcgugggaggaggccuggggcgagcuggcuuccuccucggcgcgggcgggcgcgcggcgaagccggaggagccggggaaagccgaggcgcgaucggcgcgcucgggaggaggcggcggcgguggcaccucccgucggccuccgacaggacugacggcggcgcgaccgcagacgggugaggcucgggcuggcggcugggcugggcgcggcugggcgcguggaggcaggagcggacggagcaccucgccggcugccgguugccuccugccucgcagcgcgaugcgggucuuggcugcagcggggcccggccguccggagcaucgcggcccgcucagcggcgucugccccgggcguugggucgcgagugccaccgggcuccggcugcaccuggaagcggguguuugccccucguggucgguauccugcagguugagcguucccagagaacuggaugggauggacgggcgugcuggauucgaacucugugcuggaccgccuagacccacucguaaaguuugcauuucugcccaacuggagcugcuuucuccuuuugcaagugaacacauagguguucuaugucuuugaugagugcuguucauuuuauuuuuaguuuuauuuucugcugcguucacagauguaguaugcaugauggucagcgcucuuauacuuaguaaugagucccagauggacgauuugagaucgacacaucuagcuguaacuugcggggagucaucagcuucaauuuacauaguuaauuccuauaauauagaacuacuaucugauagaacuuuugcuucguuucuucauaggaagaaauacauguauacaaagucccuaauuugcaucuuuaccgucuuagauagaguuacccaguauuuccuagcgcauauuuaguuuucacaacuccucacacggguccuauuauuacugcucagauuuuacagauuaggacaccuauuuccugagaaaguuuuaaaguuggaugguaauggcggaucccauggccugagcuuuccuggaaggaccagugauagacuuaaaauuuccaagucuuuggaaacauuguuucucauacagugccuuagggagcacagagaaaccuccauuacugaagaaguaaaguuaauaacuucccagaugccacucacuaagaaaaguaaguuacucucccuugcccugcugucuuacaucccugcugucuuacauccuguuucuuucuggagguugcucaucugaugauuucucuccggcaguuugcuagguuuuuaguuuuaugcuagugauuagguuuguuucauagaaucuuaagacauguacucauuaaaacaaccagcugaugacuuccagcacguuacggcucgacgcaucaaauucaagucguucaucugucguugcucauuacucagguauaagagcaucaugcaaacuacagcugugaacacagcaggaaaaaaaaaaauagaaaaaaaauauuucuucuuuguaggaagaaauuguaacauaaaaagggcgagauagaauuccucuagucggugacauucugcgacccuaugguuguggagacgcgaagcuacagaaugauggaauuauguagaccagagaggcaggcacagacucucaauggcacauuucucccuuuuggucccucccucgguaagacuguugagcgucuugugugauaguuugauugcugcgugagcauccucagcagugaguuucuggugauuuucaucacggcuccuccaggcuuguuaaggcaguucugugggaucagcuguguaaacuaauggcacccugcauuaccugcaauuagugggcuuggagugaguuuugaagggcauugcauaggaucaaaauaggagcuuguaaaauugucuuagcugauacaacuucucccucagugccuucuuuuuauucugugccccuggcugcugagcugccugccuuucugugugggcagauagaagcacccuguuccagcacuuucccucaggggagcuuuuggcugcugcaaucugugaaccuugauauacuucaguucuacacuugaccuagguaugaaugaagugcagggaaacccggaaacaugagauccugugaauccauaucaaguggaaugugaaguaguuacaggaaaugaagaucccaccaugauggguggaaauuuauucccuccugcucuuguuuucuuucuuaaaaauaaaacaaaaccccaacacagugaaagcugaaauacugauguucuauuuugauccuccuauagugaacacuuauuuuuucauuuuucucaaaggaaauuuacuuauuuuuaccuugcauucuuuucauauguaagggguggggccaaggcccaugcuguggcgcauguguggcgaucagggaccauuuguaggaguugguuuucuuucuggaacucgaagucaggaugucagacuugucagcauacuuaccuucugagcccuuugucauuguacucgauaauauuugucugucugcccaucuuucccguaguaggauaggguaggauuaagguauugaaacagcuguagaauucuaaaggagcaagcaaaacuaaauguuauuuuuaaggucucugcacuggguuccagaaauccaaugaccauuuuaguuugucaaguggcuauuggauuuuaaaacaaaaugcugcuuuguggaagagaagaucuguaagaaaacauggggacaguuugagcuagagucuguuuugagcauuucaaacaggaguucuuucuucuuuucuucaugucagucuccagauuuccugccugccucucccucuuccaccuggcagaccuggcccugggacugccggcucuguuuccauucagaaaauaaugaaaaguccuaucauaggaauuggacucggggauuugauucgguguuagaucugccuuggcuuucauuuugguuuuuuucccccuucuuaacguuuucuguguggguuggcgcccuguaauccugaagcucucuuucagccugagagaaucaccccaaagagcuuguuaguucuuauaccuacucugggagucugguccuguaggucugcaguagcagagacauugcuuguuaaaaggcacaccucccugguguggguaacacuuuacugaggccuucgaagaacuugauaggauguauuuuacuaacaacaacaaaaacaaaacaaaaauaaaacaaaacaaccccccacccccaagccaaacauguuuggaagccucuguauuuagacuguuaaguguguuucuuaaaauugauaauauaccuuuuuaggugucuaagguuuuagggcuucucuuguaguguuauuaugaggguuaggauauaauguaaaggauauuauauugaagucugggagaucagucaguaugcuugccaggggaucucuggggcucucugcuuggucagucuacccuaaugaguagucuccaguuucaaugagagaccaccuagggaguaaccaaaaagacacccgacaaugcugucugguuucauacacacgcgcgcacgcgcacacacacacucuccuauacaacauaugcacauacccacagacauguacacacacaaacaccacacucacacacacacaaauucuauuaauauuucuucagauguucaaccaugcaaacuguaagaguuuaugaaagguggcccugccugacaucuguuuguagugaagauuguauugguggcugaguucuaaggagugccucagacauaucuugaggugucaugcaaucuaaucuggcuacucauuuccauuuauuuauccauuaguggcuuaauagucuuguucacugaaauauuuacuucaugcaguguuugcguagguguggcaguuccauuugaccuacagcuuuuuauugguccuuuuuaguaagcagcccacauuuacucccacuuacugacucuccaccuaaacacaccacuuacccuccuggguugaaugguuuuuagaugugaugguaauaagguuaacagcaaucucucaaaagagaccugaacucuggcugugaguuaaaaaauuuaagagcuagugggacccugauggagugucugcagguuagaauccaucuuucuguacuacugagaagucaguggagacuagcccagccuguguacaagcauccuuuauagauggaaaaacuugcuuaucuguacuauuaggcugaaggacgaacacaaggccauuuucuuuuuaaucccuuaaauguuuuguuggaaaacauugucaagugcaugcggaucaacuggcacauuucuguaaugggcuagcucagguuccuggagaggaaagaaagaacucuaggugucucugugguuucuacaguuuccagaguucugcuaggaagcggccgacucaaaagugagcugucuguugcaacacugcucucagaaugucugucagguuccagcaccuguuguugcauuaagucuuuggggcaaaguuggccuacgccgccgggcacuuuucguaaccuguguuagguauuagagcugcguuugccaguguaggagaagggagcuuuauucaggcugcuguagaucagauaacagguuucugaauucuuccugguugccagcaaggaagagcaauuucgaaguaagguagaaggacuuggaggacacuaaagucucaccagugggguucuguuuugccucaucuccuuccugaauuuccuuggguaacagucugggggaacuaaggagcacccuggacuugaguguuuccacuuacccacauuuagauguuaauccucuuuuaaaucaauuugcaucuugugcugcugaaggcaaaagaagaaaagcccuaagauguugauucagauaggaaaauucagagauggggcaugguagcacaugcuaguauugccagcauucuggagaugggaaacugagguggcaggagcuagcuguggaaauucuguaucagacaaaccaaccaaagcagccaggaguaggccaucaguaugcacucuucccaagauuuuucaguagaacaguauucugaaagaguuguucuacugacuccuuauuucaaguuuucagucuguggcuuuguauucucccauuuggaagaacucuguaccacuuugugggagugaguuuuuguuguuguuguuauugugcuuaauuuuuuuuuccuccaaucaaaauacgagauuaguuuguuucuuuaaaaacgaauuuuuuuccuuuuuaauaacuuucauauuccuuuuguaggguuuugucuugguguuuuggaagagucucauguagccccuucugucauugaacucccugucugggcaaggaugacuuuagacuccuaugucccuuccuuuuuaccuuuuuaccuuuuuaccuuugaagauuuagaggugugugcaucguacuuaauuuuuuuuuaacuaacucucucccuuucccccugucugucugucugucugucugccucugccucucuccuucccacauucgcuugcucccucucacuuuguguagauuauauuuuuuaaaaaucugcgucuucuacuauucaauaccaaaguguguugccaauauucaauccuuuuucaaguuaguauuucuaguaagcauuuaguguuaaggucuugaaaaucacuugauguuaaaguccaucuaucacauuccacaguggcacaaggguagcagcuucuguugcagacugaguuauuguuuguucuugcuuugccgugcuagggagccaacuccaggcuucugauaaaccacugagcuaaagccccguccuuguucugcuguuuccuguuuuuguuuuggacaggguuugacuuagcguaggcugggccccuacucauuuucuagugaggauaaucuugaucuucucaucugucuuagucacugucuauagcugcgaagagacaccaugaccaagacaacccuuauauuauaaagcauuuaguugggggcuugcuuacaguuucagaggucuggucugcuaucuucauggcagggagcguaccggcaucccuggcacuggaacaguagccaagacuacauccugaugcaucggcugagaaagagucagagccuagcaggcggccacucugcugacggugcugaugagccccuguccuugaacuggguuuuuaaauguuaauaucucuuuccaauggauacagucuuuuuaccugucuuuuuuuguuucuaaaguuugucuggcuuguagaacuccaucugccuuuccauccagauacauguacaucaagugcuuuaucaauuggucugucuccccagccuaggaaauguguuuaagagcuagaugauaauaguuggccaagcaucagauacacaguuaccagcuccuucuuaaagcgagucacaacaaugaugccagcacccacauaaagaagagcgcuguuaccuuguucccacggccaugaucuuaucagcagugaagcagaacuuaguaaccauuucugucugugucuuuuugucuuuagcuguggguuuggaaacaguccagacucacuccggucuuugcuguuagcaagcagcuccagcuauaggaagguaaagguguuuccauuugaauuaaguucuuucugcuucucaugcaauacaggcuuccuccauggaggacacacgcuggcgaaauggcugauuaagcacagaacuugugccuuuggucaacacucuuuacauagaagccaucuguguucuccaaauaaccuagcaaaaauguucaacuacuaaaguaccugcuauuagggaaguuuuuucagucuucuauuuuauuuuuauuuuucuaauuaaacaaauuacuccuccuugaggcucagcuaaccauacacgcaagccuguguagucuuuaaggcagaaucauuuuucagaguagguugagaaauaaaauuugaauucaugaaacaugaagaugguaugaaacccagaguuuguuguccauauaaauaaaaccuuaugaaaacacaguugagccagaccuguugggaaacacuuggaaggcagagcuagucagaucucuugaauuccaggccagccuggucuacuuagugaguuucgagccagccagggcuacguaauaagacccuaucucaacaagaacaacaacaaauccaaaagcugccauguaguuacccuccaucuuuguuccaucuagcuggggauguacagcuggaguagggacugugggaccugaugucaaagcacuuuuuauacagaaguuuucuggacuuuugcuggcaggagucacaugcauagagcuguaugauauugcaacuuuuuuuuucuuuuggaacauuaucucuuuauuuagcuugaacaguucuagcuguccuggaacucacuguguagaccaggcuagccuucaacucacagcgaucugcuuucccaguguuggacccacuguaccugcuguuugaaucuuguuuccaguagugcacuuuuguauguagauuuagcagaguagcuuaccccagugacucuuucaguaccaaccauuuuccucuuggacauuaaaugcucagaggaugaaaauuuacuuuaccuucuagucuugacagugccuuaaacaguccaaguuugcuugaaaaaaauaaaugauguauaggugauagauauguauauaugcauauauauguauauauuuguguguguuugugugcauauguauacagcuagauaaagguacuauguaauaagcuguauacauuucuguagccauuuauuacauauauugcaauuuauuuggggaaaaaaaaugggcucauacaguuccagaggccgagagcuucaggcuuugcaguuggcauguugccacuuagcagaccugaugguacugugugccugugcagcuuagcccuuaugcagccucaaugcaggcagagagcagagccucccuauuagaaaagccaguguuuccuccucuacuccaacaccguaaaugcaaaagauguguccuccaaggcggaugggaauucucccaaccagaacagaggaccuuugcggcagaucccagguggguguccucugaucuauuuggagacaguguccauggguuaaagcucugucucuccacugccucucccuguuuagaugccaauuacaaguccuggcugcuuuuuuuacauauggaucugcuggacccggaccagcuaugagcugggggccccacaaccacuucuugaggcucaaguaauuugagagguuuauacuuaccguucaccgcauucaggcuauuagaaaugacacuggcgagcacaugcagagguugugguaugggaaggggaacagaguucccuugcccucucuagguguaccauuccccaggaacuguagcguucucuguggaagccuuccaggcucugggcucuguccuguggcguuuugugagacuucauuccguaggcaugacugcagcaugggcagcuguguugaaaugugguuggacagaaaggaaaugaacuaaugcuagcggauugaauggggaaccccagcaauccaucuggccucuucagcaggccucugggcugaggagaggcuugugaccugucagacagagcugcacggaagguuauuuguggcuagcauuaacacagguuagguuagguuucuaucucuugcaaggggaaagaaaaauuagagucuagaauaacagacaauuagguaauucuuacauccugccuugugggaaggaguuuagagccaggagcuauggauggaaacuccuacuaugucugaggaacuacacuugggugaacaaccuacuuggugccccgcuggaggaaggcacuucaccugcccagucuagauucugaugcuaaucauccaggaagguccuuuccugcacccccggaaugguguugacuuacaggcagcaucuggcccuaucuggguggccccagaauccaccuuccuagacugggcuuaaguauagucuaugggcuauuguuuuguaguuuuaccuguuuuuguguagucucuugaaaagcuccagcucucuuugggcuggaaagguagcuggggggcguugggguuggggguucagguguuaagagcacuuguucuugcagaggaauuggguucaaacccagucacuccaguuccagggcaucugauaccuagccucuucugaacucggugggccacaaaauggucagacauacccauagaacauucauacacauaaaauaaaaauuaaauuaacaaaagaaaagcucuagcccacuugacuauuagaaucaucugaauuuaauugguucgguuaagauuguucuuuggccaggacugaauuaaaguuggauuaacgugaaugguggcaauuuugugaaauauaauccauaauauuuucuuuuugucugaauucauuuuguuuuuagcauuaugcuaugguauauaugugugugcauauuuuucuuucaucauaguugucuugaggugguaguaaggauuucucacacucaaacuuaagucagucugacaaacugucaaaucucuggaguggcuagugggaucagcaauucccagagcaauuugcaagagccaaauugauugacgugguauuuugucaacaaggucuugaguacaucagugugcaucgggagaaauggaacaggguuugugaguguccuuccucucugggacccccuuguaaggccuagggcagcuagacuagccaacugguggugguggggggacugccuggccagacgguaauuguuuuuaugguaauuguuuuuauggcuuguuucuuugauacagaaccaugcuguauugaaggagugggaagugcgguuggaccugugaccuguugguccuuaucuuaaugaguucuagacaggucuuucuuauauaacagcccaauuuugaguuagaaaauuguauuaaauuggaccaaucuagggaguugggcuaaaagaauuguuuaaaugaaaacauccagaaaauugggccugguucccaggagucuuaccuugagaaucucuucuuuacucucagacccugauugugcacacacuuuggggcaguguggccuucccugcuuuuauuuucaggcgaccuuugcaccucucaguuagcauucuuaucuaucuaaaaccaccaaaagcgguuuuggacuaucccuucacuuuuggagccaugaauuccuuaaguauccugucuugaauauuuuaauauuuacacuuuuguuuguuuguuuguuuguuuugagagacaguguuucucugcauagucuuggcuauccuggaacucgcuuuguagaccaggcuggccucaaauucagagaucugccugccuccacuucucaggcacgugcugcagaauauuugcauuuuuaucuauauucuaagacuacucucuucauuacuaauauucugguuuuggaaacuagcucaaauucuuguaucucuuucacugaguacacagcucauuuauguuccuuugacuuguagccuggagacuagccuucugaacuauuagccgaggccuucuuauucccucaccauuguguuuauuaucucugggccuaucucuucuugauugccugaaggcuucuugagcuguuucacccaccaccucagauuguugugucuucaaaugcucuuuaaagagccaggcaugguuugaaauuagcgcaucauaaaugcuugccgugcuuugcccuuaaauauauuucgguacuucgauucuucggauuuacacuuuugcaucauuaaagaugcaaaaaaaguuaauuaaggaaauuaauuaaaaugugugaaugacgaggcauuaauucccuaaagauuuuuuuuuuaagauuuauuuuauguauaugaguacacuguagcugucuucaggcacaccagaagagggcgucagaccucauuacagauuguggugagccaccaugugguugcugggaauugaacucaggaccuuuggaagagcagucugugcucuuaacugcugagccaucucuucagcccucccuaagauauuugaagggaaaacaauuguauucacaaauguaguugcuuacagaguuaggaguuuagaaacagaauugaugggaagagcaagccggaggcugguggcuaauuaugcagguguggucuccccuggcaguggaagcugaaauagaacaucaggugucugguacccagauguuuaaucucuuguucaaagacauuuuccuaggcuacccuuagauaggagcgaaauuauuuggcauaugagaggggaggaaaggccaaguguguguugugaauacagaguucaguuuuacuggaaaccaaaagaggguuuauggaguuuucuuuugaggggaugaguugugucaacccccccccuuugccccccaucccuuuaugugaaguuuugugaauuacuucaguaucucuuguuuccuuuuagaauucuggcuggugccuaaggacuuuaacuagauaguauugacuuuggcgauuauauagacauuguucacaaagauaacaaagcagggaaaugccaguagugaacagcucaguuaaaguguugauguguuuugcuucagcuuagcuuuugcagaagaaugggagccagcugaagacaugggcugaggggcacgcaggcacgcaggcacgcaggcacgcaggcuuuccucucuauugcuuucuccagugaauaggaaaacugauauucuuuuccgugcccuucaggcaaaggucauuuggaggaagagggacuaucugugaauuauuaaaucaguauguguggguacuaguguguguacaugccuguuugugaacuugugugccacagugugugcgcaagagaucagagaaauaagaauucuguuccuuuacaaaauguugacugaaguaguugucuggcugaauguggguguggcuuuguuuaugguuccgguuccauuuuagguaaacguuuucauguauuuugaauuugguaggaagcaaaagcacacacacacauggcuuuucuuuauuguuuuuccuagcauauguugccaguuggugaaauaauaucaaagaauaguaucuaucuagaguuugcugugaaugcuuacaacagugauauccaaauuacauuauaaaaagugacauacauaauuuguuaaucuuaccagcaagaguaagaccacuacuacaguugugagccaaauuugaagcuuaaaaaaggcaaaacuugaaguccaucauauuuccuauucgguccaaucagggacaagcauccauccugacauauuuccuuccgguguaccucccacucaccuccagucaaacagauagugcaaacaaacuuguuuacgggcacagaaacuuguggcuuguuauuucccaagaaccguagcccccaucauucuaaguauugucuguccuugggcaaguggggcuuacagguuaacuuuggcucuuauguaucuuguaccggcaucgacuggucuaucuaaacuccaugucuacagaugguuucugucacuugguaaagagcuuacugaucugauguacuagccaguguuugaauguaaguguuuugacuuccuaauggauguaugaucgcugagggucauagucccucuguagacacaggugcgauguauccaagggagcaaaggauagccagcagcagacacaagcaaggcaaguuccuuugccuuuuuuuaauggcccagggggaguggccagugauaagaggguuuugucuuuuuuuuuuuuuuuuuuuuuuuuuuaauuaaccauugcuauucauagaauacuuagaaaugacaugguauuuacuuaacuuguuucacauacccuaaguuaaccucaaucuaaggaggaauaugcauugcauaauucaugguguuugccuucccuuuugauuuuaggaccuucuuuuggagacgugcuagagagugagaaggcaaaaaugaggguagcagguaagagauuuauuuaaucuggugaaaauaauuuuuuauuucaugaucuauuuuauacccuguuugcucaauuaauggcuaaaggagaggaugcaugauucauuaauucuuuugcaucuuucaucuuucuccuuuaacuuccuucccugguguguguguguggggggggggggggguggugggggggguagguucuugcuuucuaauccaaucugguuuuaagaaaucuucuggccucaggucccaucauagcuguaauuuuggaaaguuaagugccuggcugaaauaaacuaaaucauauuuagccuuuucauuuuaaguagucaacaagucacuacuugcacauuuaguagguauaauauacauuuuuguagauuuggcauauugaaaucaugccaaauauuaauacuuauuuuuaaugagauaagcguauuucccuacuaguccauauaaaauacucaaagaauagcuuugaaaauuugagaaugacuuuuucuugcuaaguuaaaaaaaaaaaagaagaaaagaaaaggaauucuaaaauagaacuuucuccugugugagguuaaguauaauauacaggaagaauuuaauuuacuaaaaugugguuuugcuuuguuuguuuguuuuuuuguuuuuguuuuguuuuguuuuuugucgagugugaagccagggcauuaaagcaauaugaaguaguguguuguuuacauugacagucauugguagauguccauaguauuaauguagguauugguaagcaucuuuaaaggguagaccccuaaauucucaguugaccuuucccuaccuacaagggaaaaccuguuucuccuaugcugccuccagccacagcccccuaucaaagcaccuugcucugaggaauucugcacagcuacaggagaaaacagguuguuuuuccaaccucaagauagucuuauccuuaauugucauuuucuuacaagcaaacccaguauucgccuagaguuguuuaucaaaggugcccaaaguugaggcggguggacaaacagcaauuuuuaauuucuuagaguuguagagaaucaagcaggcagaguuggucaaauaccaugauuacuuaaccaaguuaacugaaggucgcugcacaugauuuugcacaacuuugcugugaaguuacggaguaucaauucuaaguaguuauccacuugugggguagggagacuccagaaacaagagcuuguuuguguucuaaaaaacaaugccacacucuugcuguguuugcuccgcauuuuguuucuguuuguuuuuagguuccuuuuaaauacccuguucaagugugauguccagagccacuucuuguuuugcacauaguucuaaaugcacucaguuaagcuaacuucaucagcuaguucuuguguuuguacuuuuuuuggccuaggucugggggccuuugauaggcuaucaggacaguuaguuaggaguucacugcugugaacuaauuaauaucuucuaagugaaaauucuuucugguugcguugagaugcucauauagccugagauguaaugaucuuugguuuauaaauguggggacagacucaaagcagugcuaucaguggcuggaaggaagacagaacgacacacugagucaggaaugggaguuaugguugugauaucuuaagcccaaucuaaggccagcauugaauguugggaccaacccuagagacuauuuuguagcaugcuccuggagucuaccacuguagaaacugugggugucucugcuuacuuuucuaugucuugaagcaucucuuucuuguuccagaccagugugagggaaccgguccugcccuacucagugcuggggcuggagagauggcuaggagcauuugaugcucuugcugcagaggaacaagguuccguucccagcacccacacagugacucugaaccgucuguaacuaguucagggaaucugacgccuucuucugacuuccacuggcaccaggaauacacauucacauguguacaugcaggcagaaacacugauguguaaaguaagauagggaaaucuuaaaaaugaaaccacccccauuaaugugacccugagcaaguucguccuugaacagugcaaguuucacccaucugcugaagagagacagugagggcuucuccucuguuauaaaugcccgugacugcuagaaaauaagguacaagccuagcaugcucuauucauagcuagacgggaggggaugcuagaaaacucucuguaccuuccucccaguuugguugugaaucuaaaacugcucuaaaagaacacgugaccuagcaugugcucaccuucaccuagcaucugucaacuccacgcccgccuuacuuggcaaaaacugugugugccgccugccguagucauucgucugccguagucauucgucugccguagucauucgucugccguagucauucgucuguugagcauauauguguugagagcaugcuuuugaugagaaggcaggccaaaccaaauggaguuuugcuugcucauauaugaaacuauaggcagcuaguaggugcucuaaaaggcaggaagcagacuuuggagggagaauugagguggaggagagaaggauuaagcagguggugaaccuacucagugccucguuauuccugaauucauagauuuuuuuuaaggccuuggguuuuuuuuuuucuaauuuauuuauuuauuuauuuauuuauuuauuuauuuauuuagagcaguuuuagauucacaaccaaauuaggaggcagguacugagauuuuuuuucuaguaucgccucacguagcuaugaauagagcaucucuaaauaguccugaggaggcucuggauggguggccuuuccaaacgucuucgguuccuuccugcuccuccccuccuagaauacagaccauucuuuuggguagucuuaggggauuucuucaucucugggauuuuuuuuuuucucuuuaagguuagauaacugcagacuucaucuaccucuuucgcaucaauagagguuaaaccugaaagaucaauaugagcaaccgauugggauugguuaagacacgaauaaauugaaacuguuucugaauaaacaggcccugucucugaaguccagagguugagagggaagccccacccuuuuuacuuugcacuuugugauuugcuccaucgugguuccuaggaguaagagaugauucauaguaagcagacguggcaggggugguuauuauaagguagucugacgcccuaaagauacaaagucaaaagcuaggagcaggcgcuccuagagcuuaucacacagccaaugacugugauauccaagccuguccuccaggccacaaguccuguguugaccuaaguauuaagcaagagggggaagguaguguuugcgguuucucgugggguuagguagcucucugguuggugauaggacaguaagcuugcuacaugucacguccaacucuuuacuuccuguguguccuggccgugguaucuccagaaagguuuuguaucaucccuggagagcauugcucuuuagggauuggaagggauuaguaguccuguagacuuggcaguguucuauucaccaggacuccuguaguaagccagcugcugcugaugguagauaacucccuaucccccacgccccucgcgcaccgccccaaaucccccuagacaggcgucucaggucuuccaucugggaguugauugggaaaaaaucccuugacuugguggguaucaguagagucguuguaaccccaguaucauuaagaucuaggggaugacaauauagaaguguauucgccuucaugcuuuugccagaauggaguaucuguguagcagaagugauguucguuggcuuauaaaaccaugcugaguugcuucugccuuuuuuccaggagcugcaaaguugguaguggccguggcaguauucuuacugaccuucuauguuauuucucaaguauuugaaauuaaaauggaugcaaguuuaggaaaucuauuugguaaguuucacacccuucaguacuuuauuccuuuuauuguuugcuauuuuauuuuaguacagacuuuaugcuuuuuguaaaaauaaaaguucuuugacaauuucauacauguguaaaauguuuggauugugaaugcccgcauugcguuguuauucccuuccuacgccugguccccauccaguccacacccuccuaguuucauguccuaguuuuuugcagccucuucuguuuagcguugcucaugcgagcaugacuuuggcuuguuuacuggagcacgggcaccuagcccauggcuacaccacugaagacaaugguucucccuccuacgauagcagugaugauguuccagugacuucucagggacgaguaggguaguaucucacaguuuccgccccacccgugacugaauguuguaugucuggucuucuguaggcaaacacggcugaugugauuuccugagugcugcagccaugcuaugucucggacacagcacuuuucagcuucccaccccuuuaaauucucucugccuucucuucuccaagguugccugagcuuucagggaggacgguacagguguccuguauaggguugggucucaacagucauaaucuuguagcauguugacuaguuaugaguuucuuaaguuagcugucaccuacuguagaacaacuucauucuuuaaaaacaauuuauuuuauuauuuuaugugugugggcaaguuuuuuuuuuuuuuuggccugcaugcaugucugugcaccauauacaugccuggugccauaagaggccagaagacggcaucaaauccccuagaacuugaguuagaggcaguugugagcugaugugugggugcugggaauagaacuuggguaaucuggaauugcaguuaguucuuuuaagugcugaccuaccuuccagccccagaaucuuauuuuuuaaauuacuuaacuaacuaacuacuuuauaucuugaucaacuuucucuucucucaguucuuucccucccucccccauccacuccuccacuuuuucuuuucaaaaaagaaggggagaccuuccacagacaucaaacagccuuugcagaucaagucucagugagaccaggagcaacuucuucuauugaggcuagaugaggcagcccaauacggggaaagggucccaaaggcaggguacagccccugcuucagcugucaggggucccagaugaagacuaaguuacccaacaauuacauagguguagagggccuaggucaguccugugcaugcucguugguuggcuguucagucccugugagccucuacaagcugagguuaauugauucuguaaguuuucauguggcaucugaucccucuggcuccuccaugccuuccucccccucuucugcaggauuccuaagcucuaccuaauguuuggcaguggcucugcaucuguuucuaucagcugcuaggagaagccucucugcugaugguucugcugggcuccugucugaaagucuagcagaguaucauuagcagugucggggugugcuuucucucaaggcucaaggcucaaggcucaagguggacuagucauugguuggccauucggucaauuucagcuccgucuuuaccccagcauaucuuguaggcaggacaaauuguagggguagaaggcuuuaugcuuggguugauguccagauuccuccauuagaaaucuuaccuggccgggcgugguaacgcacaccuuuaaucccagcacucaggaggcagaggcaggcggauuucugaguucgaggccagccuggucuacaaagugaguuccaggacagccagggcuauacagagaaacccugucucgaaaaaccaaaaaaaaaaaaaaaaaaaaaaaaaaaucuuaccugguuacuguaguuggcugguuaaggcuccaaaucccccauugcuaggagucuuagcuagggucacccucauagauuccugagaguuuccauugauagguuuuuagcucauccuagagaugccccacccccaccccgaauugucucucccuccauccuccuuuacccaacuugaucccuccuguucccauccccaccccucacccacccccggugucuuuucuauuucucacacucaaugguauuaaugcguuuuacuguguccaaguccauacucccucccccaccuuguugcugaacuucuuugggucugugaauuguagcaugcuuauccuuuacguuauagcuaauacccacuuauaagugaguacaugcuaugcauaucuuucugggucuggguuaacucucucaggaugaucuuuucuagugucauccauuugccugcaaauuucacaaugucuuguuuuuaauagcugaguaauacuccauuguguaaaugcaucacauuuuucuuuauccauucuucaguugagggacgucuggguuguuugcagcuucuggcuauugugaauaaagcugcugugaacguaguugaacacauguccuugugggaugguggggcauccccgagugguauagcugggucuugagguagaacuauucucaauuuucuaagaaacugucaaauugauuuccacagugacuguacaaguuugcacuuccaccagcaauggaggaauauucccuuugcuccacauccucgccagcgggugaggccacuugaguuuuugaucuauuaaccauucugaccaggcugugauggaauuucaaagucauuuugaguuguauucccucauggcuaaggauguugacaauuucuuuaaggcuucucagucauuagagauuccugucaagaauucucuguuuagauuuguacuccauuuuuuauuugguuuguugauaaucuagcuucuugaguucuuuauauauuuaggauaucaguccucugucaagugugagguuaguaaagaucuguuuccauucuguagguugucauuuuguccuaugaugguauccuuugucuuauagaagcuuuucagcuucuauauaggucccauauauuaauuguugaucuuaguaccuaagcuauugcuguucuguucaggaaguugucugcugugcccgugcauuccaggcuauuccccacuuucccuucuaucagguuuagcauaucugguuuuauuauguuaaggacuuugauccacuugaacuugaguuuugugcaggguaguaaauaugggucuguuuucauucuuccacaugcacacaucccgcagcauuugcugaaggugcuuucucuguuuugacuguaugauuuuggcuucuuccucaaaaaucaagugugcauagguguguggauuuacuuuuaggucuucaguuagauuccauugaugaacuugucuguuuuuaugucagugcuaucuagauuguauuauuauuucuuggaaugacugauuguaaucagggauggugauagcuccagaaguucuuuuauuguacagcauuguuuuuagccauccuggauguuuuuguuuuuccagaugaaguugaguauuuuucuuuuaguguuuaaagaauugucuuggaauuuugauggagguugcauugaauuggaagauuuuggaauauggcuauuuucacuauguuaauccuaccuaucuaugagcaugggagggcuuucuaucuugugauaucuucuucaguuucuuucuucaaagacuugaauugaaguucuggucauauaggucuuucacuugcuugguuagaguuaacagcaaagucuuuuauauuacuuauggcuauugugaagggugcuguuuugcuaauuucuuucacaacuguugaucacuuguauugaguggggcuacugaucuuuuugaauuaauuuccuauccagucacuucacugaguguuuuuaucaguuguuggaguuuccucauagaauuuuuggggucacuuauguauacugucauaucauuugcaacuagcaauacuuugacuucuuucuuccuuuuccgaucuguauucccugaucuccuuuagcugucuuacugcucuagcucacacuucagcuacuguacugaagagacacggagagaauggacagccucgucuugucccuguuuguaguggaauugcuucaaguuugucuccauuuaauuugauguuggcuagguaugugccuugugucccuguuuuauucuuaccaugacugcccaaaguguaaguucccagcauggguuuacuaaugcuuugucugucuagaaaagaauuauuaucugggcgaaugucauucaguccaguagucuaaaaaccaaaaacuaucuaagaauaaaaacauaaaugucuaagcaaucgauuuuuguuuuuguuugauauuuuaaacauauuuaaagacuauuuucuacaugaugagaaacuuuaaucauggcucuggaguguucacuguagaaaagacaacgcugcuauguugaaauucuuucuucauuugaguuaacugcuugaaaaugaacccaaaucuaguugguauaaggguuagagaaauggaucguaaggguugguccuuaauauuauucuuucuuuucuccagugauuuucauuucuugcccacauauuuaguguuuuuauguugcaaauguacccauacgagguccuuuaacucagauuacaguuucagugcuaaggguccaucccagggccuugcacaugcuaggcaaguuuucugcuagugguguacauccuuaacucaggaguuuacaaauccucaacaacauggaaaccagguguauuuagugcuauuuuauacaguucuauauauucuugguuuucagauuuuccuauucuagaaguguacucugguuuuccuauggcacugcaggccguuucagaauuuacuguguagccuugcccacuguacaguucucucuucugagucauugcaaguccaauccagggcuuuguauauaccagacaagugcuguguuacagacccacauccacucuuaacacuuaauucacuuccucuugcaucuaaagauucugcuacacaccagcacuuagccucuugugucaauacucuucagagcaucaugguaucugggauguggcuuccaguuagaaugagcccaugucuaguacuuuaacuagaacacuugucuccccuaauuuccauucugguguuucauauugcuagggaccuucuuaucguguuguuuuaccuguuugauuuuggcacuguauagagcaggcauuugcuuuacucuuguaacuguagugccuuuuaucuauauuggaugucagucuacauugaacuggugcaaauauuaauugugggguuugcuuuacuucuuguuuagaauauauuagcgcucauaaccauuuauuuagcauccaacuuaauuuagcaaaugucauuggguugaaucuguguugguugguuucuggaaccuggugucuaguuacccauaguggucacuacaguuuacucaucggugaguucccuuucugcuguccuuugugauaacuuaauagcuugaacaggucaccuuuuucuuuuuauuggaaguagaguauuuucucguacaauauacauccugauuacaguuuccccucccucuacuccuuccacuuccuucuuuccacucuucccaucuggauccacccaccccauuucugucuugcauuugaaaagaacaggcuucuaaaagguagcaaccaaaccugacaaaauaaaauauaguaagauaaaacaaaagucaucauauugaaguugaacaagacaaaugaagaaaaggaaaagaacccaaacuuuauuuguuuguuccuuuucuugagacaggauuuccucuauguagccugggcuguccuggaacucacucuguagaccaggcuggcccugaacucagaucugccucccucugccucccaagugcugggcuuaaagacaugcacucacuaaaccuagcucguugucucaagcucuuuauaucauaguguuucagaaaaauaaaacagacauuuccagacaggaagaaugaaaaaugugcccacaguuaauaauugaaacuaccaagguagauugugauguaaaagaauaaaauaaaaauuaaaaggcaaagaaccacaacaacuaaaaacuauaaucuccuaaaugaaguguuuuggcauggggguguagcucagugguaagugaggacuaccuugcuuagcauaucuagauuuaguccccagcaugucccacucccaaauacacaaacacuaguuuuuuuaaauaagacuuaaucuugaaggaauuaucaagucacgcuccauuuguaaaaauaauacgcagagacccuggauacccuugcuuuagaauuccacccauucacaggcuggacagggacuuguacagucuguuagucauguuccuggcccugauuuaaugcgggguuaguuuucagcaugggccuuuaacuaguacagagcugaacaaaguccagguuaccacugcagauauugcugcagugaauuuguggauguaauuauuuuuagacuucuaugucuaagccauugguaaguacaacauauaugggguaguuaagacaguauuaaaagcuuagguacaacuuaguucuaauccuauagucugacuuaauugaaggacauucauggaagucugaugaaaucaggcaggguguguccaucucuugauguauuaucuaaaagaaaugaaagaucgggguuaucaccuagagucagaaguaaaccaugcaggugaagagaggcucuugucuuccaggcugggcuugcaccugacacuuuagcaaucacccguauucaugaaaauuaggucaucugcuaccugcagguuuacauucuccuaauugcagcccuggggacaaaucuuucgguuuugauggguuuuggauacaaguaaacuaaccgugucuagaagugcuucuugagaauggcuuucccuucaagccucucaucagcuaacacauguuccacggagggcgauuuacccugaagcccgaugacucacaaacagauuuccaggccguugucuuuaacuaaguagcaauuacagaucuggcaucugaaauguaaccagcaaaaugaucugauuguuuucaaauuuuuagacauuuauuucuacuguuucauguauguggguguuuggcccacauguuacgucuuugcaguacucuuauacauggugccugaggguguggugagccuccaggugggugcugggaguggaacccagguccuuugcaacaaaagugcucauaaccacgaagccagcuccccgguccuagaguuacucugcccuuccuucucugagacuacuuaaaaaaaaaaaagucaccacaucucauuuucuggaagaguuaacuguaaaggucccuacccugccacugugcucugggacugacuggugaucugucugcucauagucacccuuuagaagugaguggugcagccagccugagugcuauaugagaugauucuguuugggaccagcaggauugcucagcagggaaacaaugcuugucgucaagccugacuucuugaguucaauuccuaggacccacaugguagaaggagagaacuggcucuuguaaguuguccucugggauuuccacgugugucccuuggcacgcccguauccauacauauacaacauaugcauacacauuacauuguaugcauacaccucaauaaguaaauguaaugagaaauuaaacauacacuaaaaaauagaagcuagcuccaccaaucacaauuaugaccuaaaacacacacgaguuaacugcucugucuuccguuuccuuauaucugaaacgcgaugaccaugucaguaaucaccaagaaguacuugacagagcuaacacauaggaaagaguggaauuauuuaguucuguucugaucuuccucucccauucccuauuaccauaauagaucagaugaccugccgucuaauuagcccagcacgggucagggagaguggaauuccugauuuuaacaguacuccuuucuagaaauuuaaacaccugagucuggugauauauucuuuucuuuaacuaauuaauuaguuaauuaauaauguuugguuugugcuuuuuugagacaagguuucucuguguagcucuggcuauccagucuguagacccggcuggccucaaacucaggucuaccugucucuuccuccugagggcugagauuaaaggcgugugccaccuucagccagcuaauugcuuuuuuuguuaacugugcuuauuagugugguguguguguguaaacauauuuguauauguguguugguacauguguucauggcgcaugaguggaggucagaggaccaccugggagagucaggucucuccuuccagcgucuggaugcugggaacacccggcuuggugucaagccugccgcuacccauugcaccuucacaucguuuuucuucuuaaagacagacugagguugagcgugucuagccugcacauugcugacuuaguucuggggguuaguuuucucauucgaaagagcgaaagcaucggaucugaucucuguaauuauaccaggaaauggaaagagugagcuagggaaaccgcagcaccugcgugugugcuugcuccacuccuuuuaccccucccccuuucugcuuguuauuugcuuguucguggcugucuuuccuugggaaucauuucugugccuggguuauggaguuggggaggcuguugugcuguguccagggcauuacucuuucccugcauuccagcugugugacuuuagugguguauaauauucuccuaaguguucugagaguugaagccucugacuugguuucuucucuuaaaauaccucgccacucccuuucagcuuuaacuuucuguucuaucauuugaauaguagacuugcaggaaacucacaguuaucaaaaauaguacagaaguaaaaacuuaagugucuauuuauagucagacagcuggccagcuucuuucacuguguacuaauuugccaaagcaggagccagcugcccacaguacuuugauggucccuguccacauuucuuggacugggaucagacacuggaguguuacagagcgccaagcguaacugugaaggaggacaguugagacccacugugggggcuaagagcugaccuuugcccuuccuugaacugaugaaguaaacucuuaguaacagcauuaauaucauuaugccaaccaguacacuuuuguucugagaaauucagguuccccaacuuuuaccucuuuggacuuccaaagccuugcaacccuccccgccccccaagauggguuuaugaacguucuccagggcuguguggguacccagcacuggccagcagcagcagccguggcagcagaagcagcaucauuuaaauauuaucauguucaucaacacacacuguagucuuuuaaagauauauuuucaggcugacuuuuugaguaggauccaaauuugcaguaaauaaucaaauagaauguuuaaaaugacauuucacuaauaaaacacagcuucuccaggauuucagcacacacuugcccauaaugaauuacauagugggcagguaacugcuucucugaagugauauugugauguagaugcgcagucauucacacacacauugcuuaggcuuauuagaagcuuuaauauguugaaaguaggucauugccaaugggccugugcuuucuaauagucuuaacuguuucucuccuuagcucgauccgcgcuggacucagccauucguuguaagucucucaucuugguguuuuauaaguacuuuauccuguguguucauuggaaagcuuuuauccaacgagugugggcagguugugaacaaacccugaaggagacaaguuguguuggauguccuacugucauaggcucuucauucccacugggcguuugcucuucacuuggguucugacccauggcguaagcacagacgauguuuaucgaauagaggagucugcugccgcugauaccuggauggauggaaggacugagcuuucacugauccuggcuuuggacuagacaaugcaaaggagccaauuaaaaagccucaggcacccugaaauuuaacuuccagaaugauuaaguaaaaucugccuugcugagcaagaucauauggcacgauccauuucugucagguuagcucauuccucacgagggucugaauaagggagccuuuuuauauuggaagcuuugccuuucuucuuguucuuuugauacucuuagagaaaaacauucugacagauuuugaaaguuuuuauuuauuuauaguuuauuaaagaaugugugucucgccuuuuuaauuaauuuuuaaaguaugugugguguacagccugcauggauguaugcucaccacguguguuccugauauucaacgaugcugggagggcaucugauucuuuggaacuagaguuauagaugguugauuauguggcugcugggaguuuaaccuguguccucuggaaaagcagccaguacuccuaaucgcugaacccccaccucuagccccuaacuagguauaccuuaaugucuuauauaugugauuucguguauauaguuugagaucuaaaauuaucugaaaucuuaauuaauuuguuuucuaaagaaucucaaacguauuucucuucuccccaaagcuacgaaaccuccgagguacaagugugggaucucaaaggcgugcccagagaagcauuuugcuuuuaagauggcuaguggagcagccaaugucgugggacccaagaucugccuggaggacaaugugugaguaucggauggcucagagcucgaaggucguggauugagugacagaccguggacugucauggcguucugaaaugcuuuugcuaacagccaguaauucugguuaucacuguaugauuuuuuuucuccccugugacaaagagaccugcauuuaucugacuuuguguaggaugcagguggcuguuucauuugauucuuaaguaugagaaaaaaaauuaacucauuuaaaaucauuaaaauaaaaacauuucucuaguugguauaguucaacuguucagugucuccaccacacggcuguugaccacacaucucauacagaaaacauuugugccagagcaaagucccauugacagcucuacccagagcaaugcaugccuuacauccuaggccagaugcuuggguggcgcugcuugcugaggugugacaugaccuggaggucaagccccuugcgcucacacggcucugggaugagcugagugacucccgaguugcagugcucucuacaccaaugcucguuggcuugucaucaugccuugucagcugucacaaguuccugccucugacauugcaaagccugcuuuuagcugcucuucauccgaucgcccagaaaacuuagggaccugaccucacuugacauuaguguaaaauaauagauagauaugacaucaggcuagguaggcuaaagauggcguacaguuaaacaggacagugcggcauuuuucucccagcucuuuaugaauuuuagguagagcuuuuaaauuaaaauuucagugaacuaugaaaggauuggccucaugcaaaacacuuucuuggaaaauugaugcuuguaagcucugcucauuuuccccgagugcuaaugggcagcaacugucaguuacacucugacuuuucaguaccccagaucuguuuaaugacacagcagagugugcaaguuuuggacguuucugggucuuuagacacacuccccuuugucgcacuaaagaguccaaguuugaaucuaaauaagaggaggaaaguucucuuggaauaccucgcccacagucaccucuuugaagcccagaguuuagugcaaggagaacauuaaacccuuucccaaagccaguuuuccaaccgcaguuacauaggucagaagauaaauguuuauugacaguagggcuuaguauaaguguaccgggcuggcagccagaucuuuugguucuagccuggugggcaugucauguaggguuuguacucuguuguaguuugcccaaccaaaaaauugaggcugcccacuaaucagcugcauuucaagaaucauucugccauucccacgagagauuaauaauugauggaauuuuauagcuagagcucaggucaugaagggcuuuguaauuggccaaggaucucuagugcggagacugcagggaccaguucuuagccuaguccuuuuucuuguagaauuauuucuauauugaaaacuuacaagguuuuuaaacaaugcuaacguaaagaggcugcuugccuagacggccauucauucaccagguguugauugaguguguuuuccccugucguggaauguacagucuagcaguggugacagauaccuaaaaaguaauugcaacuaagugguugucagccaggaccccagcuguguaggcagugagacccuuacuugugagagugaguaagguagagucuaauuugagaucgucauugaggggaaagggcccaacuuuagaucaaccggugagcauagauucuaagacacugaguguggucggagaaacuugggaucaggagacaaccagagggaggacagacauuucugaacaccccagacgggaggcacauguucacaggccauaaggaaggaaaguucuagaagugagugggucaggccacacacaaaugaaccucugauggguacaggucaaggguugagauaauuuuauaagaguguuacauuaaaaaaaaaugaauuuuauagcuauauaagaugagucagcugguggaacaaagagcaauggaaagccacgguuaguggagccagcuguuugacagggcaucccuaaucauaacagguguuuuuuuuuuuuuuuuuuuuuuuugccuguuucucuacaaauacauaauauaauauguaugucccugcagcuguucugaguacaggaauucacuguagagacgaguacuccagauugcugucuggacagagguaaucacuauguuuguuauuuaucauagcuauggaggugcgaacgaacugcagacccugccugggcucugcucauuucuagugcucagggaagcugccccccaagaugcuuaaaguagccauagcugguggcagguauaugagguaaaacuguucaaacuaugauuugaaaguguauaguguuuaugccuuucccuuaagggucauucuuucuuucuuuuuguuuuuuuguuuuuuguuuuguuuguuuguuuguuuuaaggcauuuauuguagaaaagcagagagagggagagaguagagaaguagagguguggaggggggaagggaaugcagagaggggagcaaggggcaagagagaagcaaggggcaagcagguucucuuucuaaagguguguguagugguccagagggcccuucacagucaucaagaauaaaguaaauguauuaauugcugugacuacuccuaacguguugguuucuugggugguuuuuccuugacugcagguuuucccugcuuuaaucuguuuaacuugauagugcugcccccucgugggaagccugcggcacugcgucuugcugccugccuucguucuguguuggacuuguuugauggaauauagagcauguucugagacgauggagacaguccauuugggaaguugcugggguuugauuauuagccaacacaucaguuguaaccagcaccuuuuggaaccauccaguguccuucuccagggucuggagcacguguuuugaggagcuccccuucugaugcagcccagccaguuuuccaguggugaagcuuauggccguccuaugagugugcucagcacacauauucuuuuguuuaaaaagcuuggagauguagcuuauauauguccacacuuuacucauucguagugugauucauuaucgaguuugucguauaauucaucguguacaaacucuguguggugguccggggaaugacacuguuaggagggggucacugauggaguagguguggucuuguuggaggaagugugucacuguuggggugggcuuuaagaguuuccuuaucuuccuggggaugucagucuucuccuaguggccuucagaugaagaugucguaucucagcuccuucuccagcaccaugucugccuggaugcugucaugcuuccugccaugaugagaauggacugaaccucagaaccuguaagcuagcuucaauuaaaugcuggccuuauaagaguugccuuggucauggugucucuucacagcagcaaaacccuaacuaagaccucugccauagucauguuaggcuuauucuuccuuuuuaucuuguucauuuuucuucccucccgaccucccuccagaccucucuccuuccuccccucccucccucccuucagccucugccucuagaaugcugggauugcugccccagcuuagaacauuuucauaccaccaaaaggaaccgcacuuguaacucuggcccuuccccauuuucauucauuccgcaccuuacacccguguccuaaauaaccuuguuugcuucugucccuguagauaagcuugguuuugauguuuuccauagccgugucaucuucgguaacuggcuucuucacuugcuauaaugcuuucaagguucauccaccuuguagcucgaacuaguuaauucuuuucacagcugaauguuuuuccauuauagauauggcucauuuguauagccguuuaucagguugauaggcguaugaauuguuuccccguucugacuaguaagaaccguguuccugaaccauuuucuacgcagguuuucuguggcuguguuuccacucucugugcuuguauggcagugacuuucagauagcugucgggcuuauaaaggaacugucagauuguuuuccaaagugaccccauuugaccuuuguaccagccgagugugaaguccuggguccuccauaagcccagacacuacagcaucuaguaggagugaaguuguaucucauggaggccuugaugugcaucgcucuaauuguugauaaugucuugcauuuguaaaauucaccacagggaaauguccauuuuguucgcuuugaaaauugauggaugguuauuuuuccuugcuugguuguuuguguguguccuucucaccccuuuauguuccguuaccuguaucuuuguuucagaugaacuuacugucggcgucauugcuguuaaauagagugguucuguaauagcugaugguucgcauuccgucuucauuugguguguuugaacuacucacauucacuguacuugcuaucacuuuagcauuuuuuuuuucuguuuucagauagcuuuacuuugaguuucaugaucauuuuuuuuaaaguucuauuugaggggauuaguugggaagaggaagugaggucagcagguguggcugggggaggcaugacauggcgacacgggaugagggaggguuaugggcuauaugauuuaaaaaaauacuuucuaaacacacgcagaauuguuuaaauuagugaaacccauggauauuguauaugauaauaaaaacauuuuaagaaguuucuuuagauuuacucacuguuuuugaguguaucuuuuuuggagagacuuauagugauacugucugucccuuagcaggaagguuuuggaauuaaggucuaguguuucuucgguaaaugacaccuagauguauaucacggcacuaugccugcauguuugcaguuugcaacuagcagaaagaggaaggcacuggcuggcacggagcccuucucagcaucagaugcacgaagcuuaacauuaguuuucuuuuuccauacuuugucguacucauuuacauaaacgaacaugccacucacguauuagaauuaauucccugcaacuguaguucaguuccagauaugaguucuguggaaggcacugacaccuucuguggaaaccaguugacuauauggaaugcauaauaaagcauuagagacuucauuugcaaaauuaugugcuacacauucuaucuaauauucacauacgugaguguaugcaugcucacaugccugcacagcgccuccucuugcaauacacugcugaggaaaucgcuaauaccuggaauucuuuuaacaugaccuacaaacuuugguuuuguauuccauaaaauaaacuguuagcaagccaauaugccacugugccgugcgucucacggggucaccugccauuguugacagcccguaagcugcagagcauuacgcugguuaucucaggcagcccacguguagccguggcgagguauaauucguagguacagcauuccuucugagugcagagaagguuugcguugauaaugacuaggaaaauguucacggugggguggccuggguacaacagugcuucacuacuccuugcuuuggcuuuuaaagagcuuguauagcauaggacuccauuucaugucaccgugucacagucacagugagccuacagaagguacacaagaaagggucuguccuuuggcguuuugagaaugguugagagaucguguccuguggcgggcuugaagaaugccucagauggcacugcacgguauuacacagagcggcaacaguguggcauuucaaucauaauuauuuuaaaauuacuuuguuuuccuuugugugugucugggugugugcacaaaagcacaggugucagcagaggccagaggccuacaaucccccuggagguggaguuacuggagguugugggccuccugacuguauaagucauacauguuugcaaccacugaaccaacucuggcaccauuguaccuuuaugcguaguuuuaauuuuaugaaguauuaauugaguugacacuacagucgacucagcaggcugucuuugauguuaaauguuuguuuguuuuuuuuuuuuguccauuugucgaguugaguaugcgguauguguauaauaauaccuuuuugcguuuuauuucucugacauguuuacauaugcugucugacccuaauguuuguuuugucuucucucccuuuaguuugaugaguggugugaagaauaaugucggaagaggaaucaauauugccuugguaaaugguaagaauaauuauuguacuuugucaguauaaugaagggauauauauauauauauaucccacacuaaaauuuauccuugggaucagaauaauaggcaccacucaacccugaaaccucaccgacaagggugcccucuugugcaaaccauugcagauagacacuuggaaucuacugaucgguagcgugccuuuuugggcacguugcagcgguuugcauugugagcaagcuucuuaugaaaucgcaaacuacuaaucuaguacuaaauuggugccacguggcugugccuuucagaacgcuuauuuaguaugaaaaucauaagggcuuguaaaaugacaaaggaugguggauugaauaaguaucgggagcaauaaaggcguaaugauuuguaaguuuucauccuguccguguucuccucagagguucauugguguagacagguccgcugaauccugaacauagcgaauguuaccaacagcaguucauccaacccaccgcagagaaaagcuguuugcuuuauucauaaaggcaacuauaggacuuuguacuaagcuaacaccuuaaugucucuucauccguuucauugaucuuaaauguaaaauaaguguaaauuuuguuuuaaaauaacuuuaauauagauuguugguuuugguagcuaacuucuuugcuguagaucgagcuuguauguuggaggugauuagcacaggaugauggccccacaugaaacugaaguguagcauagaauugaucugaaaccaaugauacacaucuacguguauaguucagauuauaauuucuaugagcaguuccuucugucagugaguucaugccauuuguuggguaacacuacuuuuuaaaauuucuacacuuauauuugaguugugugcuuuaauauguguucugucucuuucagggaaaacaggggaaguaauagacaccaaauuuuuugacauguggggaggagguacgugugcagcuuacacuguguuccugcggcucacacugagccaucugagagagaacuguuugcauuucccucccucgggccucacugugugucuacucauauuuaauacauugcaugcagauugguuauugcaggaacguuguaugugaaugagauuuggaggacaucagcccuuguuggacaggacaccugacucaaagcucugaguuuguuuagauugcucccugaaguuagacauaucggaagaccaguauaaccaguucacacaguuuggcuuguguaugguuuuugaaucucaaaaauuagucaaaagugggagccuucaguagauaagguaaacucagguucuagaaaagcaaugcucccauuaauucauccuauuaacuauuauuuauacacaacacacacacagacacacacacacacacacacauacauauucagguucuagaaaagcaauacucccauuaauucauccuguuaacuauuauuuauacacauacacacacacacacgcgcgcacacacacacacacucacacacacacacacacacacacauauaacuggacucugcgauuacauaguaaauauuugagagagggcaugaacuuuucuuugcaguuuacaggacucagaacaaaccacagauauuuacuccuucaguguuugggaguccuagggacagagcaaggucacugucaugcauagcaagcacugacuccccaaagcauguuaccacaaagggaaggauuucuuuagaaaaugcauuauuuuuauuauuguaguuauguguaggugugcgucugcauguagauauauacguauaaggaugcagguacaugaggaggcucuuacagcaugaguuacaggcguugugagcugccugauguaggagcugaggaccaaauucaaguccucuggaagagcagcgagcacuccuaagcuuugagccaucauucaagcccacagggcuccuuuaucuuuaaggaaggcgggcuuaccuuuugguucccuggccccauaagccgguagcucucaggcugucgcuguugaugcucaguuucaaggccagcugaugugucugauauuucuucagcucuuaauaagcugcuguguguuauuuauuuaagcuuuagagaauguuucauagcugucagagcuauauuaaauuacacuguucccaucaguuuuaaguucugagggcauaguugcucuuaguauaauuuauaacacagaaacucuuccgugaagcuguugaaaccaggcauguaaacagagauccgguacugcucucucagcccaucacugaagcccauuugcugccaaaaacucuuccugguucagaaauaauagcaguuuagugucaucuuuucaugucaaugggaaugacucguuggcauuuauguuucugcauuaaaaaugcucuuauuauaaaaugcaaucaauuagagaaaaauguuuggaauccuugcuguuggaaaagagagagagagagagaaggcuugaaguaauagagcucuggaguccuuuuagacuuguggccuauaaggaaagcuaacacugcaaagagcucacaagagaaaaugcuuuaguaccugaccagucugucuggcaacaccaguuugcccucaccaagcuggauuacugugaaguuccuguggccuugauacauaagagaccaacguuggccauaauuaguggggcuuuuaguuacugucuacauuccuucccucaguuuguuacagaaugguagaccuagaaacuuuuaaaauaugccuuuuuccauauuacaaaaaaguuuuacagaugucucugaguaagcagggcuuacuuuuccuagacaagcaccuauguuaacaugacccccugugguccccaaaaccucacauggaccucagagucaggcuuccuauggacgguggacccuguuacacuucugagaggccucugagggccucacuauacgaaugaugcucuuacaugcauucaccguggauuuuuaguggccccuguuuuaugaaugggaaaaacgcaagaugauucagggcuggaaaauaaaccucacagcaaagaggcuuaaggaauuauuugguaguggauuauuuuguuuaguguuuuuuuuuuuccuugaaaauuuugaauuuuuaggccuuuccuaagauucuuacuugacaucacuuuucauuagaaacaauuagucauuuuauggauacuucauauaacgcuaauucuuagagauuauugugauaguaauuccauuauuuacaaauaaaauccccaaccacucuccauucuuuuucuucagauguggcaccauucauugaguuuuugaagaccauacaagacggaacaguagugcuaauggcuacauacgaugauggagcaaccaaguacguaaacucagagccuaacacaacuuuuggacucauaauucauacuuuaaaaagcaauauauuuucacugaaaaacaaaucuauuaaguagauaagguaauuguagaaaguacuaucagcucucaaaagucuguuguccugucuuuacauaaaguccaucguucauauguuacgaugaacuuugaaucccauugcacauacguauuuuauacauucuuuuguguuauagcaggauuagaugguuuucucuaacauucuccuuuugguuuuuggauugacauucuucaguagcauuuuuagggcucagagaaguucguccucugggcccacauuuguuaaagcuccuccuuaccugccaaguuuuucuucuaauucauaacauggugauaacuuucuuuugcauauuuuuuuuccucuuuuggaccuuuguuuauaacauaaggguuaauuucugaaaauggaauuaacggucaagggugcagaugugaggagugugugugugugugugugugugugugugugugugugugugugugcaugcgcacacgcgugugcacacuugugugcuuuuacaccuguacaugugagugcuggugucugugaggguucugaagcuggagucacagguaaucgugagucaccugacaugcaggaaugcugugaaucuagguugggucccuuguaaaaagaguuaacugucuuacccacugagccgucaucuucugcagcccaggaaaugauauauuucuuacagaguuuagcagcugaugacgguuuuguagcuuguuuucuuguauugugcguccugggaaauuuggaaagcguagaaaagcacaaagaggaaacaaguucccacaucccaucgcccagggaaagcgaguguaaacacuguaguuucuugaugacuuaaugcacauuuuccucauuuugguauauauuuucccauguuaaguauuccuuuugguuguucauaugcguuuuaaaauguacguuaugauuuuauaaucuuaaaagcucaauaaccuguuuuuccuuaaaaauugagauuauugaguuaaagaaugugugcaucuuuuuagaguuucaaauucuagauggauuuuuuguuuuuguuuuuuuuuaaugacuuauuucauuauuugugagacuagacuuaugugugugcucacuagauagauuuuuuucuuuuuguuuuugcauuuucuuuuauaaaauaugaccauuuaagcugacccauauuaauuaguaaaaguucuuuauauauuaagguauuaaccaguucucuuguuaaaaauacaauuuuuguagacaaucagcuuuuaauuuugucaacuuaaggugccuuugacagaguaggagcuuguaccuaguggugccuguaggcuuuuccuuuuaguuucucugacucuuaaacugaagaaguauguuuccauucccaaauuagauaauuuaguauauucugucuugcagagauuuuauucuuuuccuguauuuucaaaacccauuuguaauuuccagagcuuuacagagcucuguguguucuaagaugguguaggcucguuucugguucucuucaguuagccucuuucuuucuguuugucucaaagacaccguuucagcugcuuuaugacuguuuuguaaaaaugaaugugcuuuauuccucucugauauaaucuuuuaaaacacucuauggacaacacugacauuguauauuuuuaaacugguucaacugaugauuaauguuaaaucuaugaagugaggcuugaugcaaccggcagguucagcugacuuuacacaguaaagccucauuaagccuucuucauuagaaaaagugacuuguguguugguuuggcuagagucuagacuauuauguguauagugucauuuuuuuuuuuagcauaaaggcucccuuuuuugucuagacacacacagucuuccuuuuuucaugcuuuuauuauuaagccuaaugagaaucagagcucugaugagauacugauguagucuugagaugguugcauuguggguguccugaaguccuccagaagcaguuagccagccugagcaaguccuaucagcccugguccuccccaccugcuggaggccagcacucaugucccuaagaagcuguggagacuguaaagagaugcugucuucucagggugggcucuauauucuguucagcauuccuuauuuuggauaaguagaacggcaagacaauagacguguucccuugcgacccaauaccgaagcauuugaaacuaauugauguuuccuuuuagguuucuaagcucaguacacauagcucuuuuaaccucuuaucauauuguguuucuccuucauuuccuuuccuggcuguguuuccugggcauccuuugguucauuauugucucucuucaaaugagugucucaaauuaagcacaguguuccagauguggucuggccagaacuggcuauaacggagacgcuaacuugcccuguuucaggagauuacauuucuuugcauauucaugcagacuagaauuauauuaguuuucucuaagcaaucaaaucacauuuuuggcucaugaauuuuuggucaaguuagauuguuaagucgucagaucuuuuccuuugaugucagauuuuucccuccauucagaacuugauuuuguuuuauguaaaugaagaacuuuauauucauuuauuccuguucaauuugauuguacugauugggccugcuuggucuugggucugacguguauccuaagaggguuccacgauccaggcuuuguacuggcuccaaagucauucgugugucuaaauuuaagcccuugauaaaaauguuuaccaagggcaguaugccgccaaacuagagaccugguuccucacagaauucuucgguuaauccauuucagggaugacuuugcagaccgcugcuagugucccccaguaggcgugcugucccgcugcaccuuaguuauuuuacucucagcagcuauuuucuggggcuaucagaugcuaacuugaaauucauagaggaaacucauuucaguacccugaucugcugccauguagcucaaguuucagagaugucauuuaacuuggcuugacucaugccugcgcccuuccagcugcucccccuugcuugucucccuucauuguuauucuuacaggggcuguuguggucuuccagucuagauuuuuguuaggaacuggaauuuguucuauuggaagcagaguuauaggugaacacugucacgucuggcuuuuaagugugcuguuagaaucaaacucgaguccucuuguuugcccagcaagcaugcuacuacugagccuuccucuccuuggcccuguuugccuuaaaaccaaagcaaaaccuagguaaucaauugguguacccuucccuagggaagacuuucucagcauuuccuaguuaccuguagugguuggucaugguggaggccuccugacagcccccuccccgccacguuagcaugcucauugguaugacccuuguuuaggacauguuuaggcaugcuuggagagacuuucugccugcagcuacugacauuucuggagauaaagaaaaagaucucauggcaaacuucuuuuuccucuggcacuuguaaucuuucugccuuaucuucugcaauaaaccugagccauagacgccauguuauauuuauuuaggaacacauacauacacacacacacacacacacacacacacaaacacacacaccaccaccagcagcaacaauuaaagaauaacaaaaguuauuuuuuaaaaauaaaauacauuaucuauagaaaaagaaaccccuagaguacuaaacuuguaagagcuuagcauauccauuuuuaguuucuaaaacaauugacucuuccuuaagaguguaucagugguuuguaacaauuggcuacaacaaugguuauaacaauguaacaaguuguguuugggaugcgucuguauccagaagcuguaacaaauugcguuuggggugugucuauauccagaagcuuacauugacuuuaaauuacauaccaggacuuuguugaguuacugcuuccuuucugugcuugccuccucggaggaugccuugaucacacuugauccugguacucauuuuguaaaucaggguuccuucauuauacuuuauuacucuuucugucuuuauagcagaaauucuuuagugguuuugaguucuguuucauucugacauggaagguuuucauauaauauugcuaaaagcuuuguccucaguaaugugguuugccuuauacuucaaaagcuuuccuguuuucaguuaaguaccuugcuaugacagcaguaauuuagaaaccaauccucucccugauuauuauagagugaaaauuauuaguuuuaguuguuugcuugcuuguuuuuccauuuauuuguuuauuuauuuuauuuguuuguuuguggggguguggugguauaugucacauguguggaggucagaagucagcuuuuaggaccuguucuccaccaccauguguacccagggaucaaagccaagucacuaaguuugcuggcaagugucuugaccaacugagccaucuccuaggcccacauuugcuugcuuuuaaagaacuacagucucagaagaauuucuggggagcaacugucuuuuaucucugguuuugaugcuccccucuccccaucuucuauuuuuuggccuucagacucuacaggaaugugacuguuuucuuccauaauuccugauauuuauauuucuuaguuuauucuucccuacgaaucagaauugauuccagaaaaugagcucucucuuuucuuuucguguuuuggaggcaugauuuagcuggaugguguaggccugcuggauguaccuccucucccagucagaguggguccugaugcagacucucaucucuggucugggcucucaguguucaggaucccaguguagcuuugagccuuacucagggugaguuucuugccccccuggccccgcucacucugccccagcuugcucuggccauauuuauuucauauauguggguacacugucacugucuuuagacguaucaggagacgacaucagaugcccauuacagaugguugugagccaccaugugguugcugggaauugaauucaggaccucuggaagagcagucagugcucuuaacugcugugccaucucucuaauccaaggaacacacacacacacacacacacacacacacacacacacacacacacacacacacagacaaaaugcauuuuagguuaacauacuucaguuaauaagaacaaucauccagaaggggggcuacagaaaccagaaagcaagguuuauacauuuagaggcuuucucagaacuaugggcuuugacaaauuagguuucuguuuuauuuuuggcaaguagcacugucugugugcugaguguugcaacuuggauggugcuuccauuauggagucaguugagccuauucagaucuggggcccugcuacaucaguucccauuccaaguagacccuaugggugaucaaaggagacccuguggaugcuccaaggagacccuaugcaacauuaggaugucuuuaggcccccuugcuuuguuugcuucaguccugcuguagcauuggaaaguuuucuauuuaucuuaaaagaagucuucucuaaaauaauugauucaggauaaaccuuugaaaauggauuauacuuuaguuaugguggaugugugaauaagcacacacauucuauggugugcauauggaggucagagaacagcuugcuagaguugguuucuuuacuuccaccaugucuguucuggggaccgaacucagaucuucauguuggugucaagagcuuuuaucuucuugagaaauccugcugacccccaaaauaaaauuuuaaaaguguguguguguguguguguguguguguguguguguuuguguguauuacacagguuguauaggugugugugcuccugagggcaucaggugucuuugccuuguucucugcuuauucccugcuuauugccgugcgucuggaacucaucguucucugcugggcuaccaagcagcaagcuucagcagaaucuugcagccucugcucucccgaucaccagggauacagaugucuguggccucacuggcuuuucugacaccuguauauauuaguguucucacucgggcuguuuugcauugauuuaaacuuccuccugaaauaggaaauuacccuuugcuuaaaauagaauagaacacaaaaggaacauggaaacagcucacagacuuuacauaggaagaucagaaagcauuacaagucacugggaagugauucuuagaguuggacauagacacggguacuaggguuuugaggcucauggccauuuguuucaggaaaagcgagaccacaguuaccagcaagggugugaauccaggaugaaagguuggagggaaccagggccagguuuccuauaguccuuuuagauuuaauuuuuaaaaucucuaugugcgugcaugccuggauuuguguggugucugcacagaaguaccugccuucauguggagauuagagcaguauuuugggucuuuuuguacuguuuucugacuugcugccuugagacaggguuuccuacugcgcugaaaguuaacuaguugagcuagguuggcugccugaugagcucuuggcaucagucugucugccaucuuagugcugguuuuacagggacaugcaugcccuuucaggagggaggcgugcugguaucacagggccaugcagccgugcaugcccuuucaggagggaggcaugcugguauuacagggccaugcagccgugcaugcccuuucaggagguugcuggggauuucaaaugagguccugugcuggcagagcagguucagagagagacccacucagccaucucuccacaccauaagaaucucucccagcagggucacacuaggcaugcucaaaugauccagccguaaaugaagacaacccauuuaagugcugucaccugaccacccucuauguuaccuaucgccaaguugcagacacccacacaauagguguucaguguaaaugaugucaucugugcaccacaggcacaguucugcaaaggguaggugcucgccucagauccaggugucugggugccaacaaugucagccuuacugacaggccuuucuaagggggcuggggucuuuuaugcuaauugcuuucugcacaagaauuguaauguuccauggaauaugcaggaguuaguggaugcaaguugauucuagcucucuggcgaaguuggcuugguuucuccauauggaucauaauguucaguaguaaaauucaaauggcagaaagaugauugagugucucuucaauguuuguguguguguaugcaugcccuuguauaaacucuuugguagaagagauuuuacuuuuuuaguguuuugaauaggggaacauacuugcauuuggaucaucaaucguuuggggagccaauguuacuguuguuugugaauucaacauucauuauuuuaauuugucaagauugcaaacugaacuuuucccgaggaagaaauacaaauggagccccguggcccucugcggagguagccaugcuggcgcacugugagccuauggccugcccuccccuccacauugcaauacauuuuauccuuccagcaucacagcucaucugguugugcugacagaggcaaaggagucuuuaaauguagccagaaaauagcuaaccugaagggcuucacagaggcucagguggcaagcugcagacacccacacaauagguguugugugggcuuuuuuucuuaaaguaaugugugcauguaugcauguguguacauguaugcaugugugcgugucaaugugugugcauguguauaugcaugcaggugcccucagaguaaccccuaguuacuuguaagugcuucagaauucucuagagcugagguuauagguaguugugagcccccauugugggagcugggaacugagguugaguccuuugcaagagcugcacaagcucuuaaccacugcucuguuuuuucagccccuuuaaacauguauguauguauguauguauguauguauguauguauguauguaugaauguauuuauuuauuauuuucaugggcucuuuuugaacacagacauuacacuccauuucuguucauuuguucacacugcaucguucagaaguggcucugacaggcugcagauuuccuggguuuuuguuuauuuucacaccgauucuagugaacuugcuccaggcuaggaacaaccauacucaagcugcccuaccauccccaucccguggaugugauuuuuuuguaucauuugugacacugagugauccauguauguuucauauuucauaaagcuccucuuuaaaugcagaguaccucauuuaaaguuaguuuaagacuguggggguuuuguuuuuuggaguuuuuuuguuuuugauuuuuccacuaaggcagaaugagccccuuccucuccaauaguccuguuuucagauggaacacuuugccuugguguuagcagggcagaucuaucuaaucuauagaaguuggguuggguggugguagcgauuuuguuugcaugcuauaggacuucacaucaaauaaccaagguacuugacccuaguuuucuguuucuagcuaugcagcuaguguucaucuguuuccguucugcucucugugagacaggagagggaaucacugauccacauggauguuucuuuuuuaaaaauuauuuaucguauauaugugaguacacugucuucagaaacaccaguagagggcaucagaucccauuacagaugguugugagccaccaugugguugcugggaauugaacucaggacagcugauagaauagucagugcucuuaaccacugagccaucauuaccacugccccacauggauguuccuaauggcgucuaucaguugagggcuucacuaggggcuaacgugucacugccuuccgggcaaauguuuagcuuucccguggguucuaauggccauucugacuaaauaaccaaagugcagcuuauagaccucuucucaagauuuguuuuagauaaaagauagugacgaacaaccuuuagcaucugucagcguucacuuuugcuccguuugcguggacacugguugcuuaagaccuggauguaguuuggguaggcguccauuagcagagccgggcucucucuuucugaugaaugcacuuagaaauaacgaagggaagagcagucguuaggcaaugcugauguucaacugaugcucucucauuaacuucugacuuugccuuucaucacuaaagagcucaaguaggaauguuguagaaauuuuuucuguauccauuuuuuuuuaaauauucuuugauguaguuugaaauguuuucaccaucauauucaguggcucuauugcuugguaaguguuuagaaagugcaauaccccacaucuuuugcuccgucuucucuugcagacucacggaugaggcacggcggcucauugcugaacugggcagcacuucgaucaccagucuugguuuccgagauaacugggucuucuguggugggaagggcauuaagacaaagagucccuuugaacagguuagugucuggggcguucauaacugugggacuagaguagguagugagacuuucucauacaguauucucaugcuaguuauuugaaaauuagacuaagcuguuacugaauauguccagauaguuuuuuuuuauaaguucucuguaaguaauuaaaaugaugaugacuuaaaaaaaagcuucacaauaacuuuaaaaaugauuuccuucuuauagaccaaugcauuaucaugcuugggccuuuaaagaacucagguuauuaaggauuccaguucuacuuugauacuagaaucaacugaaucugcaaaugucucaaauagaauauaguuuuugacaauucuuuuuuguuuguuuguuuugguuuuuugagacagaguuucucuguguagcccuggcugucuuggaacucacucuguagcacucuguagaccaggcuggccuugaacucagaaauccgucugucucugccucccaagugcugggauuaaaggcgugugccaccacugcccgugacaauucuuuaaaaguaggguuuugggggggggguugguuuuuuuuuguguguguuuuuuguuuguuuguuuuguuuuguuuuuuguuuuugaugguuugccacauagcuccuugucccuaagggucauccauuuaacaucuugagucuuaaguguugcgugaccuuauuguugacaugugugucacugaagcgagggcaggugugcuguguuccucuacauuagcagaucacacucauuuuuguuuuaaugcugugaaucauccuuguguucccuuagcacauaaagaacaauaaggaaacgaacaaguacgagggauggccugaggugguggagauggaaggauguaucccccagaagcaagacugacgggaaggagcgagaggcgaggaggaacgcacuuugacucugcaggagaguggucaggcagccgcucuguguacauauuucaguagcauguggccguccagggugugcaugagcaagaccgucucugucgauuccaggauuauuuauugcuaacagaaauggcuaccuuuuuguaaauagucuucauugagccaaucacugaacuauuuguaagcacauuucccugaaaguacaacguguagacgacaauggcaauaauguauuuuaauucuaaaagcauauucaggggguaaccacgcagguuguacaggacgccgauauuuauccugguugcugggaaacccuaucauggaauaauguggcuuuuagggaggagauuuuguucguauacgugucucuguauaaaaaucuggcauguuauggcaguacccuucaaaugaaagagauuuuuggcuaguugucuguguacugucaccuuacaguccaacuccuguuguaucuuuucacagucuuuauuuuugaccuuccaaagaaauccagaaauaaaauguuucacacaaaaauuuacaucagauuugugaaaagcacaacaguuuuuuuguuguuguuauuuuuuuuaauaacagugaagaggaauauuaauguaggugucauucagagcucauuuucucaauucuguguuagcggugugaauucugugaugcuguguaagcuguguagagugagccuagggguaggauuccacagaacugggggcccaggccgagucccuuccucgaccuaaucaggucauucaagacaacugggucaguacauuuaggguaauacaggcauuuuucugcuuucaucgaccacaugauuuuaggacaggaauacuugacucucauagccuugauuuguaaaccaagaaauucuguuauuuauuucuaacuuugugauagcagcuguugccuaaacguguagcagaagccuugaaaagucccgauuauuguuuuuuuuagggcauuugaugucuauuauauaggugacauacauccacuucaaaugcaacauaaacaagugaaauguucaugcugcccuuugugggaugaggccacacguaaaaucugaaccuaaaauuuaggugguuuguauaaaaaucuaagagcaguauuugcuauuuuguuaaaagcuagaagcagcccagguguccccuucuugacuguuacugaccugcgcuacuguuucucuccucaaauugaauguaguucaugaggagauaaauaaucgucugugcucagagagguuuuguagacuuuaaauguagaguucugcugcuccuguacuaauacauccagcauggaugguuuagcuuuucuuuguuuguuuguuuuuuguuugauuuuuuuuuuuuuuuuuuacaguucuagggaugggaaaauaaacauugcaggguuauuuuguuuuuuaauacugaauauaaguacucuugguuugacauugugaauuuuuuauuuuucauuuuuguauuugacaaagcacuauaccugcagaacauccccugaaauccuuccuuuuuuuuuuuuuuuuuuuuuuuuggauacaucuuaacauauaaaaauuaaguuuuugccauucaacauaguaguaucauauggccuggauauauuugaauguguaugaaguaaaguugcuugagaacaggcuaacccuuugagagaugggcuuuccauuugcauaagcugcugggagggagaagacugguucuguaacugcuguggcccaguggggucuuuuggccuggauucugucuuguacugguuacaccggcucaacucgggaagcaauaaucgacuguuuuauguucacaucagccuuagaaguggaacagugcucacuuacuguugacaacaaguuuucuuuauuaaaaucaaaaaucuuuaacacugac

SEQ ID NO: 2853 - RNA, 890 nt, Mus musculus
gaagauggcgucuccucaggccagauugugaucgcaaugaggcuucggaaccagcuccagucaguguacaagauggacccacuacggaacgaggaggagguccgggugaagaucaaagaccugaaugaacacaucguuugcugccugugcgcgggcuacuucguggaugccaccaccaucacagugucuccacaccuucugcgaaaguuguaucgugaaguaccugcaaaccagcaaguacugccccaugugcaacaucaagauccacgagacgcagccguugcucaaucucaaacuggaucgggucaugcaggacauaguguauaagcuaguuccaggcuuguaagacagugaagagaaacggauucgggaauucuaucagucccgaggcuuggacagagucucccagcccaguggugaagagccagcccugagcaaccuuggccuccccuucagcaguuuugaccacucuaaagcccacuauuaucgauaugaugaacagcugagccuguuccuggagcggcugaguucuggcaaagacaagaauaaaaacguccuucagaacaaguauguucgaugcucuguuagagcugaggcccgccaucuccgaaggguucugugucaccgacuaaugcuaaauccauaacauguacagcuccuuuuugacaaugagguucucccugaucacaugacaaugaaacagcuauggcugucccgcugguucggcaagccaucuccuuugcuucuccaauacagcgugaaagagaagaggagguaggggccaggccugcuuccacccccuucccaccccuccccagauauuuaugugaaauuaacuguggcuuuauuuuuugaaauaaaugcuuuaaaaaagcaaaaaaaaauuaaau

SEQ ID NO: 2854 - RNA, 2078 nt, Mus musculus
cauggcgucguccaccguggccaagaaagagcagcgccuuccuaaaguggcccaggucaaaaacaaagcugcggccgaggugcagauaacugcagagcagcucuuaagggaagcuaaagagagagaacucgagcuccucgcgccuccaccucagcagaagaucacagacgcagaagaauucaaugauuacaaacuccggaaaagaaaggccuuugaagaaaaccucagacagaagaggacugugauuagcaacuggaucaaauacgcacaaugggaggaaagccugaaggagcucgauagggcucgauccauauacgagcgugcuuuagauguggacuaccgcaaucuuacccucuggcugaaauaugcagagauggagaugaagaaccgccaggucaaccaugcccgaaacaucugggaccgugccaucacaacucugccccgagucaagcaguucugguacaaguacacguacauggaggagcuguugggcaacgucgcuggugcucgucagguguuugagcgcuggauggaauggcagccugaggagcaggccuggcacuccuacaucaacuuggagcugagguacaaagagguggagcgggcccgcaccauuuaugaacgcuuugugcucgugcacccugcugugaagaacuggaucaaguaugcucgguuugaagagcagcacgcuucuguugcucaugcgcggaaagucuacgagagagccguggaguuuuucggggaggagcauauggaccaacaccucuauguggccuuugcaaaguucgaggagaaucagaaagaacuggaaagggugcgaguuaucuacagauaugcccuggauaggauuuccagacaggaggcccaagaacucuugacaaacuacaccaucuuugagaagaaguuuggugagcggagggauguagaagagagcaucgugagaaaacgccgauuccacuacgaagaagaagugaaggcuaauccgcacaauuacgacgcgugguuugauuacuuacgcuugguggaaagugaggcagaagccgacaccgugcgggaagucuaugagagagccaucgccagugugccaccggugcuggagaagaggcacuggaagcgcuacaucuaccucuggguuaacuaugcgcucuaugaagagcuggaggccaaggaucccgagaggacgagacgcgucuaucaagcgucucugcagcucauuccucacacaaaguucaccuuugccaaaaugugguuguauuacgcccaguuugaaauacgacagaagaaucugccauuggccagaagagcuuugggcacuucccuaggcaaauguccaaagaacaaguuguucaaaggcuacauagcccuggagcugcagcuucgagaguuugacagaugcaggaagcuuuaugagaaguuucuggaauucggaccugaaaauuguaccuccuggauaaaguuugcagaguuagagacaauccuuggugauguugagagagcucgggcaaucuaugaguuagccaucagccagccgcacuuggauaugccagagcuacuuuggaaauccuauauugauuuugagauggagcaggaagagccugagagaacacggaaccuuuaccgacgguugcuucagagaacacagcacgucaagguguggaucaguuuggcucaguuugaguucucuucugggaaagaaggaaguguggcgaaaugcagacagauuuaucaagaagccaacagauccaugagacacugcgaggacaaagaagagagacuuaugcugcuggaauccuggagaaguuuugaaggggaguuuggaaccguagcagacaaggagagaguagacagacucaugccagaagaggucaagaagagaagaaagguccaggccgacgauggcucugaugccggauggcaagaauaucgggacuacaucuuuccagaggaugcggcccagcagcccaaccucaagcuucuggccguggccaagcuguggaagaaacagcaacaggaaagagaagcugccggccaggagccagauaaggacaggaaugagggugaauccucaucucucuaaa

SEQ ID NO: 2855 - RNA, 9375 nt, Mus musculus
auucaucagucuccucaagagaaaacggaugcaucagaugguuaauuccacuuuauaauuuccacuuaugaguaugcauucacacacguggagggaaagcauucuucauggugcucaggccugcuuccacccucauuuccauaaccugaggaaguccggguaaaauagcagucgaaggcugagcaaaaucaaagucccugcagugacuacguugcaaguuuuuccguagcguagcgcuuuucuuaaccuuuaguacucagagacgucagucggucucuacuacaccaaagcccugcguggagccgcuugugugagcugcgcaggcgcaaaucuaccucuccuaggugggcgggagcugccccuacccagcccgagcgguuggagccaagaguguucuuaggugacucaggggcagcaucgacgcucgauugagcgggcuugggaaagguucccagagggcugugcgcuggaggcgcuggacgcugucauggcgggcuugcugaaaaaggugagcguguggaggucaccgugaugcugcgaauggggaccguaggcagccgcgucucccucaucggugggcagagacgcuaagaggagggguugggggaguguuccgcuguccuggcagggggcgacagggugcguaguugugucgggagggucggcuaaccaggggauuacgguaaacaucacgguccuguuuugucucugcacagacaacuggccuggugggguuggcggugugcgacacuccacacgagguaagugcgacuuuuugugucguccuucucaagcaagacugugaucgaccgaacuugcccuugcaagauuaacgagacccccgugagcucuggccuccggggcagcgcugagcuucgcugaccccguggcauccuuuuugcaaugccuccuuuugccuucgccgugaccucuuaauuaagacgcguuucuucacggcauucucuuagcgucagugguguggaguauucucagcucccuucagagucgcauuuucauuuuccauccuuucccuaccgacauuucugccuugccuuucgcacacuggcugacccugucguccucaugguugccuccuucgguauccauuggggaaacauaaacaacaaccaagaccaaacaaaccuaaacaaaaccacugugauuuauccccccuuucagcaauugcaccauuucuuuccuucccgucuacacacauaacucgaaagcguugucagugcucacugucucuuacuccuugaguacacuuaagcgaggcccaaacuuuuuuuuuuuaaggaguuaccagugaugcuaaauuugcuagucaguucacauuucucguaauuguaccgaaaguggcauugaaaauauccuuacguuuauuuauuugugugcaugccaguguuuguccgucagaaaacaacuuucugaaguuggcucucuccuugcaccuuguagauccuggggaucuuucaggucacggggcuguuggcaggcaccuuugcccucugugcccucacauugacccaagugaagcauuuuugacacucuugauaaucugcauuaaguacuuuguuuacuggaugucagagcuucgaaguuucuuaguuugggauuuuuguuuguuuguuuuauuguuuauuguuucuuucccccuaauuauuugccuuuuccaguuguuccuucauuuccccauguuguaguauugaagaccuagcucuuagacagguuuuagguuuagguuggcucucaugggguacagacaacaguuaacguuuauauuuccauaucaaguacugaccuuuuauagucauguguguguauguauguauuacacacaugcucuuaguugacaucuucacuugugucaggcagcuagguaaggguuagcauagccagcugggaugucucauuugaaaugguccuggauugcuugcaugaccccacaccucacuugccacuaagaaaauccucuggguugaccccuggguuaugcagccucuguucacaucucaucaccuccuuggcugcugccauuuuuucugccaccauccuuaucccugugacaauuacauuucucuuguaacugcuuuucccugcuuucuuucagcugguuugcaagugcuaaaacauguuggguaugcaaaucuuucuuuaaaacccucccguggcuuucuauuuuagggguuguccagaugacuuaacagaccacgcuccacugacaugucuguuccagguuucacaaagacuuuauuuugcguucacugcuagaacucugacuaguacauaguacauagugaauacugaguggcuuucuugcagucuuuaugaacuucagacuuguggacaacaaaacucacacuucuauuucuagauauucuuccucuauggguugaaugucucuugaugguauaugaauuguucuguccccagcucugaauuuggauguuguuauugauaucaaaaccuucuacuuucauauuuauccuaguagugaauugugcugcauuuuucugcagcagucuccaguuuguccucuuucgucuuccaucagauacaacugcggcuuaaguccuuguucuugaucaaaucauugcggcagcuuuauuccugcccuuccugaucuguguccauuguucuuuagcucacgaccaccagguugauuuuccuuaaacacaaaccuuguccuuaagucuuuuaguuucccccacaaaaaggcccaagugcuuggacuugugcuauaaaacacugcagucuaacuuguucucccgcuuacuuauuuccuaagugcuugcuuuauagugauuucuagugaggcgcucuccaaggagaucugagcaccacguguguaagcuaagaguuuucuagaaaguucuucuuuaugauguaaccuaacauuaagcguaacuaucacuucaugauauaaucaggaugaaaacuaaugcuagucugcagccuuuuuucaguauauuuuacuuacaucauauuuuagccugaauaaucucauuucaaguauucuuuaaccguguuuaccuacugcacagcacagcuguagagcuaugcacuauuuacuucauguucuugaugguuuuuuugccaucuauuucuuuauuacuucauauauaaauuauuuuuuccaacaucuucaaguuuuccacucgcuaucccccaaacucugucucagauguauauuuuuuuaaugaaccauucuauuuuccgcuggagugauucuucccuuauaggaugcuaauacugggaaugagacaauauguggcugguacugcucugauccagcauccuauaaaguucugcacauuuuacagaugaagaaugagggcaucuggacagaaauugucuaggcaaccaggcaguggggcugugugagugcagguaguuggcucuucuguuguuuagcacucccucucugcccuguaucuuacccuggacugccauaaguugacuuuguguuuuaugauguuaaucaucuuuuccucuuuuguuuuuuaccauacagccucuuauguauacacucauauauauauauagugggauccauguccagucugucuuuauauccaaacaacacauggugcucucuacauaggaacacugaaaaauucauucuuacuggaaaaggaaaaguguucuguagaaguggugauugcucgugauuacugauacacucagguguagggugagugcauuccugcuugagaggacagcucuggguuacuucuauggcguaaugaugaguagucucuuuuuacugugagaggugucccaguuaguuuuuuauucuuuucacuguccuaugcugaucauucugacucuccugugaauuucucuaagacuagaugcauucggucucauccugaaagaugaaaaacauguguuuucaauuuauuucauauuuguguauaugagugguuugccugcaugugugcauaugcaccacuugugugccuggugccagugaagaaggugucacauccccucggacugggguuccagauguuguaggcugcuguguagaugcugggaauagaacccaagucuucuagaagggcagucagugcuuuuaacuacugagccaucucuccagucacuccccgccccugccauaucuuguucaaaaaccuuaaaauuugagucagaaugaaacuuaauaaaaugcuauauuaaagaugaauauauguauuauauucauaaauuugagaggguaagaauuaaaauggugccaaaauuaauaguuuaaaucagaucacauccuuucaaauuucuuaaaaagaaaauuucaacuugccaaguuuacauccccagaaaccacuuaacuguuguguuggugugaaguuaccuauaguucugacauucagaaggcaaaggugggaucuuuagagucagcuauagcuaggccauuccugucugcaaacucuagguucaaucacaagacccugccucagugaaucacgugggaagagauggagguggaugcccagccuggguucuguacauacacaagcacacacguccauacagaccugcaugcuuacaugugcggccaugcauacauaugcauguauacugcauacacaugcuauccacagucucuuuaauuguggacacuaauaaaaucagcaaguuacauacucacucuccuauuccaagaaagaaaaacaggauacaguuagaaccagaucacuggaacaguaaaacccaacaguguaaauagcucauugucugacaucuggaauguacucaugaccuucugggcuccugauagcuuggaguagacucacuccuuaggcucugugauccucaguauaaacaacuucucugguaggcucaggcuucuucauucuacaucugcugcuguccaugguggucugccuauaguccuggcaucucugaacacauccuggcauguguucaauuuguaguauccauuaccuaaagaugaggaauucugcuuuuaauaaaugauugauuuccaaaaaggccauuaacuauauguuaauuuggcuuuuacuuuugauauauacacgcauaauuuuuauguuaucacauauagcaagaauuuccauauuuauauauuacuuuuucuuagguuguaaagaaugagauugaguauaaauauaaauuuuaguaaagcccuguuuaaaauugugaauccucuuaguuuuuccaguaagauaaauguguucugucuaaacuuuggcgguauuucagcuuauugaacuguguacgguuugguuuugcagaggcucacaauauuguauacaaagacucuugauauucugaagcacuuuccuaaacaugcagccuauagaaaauacacagaacagaucaccaacgagaagcuggauauggucaaggcgguaaguagcugagucagcuggguuuguuggguugauuuguacaugcaguauggcugguaaggaguauuucaguugcuuguuuuaacguucaguuuguacuacucuuccuuagugcugcucugcuuuuucuccuuugcauucagcaaguguguauuuugacugaguacuguauaaagccuguuggagggcagccuggaagaagacuggacccauuguggugugcuuuguaccucuuuucuugucugguugucagugaucauuuaccucuuacucuugcaucauccacccgaccucuaaucacaguagagaacaaagcucaggagaauuggaugguggugauguuacagaaagcuaucaagacaauuauuugaaaaaaguacuuuuccugggccugauggugcaggccuauaauucccagcuucuaggaggcugaggcaggaggaucacaaguucaguccgucuugggcugcagaggaagugcaaagccaggcuggguaacuuugugaggcucuguuugaaaauaaaaggcuagagguguggcucagugguggaacuccuagcguggaugagcccuggguucagcuaauacuauaaacgaagcacuuuguuguauaggaagagcgccacauuugguuuucaaaucuacccaaagcuacacugaacaguguugucacuaacacugaguacucuguccccagaagucuguaugucaaagcuuuaguauauaauaguauugcuuuauuuagaaguaaaucaucaauggaaauaauuaaaauuaaauucauaagggaggggccguggccccauaagaauuagcuuguguauaaaauauaaauuagacacuaggcagccaguguuugccccuugcacucgagugcccagcaagugaaggauguaagagcacauagcaacgaaucagcugucugggacuugagacuugagaggaaauccucauagacccaacuggguugucacggugacuuuggacuucucucucuaacuauuagaaaauugugugugugugugugugugugugugugugugugugugagaugaugcuugagauugaaccuaggugcucacacagguaaggcaagcacaccguccuaucccagucccuccuuuuauuuucuguuuugacauaaaaccaaacuuucacuaaagugcucaggaagaacuugagcuugcucuaaguaugguucaggcaugccuaaagcuugcaauccuccugccucaguagccagaauaggugagauuacacauguguaucaccuggcucagcugaaauuuccaauguuuaauccagucuacguguuuuguugugguggccaacuacauggcacauuuuacagcuuuaaguucagcaucugguggggagacagugagagaagugacaugcugcacaggacucuguccaacugugacugaguuucauccucaguuauuucagacuuugaagaauuaauaaaguguucacccaggcacaagugauaacugaaaaugaauuauuauuaggucaccaaaaggucagucaguaaauccucuuccugagaguuaaauagcagugugagcuuuaacuuaccugagucuuagcuugccaaguguggaaggaacuuaugagguuaauguuagcuugauuugcuuaaagaagaugagcugaugucuuguucccucacagaauaugaaugucccugcuguucaucugugaguccgcccacuaccuuggauucuugcucagcuuuccggcucagugacccuuauucauuuaucuuguguguucccuuuucucccccuugccuuuuaucgcuguuucuguagucugugauguguacguuggcucccacuucucucagaauucccuuucgcuuaccauuguaagucuuuggauuuguucauagucagugucacaggucucugcaucgccucuucacauaggaacuuaagaucuuugcugucacuucagcugcuuuuaaauuauuuauuuguagugccucauugccagggcuggacuguguucucaggcuguaaauuuugucuuuuuccuguugaagaaagaucuugugauuuucccauguuucuuuccgaguuucugaaacccagcuuuaacugauagaguuggaggguagagucguggugggaacuacggucucacagguuaauugugacuuggucuguaggucugcuaaggucuagcuuguguuuauggucuuaaucuaccaucaucuuguuaggccuuacacuucagcaguuugaagcugauacaguucuguggauuccauggagcuuaauuuuuguaguuacuuuauuuucaucuuugaauguccguuaccuuguuugacuuguuugaaugugcacgcuccaaaaaccugaggguguaguucagcaccugaacauuaccucauggguucugcuuucccauaccaucagaaguaaagguuguuauuguuaacacucuuuucauuuuuggaacaaaaacacccugauaaugacugucuuauuuacauauauauguauaaaugacagugucuggauuucaaaaaauucggcuuauuagaaaaaaauuuccuuagguaccauguuaacaauuuucuugaaguauagaauaguguacauuuaaaauaugcagaagucacaaguguaggguuugauggauuuucagaaucaacacauucuaauuaauaccaggcaaaaaagugacauuuccacaucaccaaaauacuuuuuccaaaguuacuaacuuccgaaugauaacuacuguuuuauuuuuuauuuuucuauuucuaaacuuuuuaggaauggaauaguuuucauauacccauucaugucuauauuuuccuacuuaauaguauauuugaaguaacuauaugaguuauaccauauaguuauaugccccuuaucauugcuauguaguagucuauuauaucucaguaccauaauuaacagaucaguucuauuggugguaauuuagguuauuucuaguuugggguuguaauuuguggcugcuauaauguuguuuguuuauuuauucacuauuugguauauacucagaagaggguuuuuuuucauaugauagcauuuauuguuaauucuuuuacaugaaguauagaaaauaauuacaaaaauaaaauauuugaaaaucuauuuuagaaagacuaaguugugcaucauuugucuuaccuuuguuaagaauacuuuaauaauuuuuaauauuaagacaaaaguaacgaaauagcagagaagugaaaugaauuucuaucaaauuuugauaaaacauaaaaccauagugagagaaaauuuacuuguaagggcuuuuauaaauggcuuuuuaacauacaggauauuaaaauauucauaugugcuucuguguuuagccuuuuuuucuuuucuucuugaaauuauaggagccagauguuaaaaaauuagaagccuugcuucaggguggugaaguggaagaggugauucuucagguaaagagcauuggacauuuaaugcuugggcgucuaguacuggguuugacuugcagccuguggcuaagggagaccuugggugaaauuugaaagccacagauguggaugaggacaagcuuuuaagugucuaagagcuuaugaacacuaauuccuacagauuucaaucucagaacucagaggugaccuuucuuaguagugacugugaaauuuguguaauauucaguauuugaugguguacuauaucaugacuuuagaauccugacuaugaaggucuguguucuagcaguuaacuucuugccauuauucugaaaauaccucuggaauaauuaaucagaugagcuuauuuuucaauuuucuuuauuaacaggcugaaaaagaacuaagucuggcaaggaaaauguugaaguggaagccaugggagccauugguggaagagccgccugcuaaccaguggaaguggccaauaugaccucagugucagaugguggaugggaauuaaaugugcaauuaaaugcucugugaugcuaaaaugu

SEQ ID NO: 2856 - RNA, 51316 nt, Mus musculus
ugagccuugccgcuuccggaaggggcggggccuggguaggacacgccccggcacgcagcaaccgagggggugucccgccuugccgaguuuccggcgcucucccccgcgucccgcgucccguggucucgcccgcccccgcugccauguuggauugugcggcugccgccgccgccgcugccgccgccgccgccagaggacuggaggaguagggaguuuagcgcagccgccggagugcuaggacaacgaccauccagccggagcugagcagggcgggagcccggagcuucccugucggcgcgcggcccgagggcgcccgccgucaucuccuucccucggccuccgcgcgccggaggagcgacgacgggaugcugcggcugugaccgccggcucgcgccccugucacccagagugggacccgagugcucgcccgccgccagaagugacgacccuggacgcuccaccccaccggcgacaccaugagcucgggccagcagcccccgcggagggucaccaacgugggcucccugcugcucaccccgcaagagaacgagucucucuucuccuuccucggcaagaaauguguggucaguagccgagaccccccugucgccaccccccaacgucuacuggcggguucgggcugggggggaacgggacucaaggguaggagggagaaggggggcaggcucggcacggcuggggugcugcugcgggccaggccuccagccucccgggcccuggggcuccccucacccagcucuccgggugcaggccugcccggcccggagccaccucccccagcugcuggagaacaagggagugucaccuccauaggccugcccaguagcccagguccgccgggccgggccggguccgugcccuugcugcagguucaaacuuuacucuagaccacaaggggauuuuguucgugcaucagcagcuuaagaucucaggacaggaucccagcauuggcccuugcuucacuucccacuucuggaucuggguuaucuucuuuaacaaugcuagagguuuuaggaaugaauagauggggaaagaagcgaauuggauuuucgguccgccuuaaggauuccgggagagaauaaagugcagugcagguucauggacacuuaggaucagagcaagggcaggaaaugcgccugcucccaauugcaaaaaacaaaaacaaaaaaacaaaaacgggguuuauuucuccagcagaaacuaggccuaguuucugcucuccgccccacuguggguuuuucuuuuccucccuggcguuguggggugggguguagggugcuguucgcucccaagccaugcguagggaagcgacaguuucuaauagcucacggccuuugggaucaaaagugguucugaguuuggugcugugaggaggcccauuccaaccccagauggcggauugggagcaagcaguucugugggaaggggaauggguguuauugacggaagcauucauuacguuggcugcaggccuuucugggguggggagguucucugggugaaggccuuaucuugaucuuccugaggugacugaguugaaagggggauuguuggaaugcuagccggcucccuuucugccguguuugcuagcucucacagagccugugccucuggaacccaggaaacacccagagaaguuucagccgagcugaaccauuucauauccucccuuggcaauguuggagaugucagaaucagacuacaccugcugaagaaguuaagaggagacaguuucuggaaaguuaccagauuaauuguuaacuucaugaucugacuguucauaucgacuuugggaaaccaaaucauuccaucggacuuaagauguauuucuuguucuaaaauuuagacuuuaaagaacacugcguucacugacuaaaguagaaaacagugguucaaaaaaagaagaaaaagaguuugggagaaaauuuacuuuaaagaugaaccaagucuguccucuauaguucuuuaaacaaaugagaaaauggagcucuuggccccaagucacauaguaauuuaggaauguaacuggaacuauaugcccaguuacuuuguacuuuccacuacaucauguuguuuggugaggauuuuguuccccuuauugauuugucucucaaagugguguuaaaggaauaacuacuucauuuuuuacauaaaauuaauagaaauaaaauguaaauuucuuaaagcagcauuaauuuuugcauaauuuucaguuuagggaaaucuuuuuauuuuauuuuuauuuuaauaugagcugccugcaagcaggguagaggucaucuuugcuggucuaguaccuuuaguguacagucuaucaaacauuaaguagcucacuguguucacauaccaggcccgugaacuucaggcauggcagacauucauuuguguucuaguauaugcguugcucagagcuuacuguaguguuuacccaggguuucaaggaaaugacagaugugggaguauauuucgauagacaaagauaacacggcucacuguaagcauaaguggguuacugaaaugguuacaaguagucagugcucaauuucuuuacaucauauauuauuaaucaacuuuaccuuuugaauugcaguaacuuaaaaccacauuguuguugcuuucuugugaaaauuacuguaaaauaugaagccuuuggcuuaauagagagcaauguaaaauugguguuauggaauaauccuaauaggcuuugcucagaggguuuuuuuguuuguuuuguuuuguuuguuuguuuguuuuguaguuuaaagcaacagugaaauaaaugcauucucauaaaucaagcagcaaauuuacaggucagaacaaauauaauaagcagauacauugagagcucuaucuacaaaguuaagaaaugaaaccauuauauggugccagauuuuaaguaaguucuucauuccuucuuucaucgaacaaaccugcauuggguaauuggauguugaggucaaaaaucaaaauugaugcuugcccucagggaacuugguguuugaagagggaaacaacacguaaacugaugagucagucagucagucaguccuuuacaagaccgacaagauagcuuuguagucuagucaggcaguguggguuuaagcuccgggucaauuugaacaagccucuuuacuuuccugcucugucuuugcuuuuccuaccuguaaaguuagaaugcugucucauguaguggucaugcugguagggaguauaucuaaaucucugaaaacuucuuagaaacagauggagaacuauugggugaugggagaguaaagggaaaguuugauagagugggcaacaucugagcaagauuaacaggugcuaacuagguugauaaaugacaagaaaggacuuggaaaauaagaguuugcuagggaacagggauucugccuguauuuccacauucauguauauauuggaaucacuguagaaauauuagacauguguggguagguucaauuucuugauaauuagguuuccuaggucugagguagagcuugauuuuuuuuuuuuuuaaauccagguuagugggaagauuugaauguauacuacaauuugagaguagaaguuuauuucuguggguaauucuagaauugucccauuggaaacauuggaugccacauugacaaucauaggcuuucuuuugcuggaguuugaguuuugugaguuaaaguuaaaacaaguucuuugacugcagcaguucuuugucuuaagaugucaaggcacauuccauaacuaagagacagguacaguugaggaagcauuguuaguggugagccacauacaggucagggcucacuuugacaggauacuuggguaaggugaaggcaguguagaaaugaacuauggauugugagagggaugacauaggacaucccgaagguguuuguagaugccccuguaaaauaauaaugagccugaacuaaagcaguuuauagguagagaauucaaaggacucuuagaaugauuaagucccacuuagauguagagggugaggcaagggaacugcagcaaaggccgacauuaaaggagagcagagaaguauguaggcacauacauuucucaucuucuggaaauaauucguuuuauggaagaaaugacucuuagaaaucuguugcuaugguauaguuucaauaaguagacuuuauggaaauuaggauuucauuuaaagugaaauguaauaagugaguauguguuauaacuggcauggaguuaauaguuguagugguaucacucccuggaaggauagucucauacacuucaagagcaagauucacuuaccuuauguuaagggacugcugacuuucagguggaguaauagcuaacuuguguaaggcacgugcgcauucacccuucuucauccauguggaguuucauauauguaguucccaguaaggagcguggaaaguaaaaccuguggccacuugugucuagcccccuuucugaaugguuugagacuggugaggauuggccuucuuuuccccugccauacucaccuguuugcuugguuuauuuccuuguuuuguuuuuaacuauuagugauugcuagauucuuuucuuaaucaggaagaguuuugccuuaauuucuuuuacuuccucagccccuguuuuuauuacucaucuucauuaguuaaauuguguuuccucacuuuguaugcaguucuaggagauggaccuaacaucuugguauuuuucuauaauuuucacauugcauaauuuuuuuuuuuuuuuuuuuuuuuuuuuuuuuuugguuuuucgagacaggguuucucuguguaguccuggcuguccuggaacucgcucuguagaccaggcuggccuugaacucagaaacccgccugccucugccuccaagugcugggaucaaaggcgugcgccaccacgcccggccacauacuucuugauugaauaauuauaauuggucauuagauucagucuuaggagccuagucagcauuucucacugcuugaucaaguugugaaaaacuucauauucuugacagauacuauuaccugaguucaguuucuucauuaagcaaagugguuucauuccccugcuaagcuaauaucuucuugaugauggccugcaauaauuaagggaagggugguagaauaaaguaggauaugccuuucacuuugagcaaugaggaaagaaagcuaaaauucacuggauuaggaauauacaaccaugaaaagugcccuccucuguggugggaagaagauaaggaccaaauuaugacagaagggaagauuagagccuacuuuguucuguagagugggcacauuucccaacugucgcaucuagaucuauagaacggucuuacuaagggguuuuaaagaauuucaguuagaaugggugccaccuaugaaguacuuuagggauuuguagaagcaugugaagagaauuguuacugaaauuacucaguguucauucccauugauggcaaaaacauuuuagaucaguuguagcgauuuuguuaagucagucaaguaugaauccuauaaagaagaaccuuucagcagaccucuuuaaggaggcucauccuuguucuucuuaagcccgucccugccccuuugcucugccacugguuuguuccucuguuauggacaguguugaguauuuuacuuaaaauacaccauuccaaaaguuauccuucagcuuuaaaauacuacuuacaaugaauacaaacuuguugaguggagaaauaaaaugaagucugcuggaauaauacagaugaccuaggaccuuccuuauuaccuguguuagaaaauguuggcugacguucugaagagugaguugccuccuguggugccgcugaacagcuucuaucguguagucaauauuguauguucagaaacagaauacguauguauuuauugagacaaggucaauaaauauagugcagacuagucucaaacuuaggauguaggugcgagugaacuuuaauuccuggucuugugccucuaacuccagaguuagggacugcagauguguaacugugacagccuaacuguuaggguguaaggcaugguauauuucaaguuauaaaaccugggaagaguaagauucaaaugaaauacauguugauaauauuucauuuuuuuucuguccauauuccacaguuuuuuaaauaaaugauuuuaauggaagcauagugcuugcuuuuucaauuuuagguagaaaaaauaauuuuaaaagagcuuuguuacauaauauuuuguagcucuaaaaguugcagcuuucuucccauauuuaacaaccuaguauuauauuuacuauaaagauucuggaagcaacacaagucagugcauucuuauuuaccuuuauaaggugugcacuguuauuuguaaauauaacuuuuuacugguuuacaaauaaccuaaaauaguaauucuuuaacugguauuaguuauuaaauagaagcuguuugguaucuucgacuguauucauaaauggugcauaacaagaauaaaccuuguuuaucgcaucacuaucaauaacuuagagaaccagaugauuccaucauuuuaaugguaauaaaugguaguaaaaaauaaauggcacucuaaccucacuuuuuaauuuucuguauaaauaugugauacggugauaacuggccuaacauaaggaagguucuggcuuucagguuggccggaaauaggaaaacucccuuuagaaaguagagucaagugaaaaauauguaguaaguuuauaguuuaauucucauuaccauuucaguauucuggacucuaggguuccuuugugguaggaauguguuuagacuuucaguuugucauugaagauugcuaaaggaaucacaucuguagaaggaacgcucaugaaagacuugcuagauugaagcaaaggggacgugguaagggaguccaggaaugcaugauacuguguugggguuaucacaaagcuguaugcuugggaacaguaucaaagucuuuauuuacaaaguuaaacauucaucuuagguuugaaaaagcugggauuauuuacagacaaaauacuuaccagaccuguaguuccaaauuuuaaaaguaaaaaaaucaaaucuuuauauacuauugaugauugaauauugaaaggucucacgguuaccgaggggaacaguguaguccuugugugacuuggccagcacuggagcaggaugacauacuacuuuuccggcugcugugacaaaaugccugacaaaagcaacucgcaaaacaaaacguuuauuuuggcucacagugugaggguguggcucaucaccgagcauggcagcggucagagcugugcuagcaggccagugaggcagagggagugagcauaggcugcccagagguuacuucuugccucacuuucuccuuuugugauguuuauucaguucaugacccccucgcccaugguuguuacugcccauuuaggaugguuuugccuucuuccauuaaagcugucuggaaaugcccucacaggcacucccagaaucucuccuaagucauuccaaacccagugaagggacacagaagauaagugaucacaaguguuuuccauaagcaauugaaggacuagcgagaugcuuaauuuaccaaaaaauaaaaccaaagaguauuuuauauauuacacagauccuuuuuaugcuagagguauguuuccuuguccauuuauaccuauuucauucuuuuauucuuucauuuaaugccauucugcuacauuguaugaagguauaguuauauggaauuuauuggucucuauuaauaaauagaugcuauauuuagccagguaccauaaaaccagguagcuuauagaacaguguauucucucauuguuuuagauugaaaucucaaaucaaaggaccagcagaauuuguuucuucuggagaaacggagcgugaaucuauuucauacccgucuuccaacuucuaguagcuacuagcaauccuuaagguuccuugacuccauccaguguuugccuuuacaaauaacauggcauguuguacucauucugucuucuccacuuacaagaacaccagucauacugcguuagggccagccuuaaugacuuaaaggcccgccuuuccaaauaggauugccuucacaggugugaggguuaguauuucaauguaacuuucaagaggacacaauucagcuugauaucaauauguuuuuugacuuucaaaggaaaguuuuuguaauaugauaaacauccaaaugugcccuuuccaguauuuauauagaauaaauuauaagaacuaaagcuaggacacaagcauuaccacgugggcagauaacugcuaaucaguccuguccuccacacaauuguuagaaacuaccuuuucaucaguggccggcauuuuaaaaaugucuuacuggugaaagaaucucauuguuuguuuuguagauuuagugaaacugaacagcuuucauaucuguugagcacacauagucuucuuaggccauuuauuuccucuuaguaauuuggaagaacuguugauugguauugaauaauaguucauaucauaguauuuugguaauuugugguuuaccuuuugcuaacauuaucauuaugcaaauggucacugaauaaauacuaaauuuuccuguggguguuacugcagucuuauaucuuuuccccccucuguuucaaaagcuuuauuuucauuugauucaagguuugggaggugaggggcuccagagcauuuacagaguuguuuagugguaggagagacucagaugucagcugacugcuauagagcacaggagccucugguaggcuuccaggacuucugguaguacuuaaacuuccccagggacagcuggggccuagccacucccaucuucuuggaagugccccuuacagaaguuguagaaaugagagacccuuaggucagaacccagggcaagaagauccagaaagcccugguucagguucuccagcgcccuaguucugcccccagucagucuugagaaggcuucugcacuuccucagcagcccagccaccagcuguucuguucuuguauugacaacccugaagcucuuucucaggcgguuaggaagagauggcggcagcccagagaggcagcuguagguugccugaagguacagaagaaccagcaguuacuguggccucugaucaucagugaugcacagugugggacauaaccucaccuaugauggggacugguucuggggcuggcaagaaggugcugcuggagagaguggaaggcagcugaaaguguaaaaggagggaguccccgugucuguucuguagaaacacuguugaagcaagacgcggaucuaucuagggccuuggaugaccugccuuguuauaucaauauuuuuuauuuaauauauuuacuaauuuauguuuuaccuuuugaaaaugguacuucaaauuuuuggguuuucaggugaacuuaaagcuaguuuuauauucucuucuguuucuuucauuugcuugcuacuugucuucagugaguauaguuuuacaaugaugauauagcuugauuuauaccaaauugauaauuaaaauucagauuuccuuugcaguuuuguuauuuucuuaggcacuagacauuucuuuaaguacaaaaaauaucgcucagauauacuuguuuaaauaauauuuaagcgugcauguguguauacagacacugcacugccuagaguuaacagcauucuuccugcuuucccccuguauggauuaggcuccucaugaagaucuuucuucucgguggcuugacucccauccuuuuuuaugcauaucuacacaucucuauguauaucugcauucuaaaagcaguuguaugaaaaacagauauaucuaucccaugcuuuuuaagaguuuuuuuuuuuuuuuaauuuggagucuuaaauggaugaaaagcagacuacaauaaccgauuaacagguaccauggcuaucuacagacagacagcccauccugauugcucuguaucuccccucauccuuuccuacauuauuuuaaaggcgcugacucuucaccauuauaugucuaucauccagucauucuaaguaaaagauugaucacuauuauuaucuuuugaaacaauuggcuucuaguuucauugauuuuaguuuuauugauugauacuacuguuuuguuuucuauuuuauugacuucuauucugguccuguuguuuccuugugcuuaauuugcaucuucuagguuuucuuaucguagcaauuauugaacuaauugaugccuguacuguuauuuuuaaaaagugauuuuggggcagaaagcuggcuuaucaguuaagaguauuuacuacucuugcagaagauuuggguucaauucccagcacccauauggcagcuuacaacugccuguguuucuaguucuagaggauccagugcccucuucugaccuugagcuucuaaaagcacaugauauccaagcauacauucacagccaaguacacauaagauaaaaacaaguauuuuuuuuaaguaaaaaaugauugcuacauguuuucuucuaaguacuauaucauggguucucacucauguuauaguauaucagauuggaccaauaguguucaagucugcuuuacccuugcuaauuuaaagcugcuuuauguaauuuuuuuauugccucaaauauuuuagaacucuuagguguguaaguauuuacacuuguuaugucauguugaauugacccuuuugccguugugaaguaaccucuaugcuucagaauacuuuuaucaaaaaucagcuuugucugaaaauacuaccacugcagcuuccuuuuagcauggaguuauagucccuuuucauucuuccuuccuuagucucagugucuuuauuucugguauguguuucuuguaggcaugauaguaguuauccuuaauaucuggaaaagugaggguuuuuuuucccccacacaaaauaugucuuucugacugcuuuucagauuuuucuguuacuaguuauauuuuugagaaaucuauuaaugauguuccuuuguauaguuuaauguuuuugugcugauuuuuguuuauuucuugggcauauaauuuacacuaguuugugacuuuagaaaaaugucagacauuguuuuuaaugcuacccugcccucauaaacgucagucacaugugcuaagguguccuguacaugacugcugggcucuuucuuuuuuccucucacuuaguauauaguacuuauuacuaugucucuaauauuucaucuggcccugaacucaaagagauucuccugccucugccucucugccucagcaccucugccucucaagugcugggauuaaaggcuuuugccaccacaacuggcuaauauaucuaguuuaguauauggaauaaaauaugauguccuuguauacuaaggccaauuuuucugacuggcuuuggucucuaguggagcuauguucuugccuuuuuuuuuuuuuuuuuuuuccugguaugcuugggacuuuuuaaugaaugccaaguauucuaaaguuuaacuaauuuuauauuuuugauguuuuaaaauauuuuauguugguacacauucacauauacugagugcaugugcugucacccccauauaauuugcugcugucuuaauuacuguucuuuuacuaugaagagacaccaugaccgaggcaacuuaaaaaagaaaguauuuaauuggggcuugcuuacaguuucagaggauggaucuguggccaucauggugaggaacaugacagcaguagcugaaaggccacaucuuaccaacaaguugaaggcagagagagggggagagauggguuggccuuuggaaucucaaacucccccucccccaaccccccagugcaguaccuccaacaaggccuuuccagagcaguuccaccaacugggguccaaguguucaaauacaugagccucuggaggccauucucauucacauugccacaacacuauuuuuacuuauuuaaaaagcuauaaucaauuuucugaggaagauccagcaauacuucuccugggcauauauacccagaagaaguuccaacugguaauaaaaacacaugcuccacuauguucauagcagccuuauucauaguagccagaagcuggaaagaacccagaugccccucaacagaagaauggauacagaaaaugugguacauuuacacaauggaauacuacucagcuauuaaaaacaaugaauuuaugaaauucuugggcaaauggauguaucuggaggcuaucauccuuagugagguaacccaaucacaaaagaagccacuugauaugcacucacugauaaguggauauuagcccagaaacuuagauacaauuugcaaaacacaugaaacucaagaagagggaagaccaauggguggauacuuuguuccucccuagaauagagaacaaaacacccauggaaggaguuacagagacaaaguuuggagcugagaagaaaggauggaccaucuagagacugccauaccuggggaucuaucccauaaucagccuccaaacgcagacaccauugcauacacuagcaagauuuugcugaaaggacccugauagcugucucuuuugaggcuaugccggugccuggcaaacagaaguagaugcucacagucagcuauuggauggaucacagggcucccauuggaggagcuagagaaaguacccaaggagcuaaaggggucugcaacccuauagguggaacaacaauaugaacuaaccaguacccccagagcucgagucucuaccugcauauguagcagaagauggacuagucagccgucacugggaagagaggccccuugguauugcaaacuuuauaugccccaguacaggugaaugccagggccuagaagcgggaggaggaggguauagggaacuuucgggauagcauuugaaauuugaaauguauauaaagaaaauaucuaauaaauuuuuuuuaaaaagcuauaaucauuguuuaaaagcugucaccauugaauauguuucuuuuacuaaucaaauuauuuucuuuuguuguauaaauuaauaauauauuacauuuucuauuuagcauucuuuguauauauuugaauauuuuucugacuugguucauuuucuuuuuuaaaaauaaaagucacguuauugaaaauaauuuacaaguauaacauguagugguauuaauguagauacucaaacaagcucuugcccagacccaaagucucuauaucuuauuguuaguuccuuuucuugugucugugauuuuaagcgauuuccauaaggaaagauuuauuuaggcucacuacauuacggauauaguccaaggcuggagagacggcucagugguuaagagcgcugacugcuugcucuuccaaagguccugagugugccacaguggguguggaggucagaggacaguuugagggagucgguuuacgcuuuguaccaugagucccagggauggaauugagguccucacgcuuggcagcuggagccuuuaacccacucagccagcuaggcagcccuuuguggagagccuaaaccccagcaaguugacaaccaaaauuaaugaucacaguggucuuaauuauuuuccuauucugaagaacuuuuggcauuucucauaagucaaacuuagugguagcaaauuuccuuaauuucuauuugaaaaacuaccuuugaugaacaguuugcuggauacagaauucuaaguugaggaaguuuuuccuaacauuuuaauuacuuuaugauucugaauguuugccugauuucugaggacaguucauuauaauucuugucuuuauccuagaaugggagaauauucuucagugaacucaucuucaauguguacuucaaauugaagcacauuuagugaguccuuaacuuuugaaacuaucuaauaauaacuauguuuuuccuuuuuuuuuuuuuuuaagaaagaugcagagaaguuuaugaggcuuuuucucacuuugguuaauuguauucugacuguaauuuuauuguggcccaaagcucugcucguacuaaguaccuggcuagugucaauugaguuuggcuguuaggagcucacuauugcaguauguggagauagcaguaacuucaugcauguacucacguacauucuuaccagaggacucguguuuguguagcauuuuauccugguuuugguaguguuccauaagcucucucagcccaaccuguuccuuucuaaaaacaagcuucuucacagagugcuaggaaacagcuuaaaguaauccagacaguuaugcaaugcacagcugggagauucuggaaaggcucugauagcagucaggugacuuauuuuaaaauuacuucuuucuccuuggagacaauguucaucauuaaagauuuacuguugugauggcucuauagugccugaucgccacuaaccauguagcuuuagacaguugaaagguuaauucaaacugagaugcucaguaugaugaaguaugcucuggauuucaagacugaguauagaaagaaugcaucauagcacaccaugacaccugauuaaugcugauaugcaggaacuuugcuuauuuaaauaacguuugcuaaaagucauuucacuacuuaaacauuugaagucucauuuaucugccauuuacugggcagaugcagaguaaagucaacaucaaagcacuagcaaccuguggaucuuaugcagaaguagugcuuauaguuuuguucagaccuuaagaggcguuguuuuauaugaauuacaaaauaaaagacacccaugcauacuuacucucagaugacacccuguaggcacacucacccuuucuuuuauggacuguuccgugucagugagcgcaucauuaccaaaggacauaauuaauaguggauuuaaugcuuccuuagggaaauauuaaguccauacauuccaacacaguauuguguuauaggaaaguggcuuuuuugauuugguuugguuuucuuguuuuuuucguguuuuguguggagguagggguggggcugauagaagugggagauaagagaaguaagaaauaagagaaacaggaucgaucccugaggcaaacuggcuagcuagacuagucaguaagcucaacucugucucauuaaauacagaagagagggauugaagaaagcagcacccaaugucaacuuucaguguccgugugcacacaugcaaauguguauacugcaugcacauaugcaaaagguuaaaguauaauguauaugauguaaaauaugcagacgagaagugauacacuauguaaguuaccuucaaaauaagcuuaagaauaucuaaugcuuaaaauaaaguguuucuauccaauuguuuucuuucuuugucauuaaggcuuuguuuuagcguauuuuaagauucaucuauguuacuaccuagguuuucauucuuuacucacuaguaguccauugaucuauggcauguuugcuuauucucuuauauuuuugguugugagccuagccuuuaacggcugagccaucucuccagcccauguuugcuuauucucaugguuuugaguggaguugcuuacaguguuuacagaagaggcugccauaauuguuucaugacuuuauguacaucuuuguuucuaaugaguaccuggaagaauucaguuaccaaagggcggauguauauuucucuuuauaaagaacugucagccaguggcccugccaguuuugaccuucuaguucagcugcucucuccucaacauuugcuguggucugugauuugguugcugggagugaauauggaacggucucccaagugaauucuuacuuauucccccuugaggacugcugaugucuauggcuauuuaccauuugggcauuuuguucuuuauagacuuuucugcaguuuguaaugcuuuauagcuauuuuuaaauguauuuggacauauggcagcacuuagaaauguguuucugacuccuaucuaacauugucuuuucuaacacauccagugauaucuuuugguuggcuacucauuuuaauuaucauaaagacuacauuuucuuuuaaaaaauuuuuuuuugauuucuaagaugucuugaccuaugcugaauuaaguguagugagucuaaguuuuucuguuuaguuuuuuuauucaccaccuuuuuguuuucacacagagugagugcagcaaaagaguccugugcagugacuguaggagucuuucauugcagacagacuuuguccagugugcuaauugaguacagcgauuuguaaagguuuacuucagugacuuggagcacuuucuuggagcccuuuuucuugcuuaauggacuuuauuuguucucuuauuuuguguuuuuaaaauuuuuuuguuaguauaauauugauuugauuauugcauacuuauucuaaaucuuaaaaucaguuguggugagacauacuauuuuuuucugugcccuauuguugagccagcugucuuccuggguaggugaacugugugugguuaugauuaauauuucuguguugguacagaaauguuuuuguuugcuuguuucuuguuuaucgugagguaguuugguuuucgggcccacgcccuuuaguugguacuuuuaucuaggacugagcagauuaguaaacaugcuuuaauuuccucuuguaguaaacccguuucuucuagggcuaaugauuuagaaauacaaguaaguuucucagcacagcuugauacaaguuccauucuaaauaguuauuaauaguuuuauuuggaauucuguagagaaaacaaucuuaggauacaucagagagguaguuucauuucuguuuuagaaacacuacaguaaauugagcacagugcaucauaaguguaaaauggauguaaaucucacuuucugcauuuacacacuccguuccuggauauguuuccucgguggcagugcgcuugcuuagccugagacgcuggguucucugccuagcaccacagcggggacaugguugggggcuggggugguguuaacauguuuuccauuuaacuccuuuccuuccuuuacaccauuuaccaaauacaaaaccuguuguaauuuuuaaccugaacuuguauacuaauacauaucauacaagagaaauucaugaagcagaguaaacuggaggcagaguaucucugaaggagcgauuauaauaucucuggcaaagagaaguguaaaucugauuuuguugcuacagugcuguacugcuucggggagaauugcagucuccucaggcccuuuuagaaaguagcaggacaguaaauacuuucuguguugguacagaaucgggcugagcauugugggcuccaucauggggcaguuugaauaucaaaucuacucccuuguaugacaacgagcauauuaguaaacauguuuuaauuuccucuuguaugaagcuugcuuguucuaggccugcuagcuaaauacaaaaugcaagucaagcagcauauauaaaagguagagcagcacuuuguuuaucauugauuucuuucaagaguugagaagaaaaagaauguguguacuuuagaauaucuuuaagaacuguagucuuagguaagguauuuaaaaaacaaaaugaaacugacuuugacugacuugaucaaaaaggaauuuauuggcuaccacaagaucucaugggauccaaaauaaagcagcagugaaucuugagcagcaguagggucaguggaucagcucuuggucagcuucccuacguugcuugucauaacccauugcugcucgaaucaagaaguuacugggagcugaucugaguugaaagaaagaaaagaagggaagaaagcaagcccuuauaagccugaauaugcugcuuagucagggccauuaaagguugucuuaugugguuauuugcuaucagauuagcauugcuuuucuauguccuuccucuuugaucguuuauguggaaguccaacaaguuaaacaugguuguacauauauguagguaccugucuguggcuauauuuaagggcuuggcuaauagagaguuauaaagcagaaugacaaacagaauucgaauccaaagucaguuacuuuuacuuuuaccuguucugguuaggccuuuaccucugggagacaaagcuugcuuauaacuguagcuucuguggcaacauagcaugguauuaagcaauccuuacuuuuaauuucaaagcaugaggcucaaaugcuaauuuuuccuagauugcaguuugucagaaagaugaucuuuugcaagacuaauaccaugcugugacuugaacaggucauuuaaguuuuaaaaauccaaacauauaccugauuuuaaagcaaaaauagcuauguaaaaauuaacaaguuucuuaucuacuugucugcauuucccagcuguuccucuccucuuuaaacacaaaaggacuaggaagguggcccugggaacuaguuucaccuucaugcuugcuuagggcaaaugcauagaacuuuguuucauccucugcacauuuguuauauacucuugccuuuucauuucacaucuuguuugguucacauaaccuucauuauuacuuaagaagaaucuuuccuuccuuccuuucuuuaaagccacguauaauacccuguuguacaguuaaacugguuuauuuaauggaauaagcaaauauuuuucuuaguuauagugaaauuuuuaguugcauauaauuuggauaauuuucagguugaaagauuuaaauuaguguagaauuuuucaauccuuaaugauuuugcuaaaaguauuucuuucuuuaacaugaguuacccuuuauuuauccuuccuuaaguagaccaaauacuucauugaacugauuuuaacaccuacaugauaagacuacauuguauauguaaacacuuggauacuuuacauuuuaugcacuauuuacuuagcccaauguccuuuuuuauuguaggacacaaacuguuauucugguguuuccuagauuuuuuuuuuaaccaugauaacuugccucuuaggauucuuauaggcuaguuacaaccccuucccccuuuaaaaaaaauacuguauauuauuuugcuucuguaacacauuucucaucccucagaagcuucuaacugcgguguuuuguaaaaugaauucguuuguuugggagcauguaguagcuuuuugucgcgucuauuucuugguauuuccuauccacuaaagaagaguuagcuuaacuccaacccugauccuuuauaagaaaccaguccccuggaaaagaagacucacuagcucccauuuucucuccuucccucccuccuuacuaaaagagguuuagucagcacauugcaauuacucaacaguaggggcauaagcauagaggaauugccucugagagaggguggauuauggggacuuuuacuuaagaacuauugucuuuugacuaggacagcccaccaugcaacuccugaacacagacucugccauggaaaggagagcagucuugauaggugggcauuuguuugggggcagaggcugcacucaguucuaucauucagguacucagaguugguggcaaagcagcauggaaaaacucguacuguagaaacuuccugguagggcuuguucuguuuuguugaguuacggcuuucguucuacguuccuccaacagagaaaauaguucaauuuggggaaguugauuggaggcauuuuccucauuagaacugagcaggagcaacacagggaggaccaccccuaccuaucauuuguuaacucuggcaaggccucuguggggaaccauaaaaagagaacuauacuuuaguagaaugccuucuuagcuagcccagaaagcuaaaaguaucugggaagucccaugguagggcuuaauagccuugucaaagcaucauauugagauggaacuguugaacccagugugaugucagugcugggcaaaucauugagugaacaagaucagucucaggaggacugcccagaagaaaaaguacaguguuccagccugugugucagcguccuagaaaccuuccuggaagugguagaagauuaagaggaaagacacaagaaacugaagcugagaucuggugggccaugcauuuagauagagauguaucaaccucuuagauauucaguacauuuacgugaaugaggaagcaguuagauaaucuuagagggguucucuguaugggaauagccugggggggggggcaugauccugcugucaguaggaccaagaaugugguuucaucacacacuugauuuuagcuaaaagucaacaguuggucagcaucuauauuaggaccagggaaggccuugccauuccccuaagccagacccagucuuuaucauucccaucugaaguauugaugucccugacaugacaguguucaugucauggaugcucauucugggguaaacuuaguccccacacuauaggguguuguuauccuaguuaguuuugucaauaugucauagccuagaauuaugggauuggccugugaacaugucugcaggggaauuuguuuuuuuguuuguuuguuuuuucuuuuauaauugaugucugaggacccagucuaccguggauagugucaucucuggccaguggucuugggcuauauaagaaagcuagcauggaccugugaccaagcaaacaguauuccuccaugguuucugcucacagucuugcuggagauuuuugacuucucagugauguggacuguguccaugugaaagccaaacaaaaucccauuucugccauucagauuucaccagagaauugccuuggccagagaucugggcuagugauuuuauuagcaaauuuucuguugcugugauaaaacaugaccagaagcaacuuaaaggagaaaugguuuauuucgucuuuugcuuccagagggauaagagccugccauggcgggaagacaugguagagagcaacaagcauggugguuggaacaggaagcugagagcgcacagccuuaacuacuaccuguaugaagcagagcucaaacuaaccauccacaccuuccugaacagugccaccaaacuaggggccuuaaguagugaaguaccuaagcugggaggaaggggagaggacacaugcaaaccacugcuccagggcaggagugccugggacaugagaggacccugaccacugauacagucuuuucuaucuuaagccccguaagaauggggcugcaacggacgauucuuauuaugacuggaaacuauuucccuuaccauuuugcucacacucuauacugaucagacauauggaacuucauuuuaauaagggugucuuagggcuuuauugcuaugaagagaccccuugauuccagcagcucuuauaaaggaaaacauuuaguuggugcuggcuuacaguuucagagguuuaguccauuaaugucauggcaggcagauguggugcuggagaaggagcggagaguucuacaucuagaucugaaggcagcaggaagugaacuggcuugaguuucuaagaccucaaagccaugcauacuccaacaaggccacaucuccuaauaguaccacuuccuauggacacaaagggcuaccagauugauagaagauucauacauaagguuagaugaggaaugacuaaaauaguuugagcugaggaagagaugaccuaguaaguaaacuuacugaagauacaucuuggagaagucaacaugcuaaucgccccucuccaauaaaaagcaaucuguaaauaagggagaccugcuuguugguaguucugcuauuaguuacagcaacuauaccugucaccgagcagauacuaauggaaacgagaguagaaaauacauugucugugggugagaauugcugagaaaacagcuaaagacucaguauuuucuacauaacugcuaaauagcaaaguacucuuauugcuggaacauaaagguauuuuugaguuuugaaccuccaauagaaaucauacauuuuaaacaaauacuguaaaaucacuuauuaacuaugcccucugaaagauucuuacgccaguaggggagaaucccuuccaacaagcaccugugcuccugccuggcuuuaucuaauugauuuuggaauugcuggcugcuguuucccuaagugggugagguuacuuggcauuaagaguuauuucaugaagugugauuugaaaacugcauuuaguuguuaauuuucccuagauacaaaauucucuuuuucugauugcaucguuuuuuguuuuaagccaauguaaguaaguuucgugucuuuuauauaguuuagagggacuccccccaagaaaagguaucagcacuaaauauaaauuuagcauuuauuuaacaaaauucagaaagacucuuuuacaauacauacuguucuuuaguggaaaugggcugugugcuugaaaacauguaugagggggugacagaagcacuuugacucuggcauccugcaauaaucagaucuuccaaacagccaccauaucugccucccaccuugucccaagggagaagcaauaguaguuaccuccacuacccucuuccaguccaaacuugaggauuucccguaauccgacaaacugcaagaggauguuucuaccuggccuuagaucagucaguucccagauaagagacagcauuggagcugagcagauaucaacccucuauggcuauuuugucuacuucccuguaaacuacccuuaaauaugacuugccauguuccaucugggccauuccugcuucuguuugccagcccuugugggcauguuuucgugauccacccugugguguccucuucucuccaccucucuuuuccgcuccuggucuuugccucagaaagccugggaaccagagccccacccaccucucuucugcccagcucuaggcuguagcauccugauucaaccaauaguuuuaaacuaaggagcaaggucacuugguguaccugaaaaucuccuuggcccuaguggcagccagucuuuggggggcaguauuuagcauugcaacacagcaaaagaccaaaccuuaacagugccccuccuaccugugucuaaggugacucuagugggaaacucagaagacuacagcaagccuugccauugguuuguaguuaauagugacugucauugugggugcaaauaauuguaaaaaucuucaaggugauuugcaguuucuuaugaauuugcauuuucagcaccuccugagacuugaguaagggucguaacuuuugagugaucuuucucuauauaacauacugcaaucaaugagggguuuugucuauaaaguuucuuuagaaaugucuucuccccuccaaucuguucugauaauaguaguaaagccuaaaguaaguugaaaguacaugucuguuccaaccaaaauagagggaaaaagcuagaacuauuuguuagaggugauagguucuuuaauauaagcagucuuaagugucccuucccuuugcugcaaacaagccaccuacuucuuuaugacuugaaacaguaccaguugauuucucaccauuuggcaagugaguucauuauugguggcaccuauaauuuuucuuugaucccagguuuuuagaacaacucugccuuccaggaaacuagaucacaauaugcaaauacuuuccaaacauucauuuauuugcugauguacuuuuggucaaaaaaauuucauggacaguuccagagugaacagaaagaagacaggugggagcaugcgugccuggcgaggcaccaggagccagucuccaauaaagauuaucaaacuauggcuguuuaucuguuucaacugaguuaaacugacuuugguguuauguuagcaguacuguuaaguuuuccccuucuauguuuccuucacuccccagucccucagugccccaaagugcccaagcgccuaaccucucugucgccccccaccccacccaucuguuuucaucuuuuagguuaaauaguacuuuaggaaauccuuucuuuuauauuuggguuuuugaguuuuucuugcauaaccacauuaccccucgguaacaguuacaguguucuuagacuacauguucacaaggauuaagucuguccaguuuauuucuauuuucagcuccauuuggaguccugccuucuccuauaccauccugccuguguaguaguuaccuaauaaacacuugguaaaucaauauucuuccauaguaguuucugcauagcugguaugcggugguggagugcuugcagaccauuuugcucauugugacuggucccaaguuaauggcugguuucgucuggcuccauugucuucucuugggauccuguucaucaguuuugcuuuuccucuucccacagcagcuucagauuuacuuuuguugcuguuguuuguuuuuauguuuuaacuuucccgauucuguuuugagguugaugcuaaacaaaaaguaguguuuauuuuaaaacuucuucacugagauaaaucacuuuauaagaauucaaccaaauauuuuguauaugcucacuuuucugcuucuuuuuauauucuuuugaguagaauuucauucccgguaaucaugaguuuaguuuacuucauguguagaugcggagcauaguaucaaaaucagaaugugcuauuuuuaauuaaauauuuguauguuccauagaauauggcuagacuauaaguauggguuugcaaauguauuucaggugcugugggaaauuacagucuuuuacuggguaagacauccguguggaaaguuauuccgccuuggaguaagaccuagcgguuacacaggaaaguugcagagaaacagaagaaagagcagugguugcagccugcaaagccaacccaggaaguugauagugcuuuacugaagggcagugagaagaaaaugucuucccuucccaggucuaccucuuugcuucugacaugaaaguucucagcaggaaggcuuugcugaguuacucaguacugagcuaucugggaugcauaagauuugauggcucugauucugaauacaugacugcagugcauuugucuccuguuuaacagagucauaaccuuuauuagacuauuaagacauggauaucuaccccaaaguacuugucccuagguuguuuuucauuaguaaccuugauugugaaagauaaaagcaguagaguugauuaucuucaguuaccuaccuuaaaggcauggaaggaaucuuuguauagauuuaacuaccacacuguuaaucuaauguuaaccugauacuugguucauuuuauugccuggaauuuauauauuaaauauuacacgcacgagcuauuuuugcauauacugugguuauuaggaauuauucaggaaaggcuuuauaaaauacuaaauugauagcaaaauuuuuaaacauguuucugaaaauugcuuauuauuggguuuuccguagaauguguguguggcaaggagagaggugggagaacuauguggaaaauuauagcauaguugcauauuauagcaucauugcauaugcaaauauuuuaauuuuugucaauauuuaaacuuauguuuuuauugucuuuguauuugcauuuacaucccgauaauguucuacagucuucauauugaugcuuuaugaacaggcuucugaagauaaagaguuucagccucuagaaagaagauucuuuuuuaauuuucugaaacuguuagguauuaguaaauagagagauuguuagaugucuuuaucuggugauuucauuguuuuuugguuuuuguuuuucucuucagaaauuaucugggcagcacuacaucagaggccuguaaucucuacauuuucacuaguauacaaaaucuaguggguuuuuuguuuguuuguuuguuuuguuuguuuguuuguuuguacccccccaccagugguauucgaugcuuucuuuguugaaguuuuguuugcugaggguucaagugguucucaaccuuccuaauguuguaacccuuuaauacaauuuucauguugugaugaccccaaccauaaaauuauuuaguuucuacuucauaacuguaauuuugcuauuauaaugaaauaauaucugauaugcaggauaucuaaaaaguaaccccaagagggucaugauccacagguugagagcugcugguguagaggcaggcaauacaggcaauacagucuccauaggcuaauguguacucauauucuucaauaucaccauguaaaccggugucccaguuaacauauuguucauguuccuaaacugucuuuguaauuuuuaauaauguucuuguggaaaucucccaguucucugcaugaagcuucggugaaauuuuuuuaauuaaaaacacaacauugagcauggcaacccagaaugucuguaaagacuucugggucuuaguugucuacggaucuuacauuccugauuuugacauaaauaaaaauuuauuuauauaauagcuaaaaagaauacuuuucccagaaggaaguccccagauguaauuagaugauagcaauauaccauaccuccaaaucuuaauauagucugcugcuuauacagugcccguauuuuauugaacuuauacaucauaauuacuuaaucaguuccaacuuuugauuauuuagauuguauauguuuaaaaucccaggauucaugaaauggaagggaacugguugggaagaaaggaaucauuugggaguagggaggacaagaaagguuugugagagguacauauuaucaaaguacauuuuguugugccuuaugaaauguuacaauggaacccacuaucauguauaauauaugcuaacugaaacugggaaaugacucaugaaauaauuuacuuuaaugcuuacauuuaaaaaauaaugguuuucauagcuaguuccuuguauuuugguuuaggaaugagauuaaugguauagaagcuauaauuguuauuuucagauuuguuagugcugucucuauaugugagugccacuuuaagagaaauaaguagcuaccuuuaaaauuuuaacauaaaaaaaaggccuauuguuuuauagaagucaccuuuuccugauaggauugucccaccauuuaaauguuuguguccucaaaaugcaguguaauuaaggggaugugagaauauaaaaucugaagugcaguuuaucuauaugacucgugagugacuuuaguguuguguuucuugaguguaaugagagguuaaaauggcagugacaaugaugacuacauggacuugguauuuguaagugccuauuucuagauacaguuuaagaaucaaugaauucgacuuuucaauaaauugguauggguauuaaauuaguuauaacuucaaaaggaagugacuuaagauaaugaguguucauuguguucucuuucaggaagcuagugcgguugggugguccuggcuuagugcuuccgagggugcagucaggauguccgcgggggcuaugaaugcuguuuugaagguaauggcugcucacuugcuauuuugcagacuaugucuucagcaguggugcaguuguaugcagcagaucggaacuguaugugggcaaagaagugcaguggugucgcuugucugguuaaggacaauccucagagaucuuauuuuuuaagaauauuugacauuaagguaaguuuuguuuugauuucauuuuaacauuuuuggugguuaaguugucagccuugguuauaauuuagucuacauguucugauugucuuguguguguuuuaauugacauauuagaaaagugaggauuguuguugauaccucaauagggauauuggaaccgaguuggagccuagauaagaauauugagauauucucuuaucuaugacuguuuucuguccuuuagccaucuaauguucagugugcuacucuaggcauugcucccaaacaucaaucguaucaguguuuccuuugagucaggucagaaaagaacauggagaauaugagcaaguaucugugaccuugacaaguuuggguuaugcuagucuaaaagcugaguuuuuuguuuuguuuuuuguuguuguuguuuuggguuuuuuuguuguuguuguuguuguuauuuugguuuguuuguuuugguuuguuugucuuuuucgagacaggguuucucuguguagcccuggcuguccugaacucacuuuguagaccaggcuggccucaaacucagaaauccaccugccucugccucccaagugcugggauuaaaggcgugcaccaccacacccaaguuuuuuguuuuguugguuuuagguuguuuuguggugcuuuuuuguuuuuuguuuuuuggcuuugugagacagggugucucuguguggcccuggcugucuugaaacucccuuuguagaccaggcuggccuugaauuugcagaaaucagccuaccaauuccuccagaguucugggauuaaaggugugcaccacuacuuggcuaugaugauuucuuaauuucuuucuugacuuccuuuccucccucccucccucccucccucccucccucccucccucccucccucccucccucccuuccucucuuccucucuuucucucuuucuuauuuuuuacuuucuacaugcaucucacugcccaccucccaguugcccucucccacaauccuucuccucugaauaggugcccccucccuccagguauccccucacccugacacuugaagcaaaguuaggcuagguuucuuuaaggauagguugaccauaucuuuucaagugaaaugaucacauagucuuaaaaggaaaaaaaauccugaaacaaaccauuaguuuugcauaacuuuuauuacacauuguuacuauaguugguuuguuuuauuacuguucuuacuauacuucacauauaaauuaaacuuuuguaaauguguuuguacagggaaagcuauccauagguuccagaugucaguggaauguguaccuuagaauguauaucuccacugaugagaguagacugcacuagugauguguuuuaucuucucccugggucauauagaauaguacuuuuuauguaggccuuuuugucuuggacuuuccuuauagccucuuauucauuuugcucauuauaaguuaguuguuucaggggaacacaaauauuuuagcuuuguagauacuguuacuuauaaaagugaucauuuugcuaaaggaaagucuauaagcauaucuuccuguaguuaagccuccacaguuuguauuuagauguggcagugaguguaauaggacagaaaguaaauaugucaaucaaggcuggcagugagccuggacacugccacugugugguagcucccuggaucccagcuuguuagcuguuauaaagcauugcauugcauugcaauuuaaguuaugcuacuuuaguuaaugcugcuuaaaaucugugagucccaggacagcugagagauguggaauacgcccaucaccaacacggacugacuugacagacagacauuuuuaggaaagaaagaguaugugcauaguuugaaagagaaccugcaaguagcuuuguauuucuuaucagugauaggaagcacucuuucaaaacagaauaacuauacaacugcacuaaaaagaagaaaugcccacuguaguggucauaaauacauuuauagcagguuuuauuuauuuuuucuuucugucuuuuaauaaguuaaacuuuauccacuuauuagagcuuaucaaagaacuuccaagaagauugaaucuucauuauuuagggacuguucauuuacaaaguaggacacugugucauagucacgguugugggcugcaugcucuucuuuuuccagugaugcacaggcauugccugcugccuucugugguuucuucuuuuuggccucaaguggggcaggacuugcagccucuaaacccagcacucuccucaaaaagcagcaaucgauguguauacaugaucaaagcgccuaagugcaggccagccugaacuguugauuuuucauauuuuaaauuugugauguaguuggagucuuggauuucaaaugggcaguuauuacauuuuucucacuauuuaauucugguuggagaucaccauugcuuaguaauuauaaauaaccaccuuuggcaugaagaauuaauauauuucuuacacugugucuguagauaugauaguauguagaucucuuaucucuuauuuaacuuugguguguuuuaaucaccuguguugcugcuccaugauugaugguauuuguacuaguguuuccuuaggccauucugcagaaaucuagaauucaaagauuauuauugaagagcucagagaagguguauuggauuauucugcaucuguaaaucgaggaaaagaguaucgaguauuacuguaauguuugguagacuauagccuaaaacuuagcuaauggagcuacacaguggagcaucuuacuugcuuaggguaauauugguaaucuagugagccuaguuauacacucaccuaagggguguacuuggaaaugcuugcucuauugaaugagaccacuuauaaacagguuacuguauuguguauguguaugacaaauaaagucuuuguuuauagaaacaguucuuuaaagaguugucugcuuuuaguccaaggagauuuuuaguacauuuuaacuuuucuucuuuucuaggaugggaaauuacugugggaacaagagcuauacaauaacuuuguauauaauaguccuagaggauauuuucauaccuuugcuggagauguaaguccugauuucuuuuuguuuugauaguuuuuauauuggcuacugucuuaguuacuuuucugucgcugugaagaaauaccaugggcaggcaacuuguagaggaaaggguugauuuggaacuacaguuucacagggugaauucaugaccgucaugccaguaaucacagcuacgggcagggaggcucaggagcaguagcugagagcuuccaccuauccacaggcaugaggcaaaaagagcuaacugggaaugauuccugguuuugagagcccacccacaguguccccaacacuccagcuaggccacacuucauuaguccuucccaacuuggggucaggcauuuaaagcagugagccauuuucauucagaccuccacaguugccuuguuguuuauaaaguucuguugaaaucauacuugauuuccccccccccccugaaaacaaaguauuuaguuguuaaguuucugccaaguaaggaaccuuuucugauagucuuuucugagcguuuucccuaaaaguuacuuaaaauguaacuuuccuccuuuagaaguggacuucugugaacugucauuauuuuuguuaucuaaagcuaaguccaugcacuuuguuguuuguucuuuuugauggaaauacuucagacuugucaaguagcucuuaauuuugccaaugaagaagaagcaaaaaaguuccgaaaagcaguuacagaccuguugggccgacgacaaaggaaaucugguaaauaccuccuugcuuuuccuuuuucauucuauacauaacauggcccagacugcucaggaccagccucggcuugaagagggcuuccugagagaaagaaggggugucuugagaguggugcaaagaaagauucaaagucaaguccugggcccaagcuggcggccuagguugugcagagauggcuucuauugcuuucuguuagcucaucucaugcaguccaaaagcccaguuuuuuacuuacguaucaauucaguuauuuaguccaaguuuccuuuugauuauccuaugaaucaguaucccaugaccucucuagcccuuugauucuuaggagacagcaagcauacauauuuuucuuaacauugcagaggaauucagagauagacccuguccugaaauuaccauuuccaacaugacugagcuuaacauuaucccagacugaccucaaacuuaggaaucugccugcauuuguaccuuuguacguuucugacaagcuggcucauagcauacauagccuuuguuucuuuugauucaugaagccucucauaauucauauuguaauuuuauuucuugcauaguugaaaaauuacauauuuucaaacuuauguauuuagaauucuuucccauagccuuaagaacuguccugaaggucccagccuguaccauuuugcugagacauagccgcacccucaacuccuggacucaugcuguuucuaaccaccaugcagucauuaacgcuaacagggaggacauuccucggaggaaaagagcccuccacugcuaguacugguuccagaaaaucuguacgugauuacacaagcaagccuuaagcccacagcagccaucaacacucguggggacucacaccugggcccuguuccaggggcagaagcugucucacucuguccccaccaaggccacacuggguucggcauguuacuguauagacugugggaaucuggcuuuuuugcccauaugcauagagucaauggcuaguguuuguugugaaacaguuaaaguauugcagcaaaguucauauagccugagauauuuauugucuagcuuucucuacaacaagguuccauauuaccuaccucaagagaaauauuuuuauuuugcuaaacuuuuuugcaaauaaaauucuauguucacugacucuuugaauuauuaauagcauuuaaaaaccaaguuuaaguauuuuuuugguuuguaaaugaauacuuuuuauugcaauucuagucuuuuuuauauuauuacaagaaaaaauuaauaauuauuaauauugccaaauaaccaguguucaaauccaauguauuuacaguauguuuuuuaaaccuuuuuauuguuaagaauuucacaucauguaccccaaucccacacaucucccugucuguccauaucugcucucuacccuugcagccuucccccagaugaaaacagacuaaaaauaaaaugaaacaaaaccaaacagacucucagcacggaagcugcagcauguugcacagauacccuuugccccacagcuugacuugcgaauguugauugcagugagucauuggucugcuuggaggccucgggcuucugcuaugcucugaauacuagauccucacugggacuccucccgcucuuccucucucagucucucauuuucucccucucccucucccccucccccauccccuccccugaugcccacagugugugugugcucaaguaggucugguguguagaggcaugaaaguggugucaugugaucuuguguuucauccuugauugcuguucuauauugagucagggucucugguugaagcuagaggcagccaauuguggcucaugcagcuagccugcuuauucugggcuucccugccugccaccugcaaagcccuccaugaguucuggaauccuaacucugggccucacacuugccaggcaagcaccauuguccacuguggcaucucucugagucuugagaguuguuucuagugacaauuugugaugguuaucuaguggauuuuugugagauccauuagaauaagugacauuuuugaagugaaaaggaauugaaaacaguuguuuaaaguaauuuauuugaaacaguuaaguuuacgauaacuuuuauguaguguaggaauuccccccugcauauaguggcugucuauacuuuuagguaaaguguuucaguugcacagagaacauggccuuaagaauacagccgagauggucacuguuggcuggcucuucauacucugucaaacccugucuccuccuuuuuuauucaauuuuuuuuuaccuuagccacaugacuagcuaguaacagauugaccugauaucuucccgucacuauagaccaucuguaaccuuuucucucuccaaggcugucucuuuaguguuacuggguccauguuuuuguaguucugaaauucaguuauagauuuaauuuuccugaguucuaugucguuuucaguagggaugugaacacugcgcuccucauuguagggugagugcuccuaugcugcuaagacaucccacauucuacauauuaauuaacacugucuguuaacauugcuagcaggugucucacaggagccucagauucuuuuucagccaaacuuugcugauuuuuuucacuuaaaugacuuccaaccgaggauauaugucuucagaaauugcucuaaaaacuuuuauuuaucucaguggauuuuauauuuaagggauaacuuugcaugcagagauuaaugucacuaugaaaacuauagauugauaguguagaaauugcuuccuuuaaaugaucauaguguugcuacaucugauuacaagauggaauguuacaucuauguauuccauugguaggauuuuuaauuuaaccaccaauuuuaagcguuacaaugugguuuguuauuuauaagcugauaguuuuaaugcacuagucacuaauauuucucuuauaauuucagaaaagucuauauuagaaaaauaugugaaaauuauauuuguuuaaaauucuuuaaaccagccaaucauggcugugcaugccuauaaucuaagcacuugggaggcagauguaggagaguucuaugacuuuguuggucagccugaccaacguagacauuucucggucagacagugcuaacuaacccugaaaaccggccuccaacaaacaaaaaauuguugaaguuugcuuugggagaagugucauugucucuugcauuauucagugauuucauuuuagaccugugugugugugugcguguguguguguguguguguguguguguguguguguguaccccucaaaugccccuuaauuuuaccugucucuccccauauucccucccacuacccuucccauccccacuggauccucccagaaaacccuacccauccauucauaaauauuuauucuauuuuccuuuucuaauaagaucucucuguucacguguuagucccuuacucaggagcuacccucugguucuuuguauaaaccguggcuugguugucauuaacagcuacucucacagagcauuaguuucuuaggcugcugucuaucucugcacacaguacuuugaguguagauucuaucaugucacuguccucccaccucaggacuacuccaggucacagccuuccaugugacaaaucccugauaaacuuguuaaccagcuccuuucccuguguccucgacuccggucuuuauggcaucccucauacauacugaauaaguuuuuuucuuuuauuuggaugucuucauacuuaucuuuuucagaaagaucccuuaaucaucuacacauuaccucaagaguaagaguuuaaaugaaguauauuauaaagauuuuacuuuuguuagauauauaugucugcuuuuaaugcugguuuuauuuuuaauucuaacagaaaaaagacgagaugcuccaaaugguaaguuuuugaugauuauucacaaauuuuuuuaaauuacaauuuaauucuuauagaaauauguuuauguauuaauacuuaaugguuaugauaaaaaauagacuaauuuguucuuauuuucaauuguggaaugauaggcaaaacuuagaaauguacuguucuuaauuuguuuccuaacaugaagcaaagguguagugugaagguggguauuauuauucucuauguacucucaaguuuguuguuuagaaucggcaugugcuugagucuuucugaaagguauucuguuuuauuugguguauauguucauuucuuuucaagauuuuaaaacacuuucuuuguaacauaauuuuaauauuugucauguguuacaugacacacuuuuuaaaaugagaauuuaagcaugaaaauguguuuagugcuaacuguacuugcauacaaccccucuugaguuugguaaugaacucuuuaaugugaugaauaaauucugcuuuccuccuacuccauguguuuuuuucuggagagaggacccaucgcuuuuaucacauuugaaugugagccuuguaaauuccgauugcuucaagaaccuuaaucauaagagggcauguaguugcugauuuuuaaaugcaucccaaaucuucccucagaacuuaaaaagauuauucagggaaauuuguauaauacaaaguuuuuaauguagaaugacuguugguaauuauugaggucugugcucuuuacacaaaaauggauugcuuuucaauuuugagcuuaagucuauuuuccagauacaaaagaugaaccacagacagauguauuauuauuuagccuuuuaauuuuuuaaugaguaauugccuucaauauuguuuauucuguaccaaaguuugauauauuugucuuuugcgugaaaauauuacuaauaauaacuuacagggcuauugggggauauaaaagauaaucaaaaugcuuagcauaaugaucaauaaacguuaaauuauugucauuuaccaccugccaggcauuguucaauaaucuuuugaaguagcuccuguuuuacuccuggguaauagaugaaaaaaauaggcauauauaaauaaauuguuucacuauuaagauugggggaaaguucuuccccaaguggccugacucaugaguaggccauagucacuguuauguuagaugacuaaaggagagcccagcuuagaagagaaugaguaacacaucucaagauaggaaucugguauguggcagaggcgaaagaaacagcugagcccugaacuguucaucuaugagccuuuaaugcaguuuagaaguuucucuuaguagaugucaguauuguaauguugggauguuccuguguuguguuugguaugcacauauugaguacuaguuguaaaggccuuggggggggggcaucuaauuuugaaaaaauaacuugaaauauuaauagaugcgugaaucauauaauuaaaaaauuuggaaacauauuucaauaugcccaacauuuauuuguaaauaggcaccuaguugcugugauacaguuugaauauuccuacugaguuacucacaauuuucacgucuuucuuagauuguucuuggguaggugaguuggugguuguuuuugagacugucuguuuacacagcccugacuuuucuagaauuuacuuguagaucagguuggccaugaacucacagugaaccacuugccucugccucugccuccugaguguugccauuaaaggcugcuuaaguuuuuaguuuuauaguuuuagccuuugguguaguaguacuaacuuauuuuuauuaaauaaaugaggaagguuuuuuguuucuauuuuuucauaguacuguuaaagggcaaaaucaugcugcuaguauugccaauauauucguccuuuucaacuuauaaagauauauaguauaccaacauaucacauauauaguagugagugaugaggugcauugugggaguuuucuuuuuggcuuuuuuaguccagcaaguuuugcucucuccauuguagagagcaauagcuuugauauuuuagcuuuacugcguuuugaagugucaccacuagguggcaguggauaccuuaccaaugguuugcucuguuagcuuaucaaaucuuuuuaaaaaaacacuuuaugggcuggggagauagcucaguggguaagagcauaaacugcucuuccgaaggucccaaguucaaaucccagcaaccacccauaaugagaucugaugcccucuuuuggagcgagcggagccaaucggagcaaguccuaaauucaauuccuaacaaccacaugaaggcuuacagccaucuguacagcuacaguguacucauauacauaaaauaaauaaauaaaucucuaaaaaaagauucaaaccaaugcaaaagucucagcuuugauuccuaucacuaguagugauauuuugaaacauuuugaaaauugucauuaauguaaugaacucaaaggaaacuuggccugagagaagaacuugucagagaauuguauauuaaagaauguguugacaaaguucaggagaugauaagaauuuuuaaguugaauguguuguagaaugcaucauucaguuucacuccuagagauauuacuaacauucucuaaaguccuuaggugcucuuaccauucgaucuuugcaguucucaguguuagaauuucuugcacuuuaaauauuuuuauauaauuaaaggcuuugugccuucagauagccaacuuucauauauacucuugggaaaagauuagaggacuuaagucuggcaauuugggggggaguguuagcaaaaaaauuuuauagcuuuuuaaauaaauuauagguaaauagguugaaauauagcuuuucugcuauauauaucauuuuaucagaauuacaauaaaaaacaacaaaggaucacuuuaguuaaguuuuauauauagaucaguguacuuuauaagauuuaauauuaaguuguaaguaagcagccauagguuaaguaaguuauaaguuaugauuccauaaaauuauuuucauaaauuauaugccucucauaccauuuugacucucuuuguaggucccaaucuacccauggcuacaguugacauaaaaaauccagaaaucacaacaaauagauuuuaugguucacaagucaacaacaucucccacaccaaagaaaagaagaaaggaaaagcuaaaaagaagagauuaaccaaggcagauauuggaacaccaaguaauuuccaguaagacucaucuuuuguguucucaucauuuaaaaaaaaaaaguaaaaaaacugaucuugcuauacugccuaggcuggccuuguguuugggauccucggccucagcuuucagagcaguaugugggauuacaggugugcacuacugcacccagcuugaucuucauucuuuuuguguacucuggacugcucugaauuuuuagcuucuuauacaauuuugguuuaagagguucuuguuguuuggagcuaagaugaaaggaugggcuauccggagacuaccccacguggggauccaucccauaaucagccaccaaacccagacacuauugcauaugccagaaagauuuugcugaagggacucuguuauagcugucucguaugaggcuaugccaguaccuggcaaauacagaaguggaugcucacagucaucuauaagauggaacacagggcccccaauggaggagcuagagaaagcacccaaggagcuaaaggggucugcaacccuguagguggaacaacaauaugaacuaaucaguaaccccagagcuugugucucuagcugcauauguagcagaagauggccuaguaggccaucacugggaagagagaacccuugguauugcaaacuuuauaugccccaguacaggggaauaacagggccaagaagugggaguggguggguaggggagcaggguaguagagggagaguauaggcaacuuucaggauagcauuugaaauguauauaaagaaaauaucuaauaaaaaaacgagguucuuuguuuucuguuguugugguagaagagucaacauaaaaacaacuuacaggaguaaguuuauuuugguuucuuuucuagagaggaggucagccaucgugauggagaagcuuggcuauaggaguaugagagccgccuggcauugggaugcagagagaacaggaagugggggugggcuauaaaacagucugucaccagagauacaugcuccuagcaaggcucuaccucauaaagguucugccaccuucccaaugacaccaccagcuaggaacagaguguuccaauacaugaaccuauggggaacauauauccaaaauaugggaaccauguauauguucaucuguuuugggaauuuggugggguuuuuguguuauuguuguuguuucuauuuugcacagagagaaugaauggauuaggaaaaaguaagaacuccaaaggagcuggcuuccagggaagaacacccauguguaguccuuucuaaugguuggagacaucuugagacaguuguaucuucugggucacccaagcuggccuagaauuccaagucuguaggcauauguauacaacaagccagucuugugucauaaaucugacaguuuacuuuucuaucugaaaaaauuagauguaauuauuuuuuuauuuaauucuugaaaauaaagggauuuuuuuuccacuuugauguauaaucagcaggaggauaccuguaagacuugucuagaagcaaaagaaauugagcuguaugcagcacaucucaaguaucuuuaugcauuauuucacaagcccuugucugcauuuguuuucuaauuuuaucuguuuuccauguuaggcacauugggcauguuggaugggauccaaauacagguuuugauguaaguaucuuuuuaagcuauauuuccuauugcucaaaauauauaggaaugcuauggcuuaucuuggacuuuuuuauuuacaguuuuuaaaauauugcuuauuagaauuugaaugugcuauaugcugcugagguuugaauucauaguauuguucugucauaguugcuaaguccuuuaagggaaaauuuuuguauuccuucauuuucugcuuugaaugcauagagaaaaaagugauuuuucuuuuuuuuuuuuuaaguaaugaucucagaagaauaucaaauuuuggaaaaauaaguacaaauucuuaguaucuaguuauaaaauaacccaguuuguuucuaaacugagauuaaacuuugagguacuaccaaggaccucugggcacagcaaagagguggaauagaugaacacaagaacugguauugaguggguuaauaaaaauaugaauagaaugcccucuuugacagcguggaagagagaugaaauacaauagaaaaucucucauguuuaucuuucauaauagaaaauuuaguguuagcauuuaaaucacauaaccauuuuaaaagucugaguuuaauuucagaaggacacagguaaauuauaaguuuugccaugauuguuuugaacacaauugccuacuuagaaguuguuuuaucuguuguagcuaaauaauuuggauccagaauuaaagaaucuuuuugauaugugugggaucucugaggcccagcuuaaagacagagaaacaucaaaaguuauuuaugacuuuauugaaaaaacaggagguguagaagcuguuaaaaacgaacuccgaagacaagguaacuuuggaucuauuuugacuguuuuuccuuuuaaauuuucuaagauuagcaucauggugaacaacuaugcaccccuccuugagcagaaucuuugaauguauggaugacaaauucaguccagugucacuacaucuuugcuuacuuugguaugacaaaagccuugagccaggcaagggacgacgaugaccucuacccagcaccugggaggaggagcaggcauauuucugugacuuugaggccagccugcucuacauggagggcuaccuagauaacugcaucaugagaccuugucuucaaacagaccaaagcaugaugugauuauuaauguaaagguuaccgugugaucucuuauaaaacauuucagaauauaaauuauuuaaacucuuucuauuuugaaauacagauuuucuuuuuuucuuuuuuauauuucaagaaccuauuauacauuaaaaaugauuuuaucuuguuuauauuuuauuuguaauuauguguuucuauauuguggggguagggagugguuuugccuauacgugcaauacuugcagaaggaagaagaggacauugaaucccugagaaccagcauuucaucagucaguugaaagcuguccaacauuuuuuuccuaagaacaaaaagauaaauuaaugauuuauuuuuuuuagagcgagcacauacauaaauuaguauucaaagguaugaaaacagaauagagagauuaauaaaauuugucuuaaccuacuuaauuaguaaaucuuuuuucauuuauuuuauaaaaucauaaaauuagauuuauaaagacacgcaaauuugugauuuccaucauaucccuguguguagcuccuuaaguauuaaguccauuaacuuauaacaaucuguucuucagguccaccacaguggagugguauguauguggaacaguguguggaccacuacgcugaauuuugcaugauuugcuguguuuuuuggaguagcuagaauuuauauguccugccuucaaaaacuaauguuuugagcuugagcauaaaggguuuuguuuuuguuuuuuguuuuuuucuuuuaauguuuguauguuuguauuuuuuugguuuuuugauuuucaaggacaagguuucacuaucacugcauauuccugcaaauuccuauguagaacagguuggccuugaacuuauaagagaucugccugccucugccuccugagugcuggaauuaaacgugccugucuccaucaccccacguguaaagaauaauguguaguaaaaagagauauauuuguauaaaucagcauaaauguugucuauaacuuagauuauuuuauugaaguucucuauuaguaaacaccucuugcucacagcacucacguuuuuacugguacuaauuauaguauuuuauaaauguuuuacacauucauuuuucaauaaccuguauaaaauauguuuauauugacuagaaucaaggaagauguguaaaagaaauuugaauucacagauguaauugucaucucagaggcuugcugcuaagcucacccuuuguaguucuuucugaacucuggcugcugcuggcugaacucagcuguucuggcccagacgccucucugagcugacugaugaaacuggcugcuuuugacuuuucacugaauugcucugcuuggccgccuacuuacuuuggcaauacacucuaaucuucuggcucuuauucucuggcuuguucugucuucaccugugucuaguuuguucucuuuguaacuucucuguaaaacugaccugguaaaacugccaccgcacuaaucuguccuccucucugccucccuuucucuuccucccuuccucucucaagagaggcugcucucaaguagacuacuuucuugugcuguucucgugagaauugggaugggcauggccuaucucugacucauucugucaaauucuuucugauugucacuuugucugcccuucagacacuacuuucagacauggcugcuuccuucuauaaacuagccugacuuugauuguuagggacugaauguguguacuaagggugugucugcauucuagccagaucacuuaggccuagaaggucuuugaaugugaucccuugccagagcagccuugugacuggauuaaaauuucuguacaaggauggagcaguauuagugagcacaguaucacuuauccauuuaagcacuugacaguauucccauaaauuuauagcuagauaacauuugucuguuauauuuucaugagauaacauggcgucaguuccuaaauguuuuaugaauccuguaauacuauaugacuuuguaguauuuucugcuuauaagcagaagaauuauacauaggaaauuagauaagaauuaauacaugagcugggcaugguggcgcacgccuuuaaucccagcacuugggaggcagaggcagguggauuucugaguucgaggacagccagggcuauacagagaaacccugucucgaaaaaccaaaaaaaaaaaaauuaauacaugagaaauaaaauuaucuacugguauuauuaauaacacugauguuggucugaaguaauaguuuucaaauacgucagccuuuuuauguuccauaaacucaaagguauuuuuuuucuauaagauucaguauucuuguagauuaacuaagaguauuuguuuauauuuauguauuacauauauuuauaugcauauauuagaagcauacuuuuuguaacuuucaugucuucuucauuacuuuuuuuuuuaauuugaaaaauaccaguucuuauuuucuuucuggaguuugugaacaccuaaaagucccucacacugguggcugcuuggccagcaucuuggugcaucuaccugccuaacaguggugucuuuacucuucaauguuaauucugucacguuugucccugugaugggguuuguuuguaauagauagaauacaaauaauaaaaaguaaggauugguaauagauuauuuauuuuuuaaaaugcagugaaguuuucugucacuuaagacaacagaagugcuggggccuagagagauggcuuaguagguaagagcacuggcugcucaucuagaagacguaggcuucauucccacuacccucacgacagcucacagcucuaacuccaguuccagggaaucugacacacucuucuggcaugcauggcacccauggcagacagcauucaugcaggcagaacacucauacauaaaacaauaaguauauauuuuuugaaagaaagaaagaggagggagggaggaagggagggaggaaggaaggaagagagggaaggaauaaggaaauagaagugcucaugcugugagggcuccuuuccucuuguagaauuguacuaagggaaaugccaguaacauagguuaaauaauguuacucaguaauguguacaccuuacagagcuaaauauauuguuauuaugggucccaagaucucuguaacccaaaaagucaguuucucugaucagauuuuaaaugaauggagaacugauaaaaugcuuacuguuacauugauuuguauaugucauugguaaaaucaugucucuagaaauacaacauugaauccuuaaaggauuuauucacuuccagucuauguugauaguacuauaccuuuggauuuguuuuccuaauauaucuuacaucuucacuuaaguagacaaagaauagaaauauaacuacugggguagugauaauuuuuuauuaauaacugcaguauaauuuuauaguuuauaaaaaauguuucuuaauaauucagaucuacauaaguaauugaacauuuaaccaaacaaccaaccucuggugauaccaagucuagagcuggugacuagguuuugguaauauuaaacacuguauuauagucaaaggauauauguaaauuagauaaugaaacugugucuugaaagaaaggguuauguuuggcuaauuuugauugauguuaauaaauucuaauaaauuuugccauacuauaaaauuuguauuuaaaauuuauguagaaucuaaauauuuaauucuaaagagaagguugucauuaauuacuaugaaaauggcauuaauugcugucaauguaagcuaaugcuuacaagcaaaguguuuaauuacauaaaguaauuuauguaaaguuuaauuacauacuguauuuaauuacauaauuauauaaaguuaaaaaaguauauuuucuuaagugugcacgugugugcauguguguuccuagggaucaacccuagggcaugcuaaacaaaguuuuaccaacuagcccuaucauuuuguuguacaauugcaugcugugugcaaugccaugcacagcugugcauauaugggcuccugcagagucuggaagaacaucagaaccacuggagcugcaguuacaggcaguugugagcuguuagcuguaggugcuggggacucaacugggccccuaugcaaggccaagcacagcuaauuacugccgagcucucucuccagcuguggauggugaaggaaguuacuuuauuaaauguuuaugcuuucauuguuuucucugcucuuauuucagcaccaccaccaccuccacccucgagaggaggaccucccccuccuccucccccuccucauagcucagguccuccucccccuccugcccgaggaaggggggcuccuccucccccaccuucaagagcuccuacugcugcaccuccaccuccaccuccuucuaggccugguguuguuguuccuccgcccccuccaaacaggauguacccuccuccaccaccagcgcugcccucuucagcaccuucaggcccuccaccaccuccaccuccaucuauggcaggguccacagcaccaccaccuccuccuccaccuccgcccccaccagggccaccaccucccccuggccugccuucugauggugaccaucaaguuccagcuccuucaggaaacaaagcagcucuuuuggaucaaauuagagagggugcucagcugaaaaaaguggaacagaauagccggcccguguccugcucaggaagggaugcgcuuuuagaccagauacgacagggcauucaauugaaaucuguaaguaaugagaccuuuuuauuuugauuuguuuguuucuuuguuuguuuuugguacuaugggcuuuuaccacaacucauuauaaggugucuauauuacaggcuuacucuuuuaccuuuuauaauuuuuacaaugcuugucuguauacaaagaaagguacauauuuuagaugaauaucuguaguuguguaauccauacuuaacauaaacguauaaaauauuaguuaccauagaaagagauaccuuaugcuuccaacagucacugaucugauagcuuuggguuaacuuugucuaauucuaaauuucauguagauggaaucuuacgguguguuugcaauucguuguucuagacuuuaaauaaaagaaacuaccuacuaaacaggggaguacauaauaacccugucuggaagcaagugcagucagucaucuugguaacucaacaccaguaacuaugaaaaggaaaguauacacuaaauuuuuauacuuugaaauuaaaaauaauaaaucagacucuacagaaaauugaaagagguuccaacuuuaaaauucacaauaguaaugguguauaaguuuggauuuucugacuuagagaaaauaagaucauuucaucaucuuuuaaagguucagaacacuucccauguuauauuucaguuacagauaagcugucuuaccuugcuguaugugugccacaggagguccugaugcucguaugacaaguccucugcccucugagccaucuccccagacccacacagaaucuuuucuaaauauuuauaauugaguuuaauaauuuucuucuccaaggugucugauggccaagaguccacaccaccaacacccgcacccacuucaggaauugugggugcgcugauggaagugaugcagaaaaggagcaaagccauucauuccucagguauggucacaugaucuccacggagcgugcgggagggcuuuuauaggauagaaacaaacaggcucguaauuucuguuuauuuaucauuuucuuugugaccguuuugucuacuaacuguguaggucugaguuuacagcauauuuaaucauaguguuugcucaaugacuggucugccuaaaauuuaguagauaccaggacaccauagccauauguaaacuagaagagagaccauguaaaaagugaugaauuaauuaauuuccuauacugggaaaugccaauggaaucuuugacaagcagccacuaagcgaggcuugagauuucucaaugucauuucuguaguauucugaaaauaaccucuauaaugacaaagacagugugguaguacagacagacacucagaccaauaggaagugauaagaauacaguuaaacuguguuucauucauucugaacaacaaccagguaaaccuagauaaaaaagaccuuaauuuaaaacauggaaugagccaggcuguggucacacaucuuuaauccuagcacuuagaaggaagagucagaugcaucucuguguuugaggccagccuggucuacagucuguuccagggcagcuggggcuacacacagaaacccuguuuugaaaaaaaacaaacaagcaagcaaaaccauggaaugcuggagaagagcgggucagacuucuuuugcuuuucucuaacuucuguuacuuuuuagguuaugauacuaggaaauuugucuuauaggaaacagaagauacucuguuuuuaucuaacucacauccauaguaucauacacgugguacuggcucuguauuguuuuaauaucaucucuuacaaacuuggccuucauaaguuuuaugagguguagauaugaaaaauuggaugccaucaaaaucugcauucauuuagaggaugaugacugaacaccucuacaguacuccugcuguucaggauccuccgauacauagcagaccaagucuucccugugguggagcuuguauucaaguaugaagacagucuaagaaaccgagguagcagaauuaugaggaagaggaaauggaggagucagugauucuggggagaauuacacaggguggucaggaaaugccucuuuugaggggugguucugagugggaucuaaaugauaagacagagaggaaaguaguacuuccaaugaugaaauauggaggaaaaaguucagugaggguaggggacagagggaagugguuguagcagaaauggugaauggaaggccgggaggaggagggcaggagggcugggcaagucaugcgugaugcuucagagagagcugcgagugaguccagauggcaggagccggccauggaaggcuuaaaagucucccuccaucugcucugaguugaauguacuggagagcagcaauaacugagggaaaaaacaauccaaccugauaguggguguggacugugguaaaaaggaagugacuugauggagggagaggaaaaaagaauuauuuaauaacucauaugccuauucaccugaaaggauggugaugucacuaaaaugggguaacuagagucaagggagaaaagcagauugugggaagaggucaaaaucuaaaauucuagguuugcaaauuacugugugaacccaauucagaaaaccuacacaaguuucauuugacucauugaaaacacacugguugaaaucuuuuucccguagguagugaggggcuaaaacccaaauggugaaucucccgucuucaucuuugaucccauccauagucuguagauugauuuuauuccguuaauuuuaaaccuucuuaguaacuagauucuagaaauuaaauguuuguguuaggagucagguaguuggaaaaaugacuugagaauuauuuaugcgugcuuaacuccugcuuuuggguuuauuuuuagaugaagaugaagacgaugaugaugaagaagauuuugaggaugaugaugagugggaagacugaucuauauauuauauauauauauuuuuaaggugaaauacuaaacacuacuuccugucuauugaucuguaaaauuaucauguaaauguucuaccaauuggcuguauauuuuuguugccuuuuuugcuuuuuuuuuuuaaauuaaucugugcaauaccucauuuaaucuguaaagguuuguuauaauccuauauaaagcuacuccuuguugcugugugcaaguuuacaucaggaugcucacgugauuugugaauauuuucauuccaucaacaagggaguuuaauuaugugugagacugacacaaaccuuaauguaauuuaguuagaaugccagaaggagaacacuauuuucauacccuacuuuuucuguaccuaaauuuucuuaauaaaauuuaguauagcacuacauucuuuuuuaagugauguaaacuuuaguuucuuuagccccuucauuuugaauaugaugccacauaugaauguugaagcugauacauugcacaauucucuagacaccacucacuacacuaaugcaguuuuucaaauucuaguauuauguguugcuuaagaucacuacagagaugcuacugaagagagacgguaguacagcucucuugcaguacugccugccguugguaagcaguggcauccgaaggcaggaacccugaugagcccucacgugccuguccuugaccaaggugacuuuuaugcuguggcaacugugacaggcuauuuuuuagcaaagaguuagacguuuguuaucaugccccaaaauaguuugagguaacauuuuuggagguagcuucgugcaucauaaacaacuuucgugcucgugucugacucgagcgguaucagaacagggcugggauggagucuucguguuuugcacccugugcauugcuauauucacaaguaccaacuguaggagucagagguguuggcaaaaguaugcaugaaugcuaaccuuugcacauacucuguuuuuacuuugauggcuucuccagguuuuugucagguaccacauguagaauuacauuuuucuuaaaagauugaucauccaaauggcaaauuucuuagaguccauaacugauuugauagauuuuucuuuuuaaauaaaacuucacagccugcacaguuguuacgcauacuacaugguauguuacaauuaggguuuccuugccucuuuacaguacacuaauccgccuaaagguggcuguuugauauuuaccgugauaauuaccuuaccuaccuaccuacuuucaauacacuuuagguagccgauuaucugauuuaagugcagacacacuuuucucacauugaguuguaugcagaauguagcuucagauguauucauuauaguuacaauauccaacuaaaaaguacgcuaucuagaaguauaccgaccaaaaucuaguauugacaugaucuugacaggcuggaccugugagauaugguuugaauuuuaaccaguuuaucacauaaccucuagagaccaugcaucuaguuauugucaggaauaauuuaaaagguuuagucgccaaaagcaguuaaguggugcaguaagauaguuaaguuauucaaagaguguuacccuccuugcaagaguaacugaagcacauuggaaagauucucaauuuuguguuuccuguaaaaacagugcucucugcugcuaggaccuuuuuucugcuuccugucauuuucauguggcuugagcucugagacgugcggaugaggcuggacaacuacuacccauacaauuagggggucaaaauaacuuuaaauaaauagcaucggacuuucauauuuuucuuuuugacguggagaaaacauuuucaugccuaaaaaugucuuugagauaaugccaauucugaugucccuuaccuuuuggccaagaaguuugagauuuuuucagcuaauuuguuauuugaccagaaguugucuggggagacugaguucuuugaguugcauauaaauggggguauauuauuugccaaagguaaaauugaguuuauucuuuuucauacagaaauggauuuugcuuuuguuugcuuuuuauuuuuguguaaaaucuaaauuccaggagcuaugggguucauccaggcaugaaggcuaauccacucugaguaaagugucaguugcacagcuccguccucuucugucuugcacuguggguggcacuauuuauuccugugcgucaucuggaagccucacggauacauccagcuaugugcuugucugguagccuuugcguuuaacaaacuagcaugaggccuuucauaucuaaaugcugugugauagacaauuucagcuagccacauauuguauuaugaaauucauaaagauuuucaaucauucaauuucauuuaucaacugaaauuuuguuuaguaugugaauuuuuuuuugaaauguauaguaaauaagauguugcacugguggcaauucaucauggaacauaauaaaauuaauuugacccaaauaguauaaaau

SEQ ID NO: 2857 - RNA, 65741 nt, Mus musculus
uaagcugcucgcgcccgcgcgcgugcaugacgucacaggcgccuagguccagacuuuaguuguccgcggguuuugcuggugagugaauuuggggagguuuggguuucgcugcgggccgacccuggguaaauauaacgaggacucuucacugcaaaauuuggugcagauuugcagaaaugcuguuacacguacuguuaguguugaccgaucccuaucgggaagagacgugaacagauccaaguccucccucaugcugcugaguguuuuggggacgguuggucucuauucguuaagcagcgaugcuauugaguagcccaggcaaggaguuugagaaguuucaaccuagaguucacagauuaacaucaauugcaaguuucucuuaggauauuuacgaguuugagggaggaggcaaccaaugccaguuuugaaaucaggaagcuuuuugguacagugugcguacacaauauuuucauugacaaagggguuaaagaauaaaacccgugcuuaucucccgcccccacguccaacauuuuaagauaccaaggugaaguuggugaaauuguaacaucuaaaaucuuagaaguuuuuuaaauacaaaagcuaaguggaaauccagcuaagaagguuguuaacucagaaaacauuuuccuccgagaaggaauacccauacuuuauauuucguaucuuuguaagagauugguuuuuauuuuuacaguuacaacugagacugaauauaucaguuuacaguuuuccagcagucacauaacgagcauauuauuuuaugauacaauggaaaacguuucuaagguccaagauaaauauaucugaccauuauuaauuccaauuaguaauguguagcaguaugauaugugaacaugagauagcuuuuugguuucauauguuagauuaagaaauuaaaacugagacuuucagugugacacaguguauuuaaccuuuuugacagucguguaugcugaagaauuuggaugcuguuguaaaacuguuaauuucauacuagauguuagcaggagaaagacauauagaggaaccuccucugccuccuguacaaagaauauauaggauauagaaagcuuaaagggagaaaauccaauuagguaaggacagcaaugaauguaagaguugauaaagauuugaauuagugauagaaagguuaggaaaaaauagucauuuaaugcuaagugaacaguacaauuuaguauuuuuuuucuguuguauggcauuuugguguuguguguauguuaguuuguuuaauuaucacaaagacuugugacauugaugcuuuauagcuuaccuauauagacaaaggugcuguauuucagaaagguuaaguaauuuuccugagaucagauagcuaauagauggcagagaugguauuugaauuuagacagccuguuucagacaugaugagauaaaaugcagaacaauuagaauagagggucagugaguucaggaaacuuaacuguuuuaaauucucaacuaugcugggcaagaggagaggagacacagucuugugcccagaguucagguuuggauauuggagagagcugucucgggcuaucucaaucugucccuaaguauagauuuugacuuacuucuguguuccaaaaagaaguugaaugcuuuuuguuuuguuuguuuguuugguugguuugguugguuugguugguuguuguucucuuugccagccacaguggguuuccaccaaacucagaggcuugucacucaacuccucuauuguuaggccauugcucugaugaaaaauaagggggaaagagucacccaaggcaccugccuuucugcugugcuauugucuuccccuuggucuugacuuucucaggucugugaagagcuugugaaugacugauucccuuggugcuccuaagugcccuguacaauugcacagcccauuguuggccuuuacaguccauuaaaaaugucugauaaguuuucucacaaauguuaguaucugucauuugcuuugugcuuuuaacaagcacauaccucucuucuuucacucagcucucugauaguuuauuguccuguguuuccucuggugggucaaagaaggguuuggaacuuguaaguuauccaaccauuuguuguucuuccuagcauuuuaccugaguagaaacuuuacaucuuuauuucugaaucauuauacauuaaguaaccauguuuucauaguuuauacccauaguuuuaugaugacucuuguaugaauaaaguuguuauauuucugucucaucagaaaguuggaacuuucuuaguuaugauuaaguuuggaauauuaaugugagagggagguauuauagggucuacuuuuaaauguuuuuucaauaaauaaaauagauauucuuguggauguuuacaaagaaucauuaaaauuaagagccaaaagaaauuugaaaacucgugaugaaauacuuuauuuuguguguauuuuugaguaaaugauguuuuuaaguugacagaauaguuaguuacugaacuagaacaaaacugaaauugcacuuguguuuuauguauuaauuuggccagacuguccaguauccuaguuuaugagcauaucauuucaugcuuguaagcuuuuuucuuuauuaaauuaucauuuaaacuuucuaaaaccaagcuuuguuuguuguuguuguuguuguuaugaagagauaauauaggauaagacaaagcuuuagaaaguugauuuacuucaucauucucaguaucuaaauuaaaagguauguuuaaaaauugaauuauaagugauauuuauuuuuagguccucugauuuuugucaaguaaauuuuaaauuuuauaugacaacaguauauugacuuccggaaggaaugaucuaaaugagcaauaagaaagauucucugaugauuaauaaagcuucuuuaggacuagcauagcauuacaacauggaaagcacaccguggggaacugugaguguauagcaaggccuaggcagcacaagguuugaaaggcaaaugagcaucuuacugaagagacugugagcaauaacccuuggucagagacaucgguaacaaaaguuacaucacccuaggggugugugugugugugugugugugugugugugugguaagcagagacauuucugauaguaauucucagucagaugugggaacacauaucuuuuuguguuuugcuacuguuacuacaacuccauaaauucagugcuuuaaaaucuaugguaauauuacauauauauuacacauauauauguauaauuaaaaaauggucuucuuugcuaacuauuuuucuuuucuauucagggaaaacucaguugcuccuuaaugcuuuguggaagucaagcagcuguuuugaagauuauacuuuaagguguguaaugaaagcaugcuucauuugugcuuacccuuuugcucauacucuagaaauagguaucuuuaucuauuuacauuucacauggggcuggggacauacgugcgcgcacacacacacacacacgcagacacacacacagauacacacacacacagacacacacagacacacacagacacacacacacagucacacacacauauucacacacacacagucacacacacacacacacacacacacacgcagacacacacacagacacacacacacacacacacacacucagugauucuuuacuagguaauguguuuagaacaauguagacagccaauaucucucuaaggaaaugcuauuucccccuuugccagcgauuugcuguaguuucuccuccuuccucucauuccuucaccauuaucugagaucccuuuacuccugccaucagacuauugcaaugucuguuugcucuguuuauauuuuucacuagcaugcaugaccuaauuguuuuaguagccuuuaaauuuugccuucagcauacuacuuuuuauauuauuggccuucuauauagggagaauuuguuuccuuaguaauguucaaguaaacuuggcaagcuaggaaauuguaccuuagccauuuagauacuaccaguuaguccuaaagccuguaaauuguuuguauagucuggggcagugaaugggagccagacuaugaacugcaaguauuaauaccagcacugggauagacacuguuguuaguucugggaauacuguagugaccaaauuuaaccuuugcuuucuagaguuugcauccuagaggggggaagaagugcaaugaguaguuauaaaauuuguaauaccaaauacaaauaugaucuuguuaaaagacaaauuaaauuuguggagucuaaagacagaauaaauuuugaggaaauugaauaucucuacuauauucaucaaguaagauguauuggcagaaaauugaaacuuguuugguuuuggguuuauauuaguuugauuuggcagaugagugcugauugaacuguaaaguuccagcagggccagagaucaaguaagcagaaggcucaguuauggaccucaugugugaugugagaucuuuuagagaagccauucauuuguuaagcaaacaagagcaaaugaauguaguguggccggacaggcacugcugugucaguguccagacgggucuguuuccuuaagccuuuacauuuucucagauguacauccuuguggggaaaugaccaagugaaagggaguuuuacaagggaaacauacauuuguaauuaguaucuaauccagaaaagaguuugacauuggacucgcucuuucugucacuacccuccaaagauaaugaauguucuugugauccauaggcuaguuguuuuuccuuuaguuuuauggccucacauugcucuucuaugaacuuuauucuaaugagcuuuaaccgacgaccugggucuacuuucauuacccuggacuguuccauucuguacauauauggccgcuuaucucuucuggucuuguucuacuguccauagacaguugaaguuuuaugguuuuggcuauaacagauaugagugcauauguuuuuaggaauauguguuucugcagaucauacagaauaacuuuuagugaaguuuguguguuuuaggccauccauguauuuauugucaguauuucuuugagaauuugggugacuuccacacugucaucagcauauuauauuuuucacauuuuaaauguauguugcuuaaaugugugugauuuaauuuuacagcaguuuggcauagaugccuaggacugugaggaaccucuuuugauauuaccaugacugucuuccaagucacagcaaauauuauagcuaauggugugucacuuuaaccuuuccccaagaucaggaauagaacuugggugcucauucuacuccuuguccaaguagccaauguuguauaccaaagacagaaagaagcagggugggccagaagaagacccuggggaacugcugucaggggcagaugacacaguauaugugaaagcggucuguggaaacguagugucauucauccuuucagaugauguuuuuucaguaaguauuucccucacauugagcagaugucuucacaccuuaauucgcgaagaguuccuucaucauuggauguuggguuuugcuaaagacacugguucgccuugagugcugaucacugggucucuuaauuuacucugcucguauguaguuccccuugauuguucaguguuuuccuuuuaaaacuaucuuauauuuuuagggaacacuguuuuuguuacaaucuuugguuugggucuccaacacuuugcuacagauguuugcuucuacauuacuaaggcuaauagugugaagcuuugucguggugacacucuugucuaagaaugcaguucucaugagauagguugcuaguggccccuccucuucauugaagaauaguuugaggaaugauuagugcugccuuaaaugucuaguagauauuuuuaugggaggaauauuaauaaaugucauuauugaaguugagguucuccucugugcuuuuaccucuuuugacuugaaggaacuuuugauuuuuuauuucuauaggaaauugccgcuuucauuuaaguuggccaauauacuguucaaaguuauucuuugguguauuuuaguauugauaaguuuaguaguaauaccucauuucuagcuuuugucuucauaauuuguuuuuuucuagcuagaagucuauuugauauauuguaaaugucagcuuuuauguuaucagauuucuguauuuuccauuuuacuauaguaccugcuucuguguugaucucuuaacucuguucaguacauguucuuuguaacuuucaacacaaaguuucuacagugucuuucuuguaacuacuauuuucugugucugcauuucccucuacuugaauaauuuuuaguugucuaauuuaaggauuuaauuuuauuuaauaauuucugcuaguauucuugucuuauuucuggaauuuuugaccuaucuguuuuaaacauauuauuauuauuauuaucaucaucaucaccauuauuauuuuauguguauaaauguuuugucuuuguguguaucuguacagugcaugugugccugauaaucucagauacuccugguccuggaguuacagacagucaugaaugcuaggaaccaaaaccugguccuguaguagaccauccaguguucauaaacucugaauggcugagccaucucuccagcccaugucuuugguucuuauguuaagcuuggggcuugauucaguuccgugccugugcuuuacagcuacucacuugugcuaggauuucacuguaccguucagauaggaugugacauuguggucccuuggcuucagucucucaagugcuagaauuauaggccuggcaccgugccuuguuucuguugauuuuguuuaacccauuuuaugaacugauuuuucuggcaugccuuaaguacaaacauuuaaauuuuuucuucaugauuauauuugaaaauaacuaugcuugugaaaauauaacaguuguauuuaauauauuuaucuuuauacauauguuuuuaucaauugacaaagaaaaaucaaauucaacaguguaguaguauuuuuugaaaaauuaucaaauggcugaaaaaguuaacuuucaaguugcagaauaauuuuaaacaauauuuauuuuaaaauauauuuagaguuauuaauauucucuuauagauucauuuuugaaaaauuggaaaauauauuuuacauauggaaaagauauauaaaaucaugcgucuaauauuuuacauaaccaagagauacauaaaaaaugaugccuuuaaaagugcaaaauuccaaaagguauaaacuuagccauguauauaaugggaaaguuucuccugucacuucaugucaauauuuaguauucaacagaggcucuaagcuuacauaucuguuucuuccucaaacuaauguuauuaaaaauuacuguauuuuguaacucauugugcucauuagauucuuaguuaucuuacaaaugcaugccuguaaacccuuagccaaguaguagucaagguaaacuuacaacauaugaauaggauuagacggaguaguaguaauaccaggcagagauguaaaacauggaaaauaaucacaguaauaaugucacugcauagacuaccuuaauugaacaaaggggaaacaugacaugauuauaucagaagcugcagaaagcauauuugacaaaucccagcacuuuucaugauagaauguaaccuccccccagccugaagcaggcugagccagaccuugaccuugcugccacuaaggauauuaccuagggugcagccuuccucucuagaucacuguauuguucagccacugccuuuguuccccuucaagauacugcuaccugccgccaggaggccgcugaacuauuccagagacuacacccuauccugcagcugguuccaggaucaaaggaugaguuggugggaaugcucccccccgccccccgcaccccuuuauaagcgcauuugccauuaaacuuuugagcuuugaucaggaaccuugacuuaucuccauuuuugucuugaccgccuaauuccccccuuucagaagcagccugccacucagguguaagguguccaugugagccgcuggcuggcucgcaacaauagaacucagaaaguuaagaggguccuugcuuuuuaugauaaagacauuuaugaaaaauauagcuaacaccauguucaggaauauagaggucaaaggacaacauguguaguugguccucuucuaagaagugggucuugaacaaauucagguugucaggcuuggcaucagcuucuuuaacccauugagccuuuauuaugcaaaacuuuaaacauauagaaccagugagagcuauuuagcuaacaguuugucuuaggguuuuacugcugugagcagacaccaagaccaaggcaagucuuauaaaaaaacguuuaauuggggcuggcuuacagcuucagagguucaguccguuauccucaaggugagagcauggcagcauccaggcaggcguggcacaggaguugcugagaguucuacgucuucaucccaaggcugcuaguggaagacugacuuccaggcaacuagggugaggauauuauacccacacccacagugacacacccauuccaaccaggucacaccuucagauggugccacucccugguccaaggauauacaaaccaucacacaguuauacauuugucagcuaauuucagcagcauguuagaguuuucuaguggaacugauagaaagcauauauuauuuguuuauacuguagaggcuggauuguccuaacaaggagcaucugcaugcuacagaggcugaaaccccauagcuguucagccaaucuguuugaugccucagcagucucuaucuucgguuguggaaagccuacagaauuucugcagaaccuuuggaagacucaagaagcuggcaucugaugucaguaaaguauagcagcagcagcagcaguggggcugaugcacucaccagcaggaaugaaagguaggcagucaagcugcauugcuuuuuccuuagaccuauuggauauaugagucuuucuaugagucuuagcuggacuguaccaaccauucuguuggaagagcgucuuccucaaagacuuccccagaggcauguuacuugguggauucuccauccaaucaccaucaacaaucacagcuagugggcacuuuguuucacccuuugaguauucagcgugauguauuauuuugaggcaaauuuaugaauuguuuaauuuaaaccauauuauaggauacagaauagacuucaaauauuaugccugcauauauccauguuuaugucacaggaccauuaggcugucuaaauguucaccucaauuuuuaaaagauuugcuaguuuaugucugugccagcaucugcgugaugggagcagaaggugaagaggccaguagaggacauuacacugcaucccuugagaacugcaaguguaggagacugagcugccuggccgggaugcuggggacugaacugcaguccuccuaagcacagccagcugcaccagcucuccagcucugucucgucuauuguuuugguuuuuuuaauaaaauauaucaaaacauuuauguccacaucaucaucuggcucuuccuagucuuuuugguauguauacagauacaauuccacuauuagaauguaaauaauuuaacuguaguuccuuucuaugcucagauuucaaaugagaccauucucauggcuacuuaauaaauuguucuucaauuuguucuuguuuguuugcuugcuuuuuguacaagaguggggucucaaauagaaaacccacuauggagguuuuguagcauuugauuggcacuggcagaggauguuuguguauccugauguuugguguagugggugaaggacuugguauucagguuuuucagucaacaaaaaaugccuaaaauaauaucugcuuccuguguucugaauuugaauuuucuaaaaugauuaauaucaaauuuaucuaccuucuagguuaaguaaauauuugauuaaaaaccagcuguucuuugauagcacguguguucccuguaaauuuuaucuuuuuauuucuuucuguauaauguuuauacuugaaaauguuuuucgugaaauaguaaaugugcacagcuggagauuuauaugugugugugcaaguacagguucaguguguguguguguguguguguguguguguguguguguguguguauuagaauuuagaauugacagauagguuagucaauuauaaaucuuugacuaacaucuuacuuucauugaaauuauaauguauugcucugaggucaguugaaagcaaguguguuuuacuuuuuguuaaagagaauauacguauuuuguuccuuaagugccagcaugugcuagagagaaguaaaagcuucauacagaaacuuuccgugaauuuaacuguagagagcucuacuuacuuggcauugacuacucuuacugugguuuuguuagaacaaaguaauugaauagaauauuauuuaaguuuaugagcgaaauaguaagccugaguuguuuaguuguuuaguguagaggcugaaacauucucauuaaguuguauuugccaaaacaaaauggcaauagacagaguaaaaggaaacaaagauaguaacacugcacaugagccauaaacaugccacacaaaggccaaaguuugaggcuugaauaucuuuuccccuuucaaaaucauuagcuacuccgcuaaaauuauuccuuacaaaaaaagaaaauaaaauguuccugaggaauauauaacaagaaguugcuuacaccguuagugcagcguugcauugucagucacuuccucugugcugagucuaacauuggcuaaggaaguuacuguaaggagauuugagacccaccccacccacacacacauuuuuaauuacaauuccauuugaucuuacaucuuuaacauuuuuuuaauuauggaaauuuguguguguguguguguguguguguguguguguguguguguagguagggaugugugcaugugagugcagacuucaguggaggccagagcaacguguugguccccuagagcuacagguacaggugguugugugugccugacaugagccaugaaaccaaacuauacugugauagagaaugugaguauuguuaaauguauaguuaaccauauuugaaugaaaguaacauacauacaaauaaauccucuuguuuuguuugcagauuuaugauaaaucugugagaggauuuuucaucaaacaaugucuuugguaaggugauauuuaguauauagugacacguaaacauuuauguaucugcuucauauuuuggucuauuuuauaguuuaauuuuaaauuaaccuauuugauagucagcuuuuacauuagugcuaauccaauggaaaccaguaucuucacuuuuuuauaugaugguauugcauuauaguucuguagguaccuaauguauuugauuuuuuuuaccucuaucaucuacuaauaucucugcauaagcuauacacauguaagaaaacuggaagaaaaccaguucuuacuuuaugaagacacgcaguuuuuauuaguuuaacccacaggcaaauucaucucucuugucagccuguguuaaagcagauuguuggguacucaguagugauuuaacaaauuguauaaauaaacaaagauuuuuauacuuauacauuuuuaaccaauuuuucuuuauuuuauaaaauugugguaucuaaugucaguaggcaguguuuuuauuuuuagggguuggauacuuacagcugaaugaaauuugaaagagagcaauacauugauaaaguuuaauauaauguguguucuaccuauaugcauucauuuauuauucauuucucuuucuguguaucuguauaugcuuguuuaaguuuauguacagcauuugcauggaggugcccacccaagccauaaggcauuggaucuccuggaauggaguuguagacaauuguaaaccacucaauaugggugcuagaauccaaauguuggucucuuccaagagcaguaagcuaucauuagccauuguggugugcucacggcaaguaccuguaugugcuagcaguugauggucagaucuaucuacuaaacauuccacagcagaauauuucacuaaaaccuuguaugugcuaacucuaguguagcuagccuggguccucugucugcuucagagggcugugauuacagguggaccaccaaccccaccaaguguuuaccugcgugcuccaauuuguacguauauauggccagugcuucucuuccuacaucauccuuuuacuaaggucaaaucuaaguggaucaauauacuccacacaaaaccagagacacugaaacuuauagaggagaaaguggggaaaagccucgaagauaugggcacuggggcaaaauuccugaauagaauagcaauggcuugugcuguaagaucgagaaucgauaaaugggaccucauacaguugcaaagcuucugcaaggcaaaagacaccaucaauaagacaaaaaggccaacaacagauugggaaaggaucuuuaccuauccuaaaucagauuuuggauuaacuaauacccaauauauauauaacgaacucaagaauguggacuccagaaaaucaaauaaccccauuaaaaauggggcucagagcuaaacaaagaauucucaccugaggaauacugaauggcugagaagcaccugaaaaaauguucagcauccuuaaucaucagggaaaugcaaaucaaagcaacccugagauuccaccucacaccagucagaauggcuaagaccaaaaacucaggugacagcagaugcuggcuaggauguggcuacauuguuggugggauugcaagcuuguacaaccacuguggaaaucagucuggcaguuccucagaaaauuggacauaguacuaccggaggauccagcaauaccucuccuaggcauauagucagaagauguuccaacugguaagaaggacacaugcuccacuauguucauagcagccuuauuuauaauagcgggaaccuggaaagaacccagaugucccucaacagaggaaugguuacagaaaaugugguacauuuacacaauggaguacuacucagcuauuaaaaagaaugaauuuaugaaauuccuagguaaauggauggaccuggagggcaucauccugagugagguaacucaaucauaaaagaacucacaugauauguacucacugauaaguggauauuagccaagaaacuuagaauacccaagauacaagauuuaauuugcaaaacacauguaacucaagaagaacgaagaccaaaacguggacacuuugccccuucuuagaauugggaacaaaacacccauggaaggaguuauagaaacaaaguuuggaacugagacgaaaggauggaccaucuaaagacugccauacccagggauccauaccauaaucagccuccaaacacugacaccauugcauacacuagcaugauuuugcugaaaggacccagguauaggugucucuuuugaggcuaugccggggccuagcaaacacagaaguggaugcucacagucagcuauuggauggaacacagggccccaauggaggagcuagagaaaguagccaaggagcuaaaggggucugcaacccuauagguggaacaacaauaugaacuaaccaguacccucagagcucgugucucuagcugcauauguaucagaagauggccuaguuggccaucauuggaaagauuggcccauuagucgugcaaauuuauaugacucaguacaggggaacuccagggccaagaagugggaguggguggcugggggaguugcgggggaggguauggggggacuuuugggauagcauuggaaauguaaauuaagaaaauaccuaauuaaaacgaaaagaauuggagcuauauaaauugguauaugaauuuauagugacuaauuucauggaaaggacauugaauaauuuuuguuuugcuuguuuuucucuguuuugaaccaguaacaaguuacgcaggugccuuuuagucucccuaagcuguucugccuuucccauuuucucaugguagggacuugcugguuaagacagaauccccguuccaguuauuuauuggcagccagaaucaucuccuuucuguuccuuuugcugagcacuauuguaacauaaauaaugagcuacguguuucuuguauauuaaagacugauuaaauagcaaagcccuucucuaucuacaucaaaaaaucagcuuuccuaaaaagaaagaagaacuaaucucuaucuggguuucuagucauuuucuuguugaagaaguauaauuauauuuuuaguugguuaaacuuuuauagguugguguguuaauuucucuacuucugaacaaaauuacuucaagagaacuuguugguuucuauaguaacauuuggaagcuauuguguuguuuuauaaauguuuccccuuuacauuuugaagucuucuuuaggauaaccauuugaaaacaaaaugaaauauacuuaauuuacaagucuuacccuaauauucuaaaagguagacagugauacaguuguuguuuuuuuuucuuucuuuagguuucaacagcucccuauacauauacaccccugaaucuacucaaggaagguacaauugccaaugucuaugguguugugaaauucuuuaagccuccguauguuagcaaaggaacugguacguaucagugugugugguguuuuaugaucaagaacugcuuuaaugaucucagagacauagcucagaucaagcucaaucuugacuuuuuuuauuagauauuuucuguauuuauauuucagauguuaucaccuuccugguuuccccuucgaaaacccccaucucauccccccuguuuuuuguuuguuuguuuguuuguuuuguuuguuuguuugguugguuuuccagacaggguuucucuguauagcccuggcuguccuggaacucacuuuguagauuaggcuggccucgaagucaguaauucgccugccucugccucccaagugcugggauuaaaggcaugcgccaccacucccccugauuuuuaauugccaaacaauaguaaugaauauuauuuggcgauaauuugugaagugacuguggucuuuagauucuggggucuuauuuagcaccacguggauucaguuuucuaaaggauucuaaaugguguggaaggacaugaauaucuggcccagaaauuaaaagcaaacggaagagaaaaucuauccauaauaugcuuuaauugauacacaguauagcaugugccgagugugagcugagagaguacugggaggagaugcaaaaggagagcuuuaaagugauugaaguuaaauaucuguaagcuuagaaaauauuccuucugcuuuaaaguguauuacaugagcccaugguaaccacaaagaaaauaccugugagaaauauacuuauaauuuaaaaaaaaauuaaaguuuaucauuguaaaugcucaaugaagaauauguagaagaaauuaucacaauuucacacuucauguaugcaacucucacagcuaacaugaugcuagucacugagaaggacaaaacuuguccucagaaauuaguaaagugcaaguguggccuauuuuugggacuguuuuguagccaaaacaguuguagguuggaggcaaaagaaaagaaaaaaagccauugaggaaagaagaaauuaaguuaugucuguaaagagccguauccugugaguagaaaacuaaauacuucaaaaaggaauuccucugaaaacuuguaaauggguucaguaaaguuacuaaaucaaacuuaacauuauagaagcauaccagugaugaacaauuucaaaggguaagaaaaagaacuucauuuagaauagcacugauucuguaaaguacuuaggaguaaacauaagcaaggacguuaagacgugggccgugaauaauacagacaauugcuggaaucagagaugacgcagacagaugcagugauguccuaugaccauggguagcaaggguucauagucacaagucuacaaucuucagagcaggauggcaauuauuugcagucacuauuaaaucucauugacuuuuauuuuucacuucuuuuuuuuuuuauuauuuucuucauuuacauuucaaauuuuauccccaaaguccccuauacccuccccccacccugcuucccaagccacccacucccgcuuccuggcacuguauuggggguauaugaucuucacaagaccaagggccucuccucccauugauggccaacgaggccauccucugcuacauaugcaacuagagacacaguucugugggcuacuuguuaguucauauuguugauccuccuauaggguugccgaccccuuuagcuccuugguuaguuucucuagcuccuucuucaggggaccuguguuccguccaauagaugacugugagcauccacuucugcauuugccagguacuggcauagccucacgaaaaagagcuauaucaggguccugucagcaaaauguuucuggcauaugcaauauugucuggguuuggugguuauauaugggauggauccccagguggggguccuuucuacugucucagcucagaacuuugucucuguaacuccuuccauggguauuuuguuucccauucuaagaaggaacgaaguauccacauuuuggucuuccuucaucuugaguuucauguguuuuguuaauuguaucuuggguagucuaaguuucugggcuucuauccacuuaacagugagugcauaucauguguguucuuuugugauuggguuaccucaaucaggaugauauccuccagaugcauccauuugccuaagaauuucaugaguucauaguuuuuaauagcugaguaguacuccauuguguaaauguaccacauuuucuguaucuauuccucuguugagggacaucuggguucuuucuagguucuggcuauuauaaauaaggcugcuaugaacauaguggagcauguguccuuauuacaaguuggagcaucuucuggguauaugcccaggagugguauugcuggaucuucuuguaguacuauguccaauuuucugaggaacugccagacugauuuccacagugguuguacaagcuugcaaucccaccaacaauggagggguguuccucuuucuccacauccucgccagcaucugcugucaccugaauuuuugaucuuagccauucugacuggugugaguuggaaucucaggguuguugguuuuuuguuuuguuuuguuuuguuuucauuucccugaugauuaaggauguugaacauuuuuugaggugcuucucagcccuuugguauuccucaguugaaaauuauuuguuuagcucuguaccccauuuauuaaugggguuauuugauuuucuggaaucugucuucuugaguuccuuauauauaauggauauuaguccccuaucugauuuaggauugguaaagauccuuucccaaucuguuggugaccuuuuugucuuacugacaguuucuuuugccuuacagaugcuuugcaauuuuaugaggucccauuuguugauucucacucuuacagcacaagccauugcuguuguguucagaaauuuuuuccccugugcccauaacuccgaggcuuuuccccacuuucuccucuauaaguuucagugucucugguuuuauguggaguucuuugauccacuuagacuugagcuuuguacaaggagauaagaauggaucaauucgcuuucuucaccaugcuaacugccauguguuggagaugcugucuuuuuuucuacuggaugguuuuagcucccuugucaaagauuaagugaccauaggugugugaguucauuucuggguguucaauucuauuccauuggucuaucugucugucgcuauaccaguaccaugcaguuuuuaucacaauugcucuguaguacagcuuuaggucggguauggugauuccaccagagauucuuuuaucauugagaagaguuuuugcuauccuagguuuuuuguuauuccagaugaauuugcaaauugcccuuucuaacucagugaagaauucaguuggaauuuugauggggauugcauugaaucuguagauugcuuucgacaagauauccauuuucacuauauugauucugccaauccaugagcaugggagaucuuuccaucuucugagaucuucuuugauuucuuucuucagagacuugaaguucuuaucauacagaucuuucacuuccauaguuagagucacaccaagguauuuuaaauuauuugugucuauugugaaaaguguuguuucccuaauuucuuucucagccuguuuauucuuuguguagagaauggccacugauuuguuugagcuaauuuuauauccagcuacuccacugaagcuguuuaucagguuuagguguucucugguggaauuuuuagggucacuuauauauacuaucauaucaucugcaaauagugauauuuugacuucuuccuuuccaauuuguauccccuugaucuccuuuuguugccgaauugcuccagcuaggacuucgaauacuauauugaauagguagggagaaagugggcaucccugucuagucccucauuuuagugggauugcuucaaguuucucuccauuuaguuugauguuggguacuuguuugcuguagauugcuuuuauuauguuuagguaugggccuggaauuccugauauuuucaagacuuuuuaucguaaauggguguuggauuuuuucaaacgcuuucucagcaucuaagaagaugaucaugugguuuuugucuuugaguuuguuuauauaguggauuaccuugauggauuucccuauauugaacuugcaaucaguaucauaacguaauacuugauuucucaguguucacugcaguguuaaucacaacagacaaguuguagggggcuggagagaauggcuuaccaguugggaacacugacuuucggaguucuuucggagguccugaguccaauucccagcaaccacaugguggcucacaaccaucuguaaugguauccgaugcacucuucugguaugugucugaggccagcuacaguguacucauauaaauaaaaauaaacaaaucuuaaaaaaaaaaaaaaaaagacaaguuguagaaucgggcagauucccaaggcaugcaguggugcuaauggccucuucccauucucugccugaauagcgugucauaaugagcaccgggacccucuuacuuauuaucagucuuagugucugagccuggccugucgaguuuaucaaucuaacuugauagaagauaacauuuuaaaacuuugcauaugacauguuaauuauaccauugaaaguuuuuaaauaacaugaucagaaaauaccucauuuucagaagcuaauuaaaaauggcaguauaaaauuaaaauguucuuuaaaaacacugauggcaguauauauuuaguuaguagguaguauaaucauucuuucuugugaucguauuauuaaaucaugaauaaaaaggaaugccauggggagauauaauuacuuaguauguaugccuaugccucauauuucuaucagauauguguaguugaauacaaugcauuaguaaaaaauucaugacuaguaaugaaacaucuguuauuaugggacuaauacauuucuguguuucuucugagauaccaaauuaaaaugaaugccaucaauuuuauaugaacagucauugagacuuuaaaauacaucuuucagauauagcaugaugucuucauuccaacaagauaggcagugaacucuaaaacucauccauccuguaguuuuaguuacaguugcauuuuuauuucuguugacagagcucauccuucaacgggauuaaguguagcaacagaagucaggcaaaucacacugauguuuguguucagccaaggaucagcuuagugaauaucgacacagaaaagugcuagaauaagugugcaugagcaguccauggcugggucucuuacauauagcagugugaugucacagaacagauccauagugucaguagcgucuagauuuauauauaacuagguagguaggggaauugccuuuaugggacucauuuugaauuuccauaauguuauaauguuauauaucuauauauauaucaccaaguaaaacuuuuuguuaaauuuaucuuauaaacuuuaaauuuacuauagagauggcagaugcaauuuggcuucuuuacuacucgauuuaaaaaagcuauucuuuacauccuaaauacugaagaguauauauggucuauaguguacuaucauuucugaucacaaucuucaugagguagcagaugcucuauuucccuaacuuuauauuaagucauggaagagguaaaacacuuacuccuuuacaggucgaucaguccuguuauuaaaagaacauuucacuucacaacuaugcuacuuugagaauccuuguauguguguauauuguuccuguguguuucuuucaucucugagggcauagacguagagagcaguggacaaccucuggugguguuccacaggaccuguguauccacucaguucuguuuuguuuucauuugagacagggucucucacaggccuggacuguagagacucaggugccuuaucacugagccccagggaucuguguccucagcacaggguuauaaaugccacucacacuacguaugguuuguuuguuuuuugaacuggauucugggaaucaaacuugaguccgcaugcuuacucagcaaggacuuuacagacgaagcuaucucccuagcucuccauguggcuucuuguagaugucauccugguacuagacacuguggucuuuguaggauuuugggaguuuuuauuguagugauuuccuccaauaggccuuugguucugcuuuuuaaauacagauuuuaauguuggacgguuuuguaucccugcaaugcugugguuucuaagggaagcaggcacuggcuuuccugcuuuucagugccuacaaugaauugcuaugguguuucucagugagggcgccucucugaggcacuugacugucugacuuucaguaauggaaaccaucaaagccguagcuguccaucacuucccauguaaagcuaugggauguugaccuaccuuuguccaugacaacuacuccauuuauaaauauucuaccuguuucuggcaggauuggugggaggggaugaaacccuuuguauuugcugguuuucauuuacaggaaugauuuugauugacguuugaggauuguaucuggauuuuggugcauaauaugauacuuugccuuuuauaauuuccuguagcuaauuauuaacuguaaaauucugucuaaaacauuuuuuacucauucauauucaaugaaugaauugaauagcaauaaaaaagagaaaguacuauagauaaaaaggaaaugaaaaagcauuugcagaggcaucucucauggauuaugcauuuuauguaugcaugcuucuuugauuaaaggucuccuuagguaagcuacauuuuuuuuccccucacaauaaaacuccaaggcaauuuacacuuagucaugcuggggaaauugggugaauugcucaagauugcagaauaaagagcuuaauuuaucaucuguuaucuuuucagauuuaugucaaguuaugcaaauauuaccaaaguguaaaacuaauuaauugaauaccuucucaucaguuugaaucugaaauauuccugaaguaauuaagcauacacauguguuuauauacaugcauccuuguacuaugcacuguuuuggguaaaggaugugauauucuuagauauucuuucugcucucuacacuuacacuaccgaugccagacuauuaaauuaucuuuaauuuuguguuuucaucuggaaaagauuaaagaauaacaugaggguuaaaaaauacauuuauuauucuaucuaauuuguuucguuuguuggaucacuuccuuggagcaaucaucaaaguuuguuaagguaggcucauuacuauuccuaacugguacacuuaaucuugaguuagaauugagacauuagauuuuccaauccuugauuauccuguuguuuuauugggauugccuuauuuugugucuuugacuguaauggcuauucuugguugucaacauaacuaaaucuggaauaaacuacaauccagaaugggaaggcucaacugugauccagaucuugaugcugagagauauaaguuucugaccuggaucuuggcauggagaucuugagacauaauggcuaugaaucccaggagacuaaggcaagaagaacucugaguucaaggucagcccggaacaaaacaagucucagauccaggcguagugauacacaccuuuaaucuaguacacaccuucugcuggagaccuucauuaaggacauuggaagagggaagaugcacucuucuuugucugcucgcauuugccuggccagcacaucuguuuggaaucuacuagccugugggacugagccacuacuagauccuuggacuucccuuucacugcugaccauuguugggaguuggacuacaaacuauaagucaucauaacaaauucccuaacuauauagagacuauccauaaguucugugacuccagagaacccuggccaauauauugacauuuuaauuuacuuuuugaaugcagagagacaguguaaauaguuauguucugugcucaguucuagaaucuuccuuuaaauccauaaugaauuuccuuuuccaggagguuagcgccuaauuaaaagcagcuaaugagacaccagagaaagcugaaugaccauguucuuuugacaucuuugagucuguacuuucagaguuguaugccaauucugaccagauuggcacuguguuuugauagacuguucuuaggaaguagauuuaucuuccuaagauaguaucuuauaaugacaaaacacuuuuauuaaagcuaccuagggaggaaaggauuuauuuugcuuacacuuccauggcacuguucaucaucaaagaagucaggacaggaacuuaaauagggaaggaaccuggaggcaggagcuuaugcagagaacacagaggggugcugcuuacuggcuuacuccacaugccuugauuagcuuguauauguaucagcuauugcaguuuaguaacagguuuguaagaaugaauggucugauaauguucuuggauucuaaauuuauggaugaaacuuucuauuaauucuucuguaguaaacuuaguauauuuacuauuuccuguuagguucaugaaauaguaauuacuacaacaccauugagaugcaguauaauuuaccgggcuagaaaagcuuugaagucucccuuacugguuuaagcuuaucuuucuuugggauuauaauuucuuuaaaagcaugcaccauggggacauuagucagacaggcuaaguuugccuaucagcuuucucacauucaguaugccugggcuuagacaccuuaccuaaucugcuugagaaauuggauuuccuuuuucagaguuagaagcaauauucucugcaauauacaguuuuauaagaauucaggagauuuuugugauuauauaugugucuguauauauugcuuagcaugcuaccugcuacauaaugaggccuugauaauuauuaaccacuaaguaauaacagguuuugcccuguuggagcuuugguuauaagauauguugcuuaacauaaguaauuuguuuucauauuugaaaaguagcaaauacucaacuucuguacuuugaaauauacucaacuaagguaucuuauauuuuacuaguuuuuauuuggcucuaaauuaccaguaucuaguuugccuugaugauuaguuuaacuguaggcaaaucagugguugaaaucuaacccaguuccuuuccugcugucugguauuucaaauuuuaccaguuucaaguuuguaaacaagcaaccuuguuuuucuuacuuuucuaaaacugugugugcuuaauuccuuuucacguuucuauccauguguaccaaacucaaaugucaguucccauuuacuuaggaaaaugucacacaaaucauuaguucugucuugucaugagaaaucauuaccuaugcaaagaguauaagcucugccgguagcaaguacugaggaaugaacccugacucucaagaaaacccaucagcaugaggaacauuuaaacuuugggaucagggauaacucaguccuuauuuaguguauuaagugacaaaugaaaguauuagguucacuuagauuauuuuuagaaauuuuacuggaauuugugaaacaaaucuguguaauuaucauuauuaaaauauuaaauacuggccaccauaguggaguauuuggcauuggaggaaauuuaaauuucagauagacauauaaacuaugcaaggacaaaaauauuuaagguugauagaauguauuguauucugaccaucauuucagauuaaggaaguaucauaugccuaugaauuauuaaguaucaauauguauguucagagauagagguagguuuucaugcuuuguuuucaagggaccucuugauuuaugcaaagaacuuuuccauuuuucuggccuuccuauauauauaacaaaaucaugucuguaaaguauuuaaacacauggaaggucuuuccuuuuuuuuuuuuuuuuucuuuuuuuucuuucuccacacuggcuaaaagugauagguagguaguuguaguuacaaaagagaagcugaaaauccugugaaaguuggagagcagauguauguugugcucugugcagacaugcuucuuuagcugaagcacacgcacacugagauuucaggccucucugccaagucugcugaugcuagaguguuucucucugcuauaaaucgaucccaucucauaggcaucuguuuacaaaacucagggcauacagguagucucccugugacuaagacguuccagaaugcauccccaauccuauagcagacugacuguagcaacaugucuucccucuuuuccucuauuccucuauucccugagaacuccacagauucucuuuccugacccaguuauuuucccuucucuuucccaacccaguuauuuuuccuucugugaacccccacagcaccacucuucuagcucaucuuuauucuugucagcuucuaaaacccagaaagaaguucugacuuggaccaacagcuccuauaccuuggaaggacucagcacuccauaacaagcagccuauaaccaguacauuuucuaagauacagagagggcaacagaaaccaaggaauggaaaauccacucaacagagcuaagaccugauaaucaguuccucaaauuauaagcaucccaaaccuagauacuuagacaccaacauaaagcauaggacaauauguauuuccucuaguacaauaucccugaguauuucaacauaggugaaacaaaagacaagggcuucacaauagccuuuauaaaaauguucaaggaccuuaaagauuauaggaaugaagccauuuaaugaaaucuaugaaagcacaaacauuggaauaaaaugaagaaaaagguucaaaaccuaaaaguggaaauuaaaucgcuaaagaaagcucuaaaugagguaaaacuagaaaugaauaauuuagggagcaaaauaaaaucucagagacaauuuucaacaacagaauauaaaagauaaaagagagaauaucaggcauugaagauagaagagauggauaccuugguuaaagaaaauguuaaauuaaaaaaaaaucuaagcacaaaacaucaaggaaauaagagacacuaugaaaagacuaaaucuaagaauaauaggauuagaggaaggagaagaaagccaaguaaaagguacagaaaauauuuucaacaaaauugaagaugaaaauuucucuaacuaaauggagaugccuaucaagguacgagaugcauacagaauaacugauaaacuggacaagaaaagaaaguuaccacaacacaauaaucaaaacuaaacauaaagaaaaauaaaaauuuaaaagcuagagagagagagagagagagagagagagaaacaaguagcauacaaaacuagaccuauacuaaagcaccacaaaugcuagcccagacuucuauacccagcagaaguuucaaccacuagauggagaaaaacauuccagaacaacccaaaauuaagcaguaguaaucuacaaauccagcuauacagaagacaccagaaggaaaacuucaaccugaggaaauuaacaucaugcaagaaaauacaagaaauaacuaaucgcagaccagugaaucaaagggacugaaggaaagucguaucacagcaaaauaauaugaaucaacaaacauugcaguguuaucucucaaggucaaugaucucauuuccucaaucaaaagacauagucuaacaaauuguauuagaaaauaggauacaucuugccucauggaaacaagauacacauuuccucagagugaaugaauauuucaagcuaaacuaaucaagaagcaagccaguguauucaucuuaauagcugacaaaauagacuucaaaauuaaucagaagagacuggaaagggcauuauauauucagauaugguacaggagagguggcugagaguuauauagucagaucugcaggcagcaggaaaagagauggagugugcaaagccuagcccugugaccccacuuuagauucugcacaccauauccaacaaucaaacaaaaggaaauccaaggaagaucaaaugauguggguuuuuauugaguauauuaguaccauucccucgcaaguggccuguuuuguuguuaguuguuugcuuuuuuuuuuuuuuuuuggcuuuucgagacaggguuucucuguauaucccuggcuguccuagaacucacuuuguagaccaggcuggccucgaacucagaaauccaccugccucugccucccgagugcugggauuaaaggcgugcgccaccacgcccggcuaguuguuugcuuuuuuauacauccccccaaaagauggacagaguuucuuguugacuucuuauucuaucagauggaguuuuauucuagcuguaugcuugggugacuguuuugugugaaucuuaaauguucuuucucacuguauaaauguccuauguguaguuucccuuuucaggcaagaucauuggccagcuaaaugugcucauggguguaccuuuguucuauguuugcuuuuuacaaagagccaaugacugacuugcuuuucaguugaugucaucuuggcucagaaggggacuuugacuaugccaguguagguguaccauauucagcaaugaguauuuucaucccaugaauucuuuuagaucaguuguucucaaccuuccuaauucugcaacccuuuaauacaguuccucauguuguggugaccccaaccauaaaauuauuuuauugcuacuuuguaacuguaauuuugcugcuguuaugaauaguaauguaaauaucugaugugcaaaucccccaaagggucaugacccacaaguugagaaccacuguuuuaaaugaucagaucuuucuucuucucucauauauuaugucccaacuggaguuuucccuucuuuuucuccucccagucacuccuccaccucuuccccagauccauuccuuuuagaaaaggggaggcuccccagggauaucaaccaaauugguauaucaggaaccucucuauugccugagcuuuuguccccgcuggcaagaacacacucaggacaaccggaaucuucugcggcaaaacuuuuauugcuuacuuaucaggagggaagaccccgaacugggaaaauggcgcugcuuauauagccugcagcgugacguuucagcaccugauguggcgugauagcuccugauuuguugcuugcccaucaccccauuacuacgcugcgagaugggcagugacuaggcgugaguucacucuugcacugugcauaaggcuuguuuacuaguuaggcacagugaaagccagcgccaucuuauaauggcgauugcucacggcacggcucuccacaccucuccucauauuaaggguggauaagguaacucaguauaaggaaaagugucccauagacaggaaaaagauucggagaaagcucccauuuccacuguuaagagucccacaagaaugccaagcuacacauccauaacacauauccagaagacagaggucaggcccaugaagccuccccgauugucaguucugucugagaguucugaugaguugauucugugaguuuucuuguuguguccaugaccccugucuucuauaaugcuucguuccucucuucuagauccugagaucugccuacaucuguuuggaugugggucuuaccugcucccaucaguuucaggaugaagcucucucaugccaacuuauacugugauuugagccuaccaguaaagcaaauaucauuaggcaucauuucauuggcuuauuuuguuuguuuuuuuccagucauguuugguuguguccuaaguuucugggcuauccagccucugguuccuggcucuccaggcagugucaggcuaagguuccuucucagagcauggaucucaagcuggaccagucuuugguuggccacucccaugaguucuucucuaccuuuagcccaucacauuuuacaggcaggagaaauuguuaagucaaauguuuugagaaugggugggucucccaauccuuccacuagaagccuugccuggcuucagaagauuguugguucaggcucucucucccucauuaccaggagucuuugcuagagucacccucauagauuucuuggaaauucucuuacacuagguuucuaccuccccugguuccuauugucuuucucagaacucugucccuccagccuccccuccaccaagucucuccuguuugcaugccauccugcccuccauccacccaugcaguuuuucuauuuccccuucccuggagauucauguguuuccccuuaugcccuuuguuuuuacuuagccucucuggaucuguggauuguagugugauuauuuuacagcuaauaucuacuuacaagacaguacaaaccauguuugucuuucuggaucugauuuaucucuguaaggaugaguucuucuaguuccaucuauuugccugcacauuucauguuguuauuuuuuaauagcaugguaauauuccauggaaaaauguuccucuugaauuuuauugcuuacuuuuuucuuauugacuauuaauauguucaucuaaaauauuuacauuuauuuacucuuuuuugguggagaugauuuucuuuuccaccuucuuuuuuaaaaaaugguuuuuauugguuauuuuauuuauuuacauucuaaauguuaucccccuucccuguuugcccuccuuuacuuuaaaguaaggagagauuuuuuuucccagaaaaauaauguacaauauuuauuuucauaccuuuuuuccucuucuuugauauuuuggauucuugacuguugugguaccaucguuacguuacuuaagucuuagggaagacagcacuuuguuaguguaucauuuuaugaacuacagcaguauguauuacaacuuuaauagcaccaaugcuaaaauucuguuacccuguacauaaaaauauuaauuuuuccaaaguaaaauaucauuauucuuauuguccuguuuauugguuguauguaguuuuauauaaauucuuuuuauauaugcuuacucugacgggguggguuuguaaacuuucugaucauucauaucuguacaguacagauaggacuuuuuauauuuucuuaauuucuauucuuguucccucccucccucccucccucccucccucccucccucccucccucccucccucucucccucucucccucccucccucccucccucauauaaugcuaaagguuaaauucagagccuugcucauguuaggcaaacauuuuuauuccaauagcccucacuaucuguauaauuauauuuauuuuacaaauuuuauuuuguuuacuugaauauauucaucucuuucaagacuuuuauacuuuaacaaaaaaguuauuucuucucuagaaaaauaauguagauuauuuauuuuuguuucauuauaugucuuaagguuaagauuuguggaucacuuuuucagauuaauuuugcaauuaaagaaccaaaaacaagucuuaaccuuauuuuuuucuuagaaguccugauaauagaaaugaauaaaauuuguuugguauuuuaaaauaagcauauucuacuuuuaucaaaaaugcagugaaauacuuuaacuuuuuguuaaauauuuuuuguuucccagauuauugcucaguuguaacaauuguggaccagacaaaugugaaguuaaccuguaugcucuuuaguggaaacuaugaagcccuccccaucauuuauaaaguuggagacauuguucgcuuccacaggcugaagguauaauucauccuuucugcaaccuacauucuuagacaagaaggcugcauuguucacuaacagcaguuaguacuaauuauauggcugccuuguuaaaaugugacacuaagcauuuaaagagauaaaaaauguaaauaguaucaggcuucauuaguagcuagauuccuuuucauuuaaauaaauugcauguccucuuuuccuauacuuguauuagaagccacgguuccaacugguuccaauuuguccuguuauuuccaaauauguuugauguucucaaguuuccauguauaguuugcaaaggauaggauacauccuuguaacuuacuuuugauuaauuuaauuuuauuuaauaugggguucuuauguuggugcucugacgggcuugagacugcuaaaguacaaguuguauaauucugguaagcugagggagggaagacuaaaacucuucccagccaaaagaacuugacucucucuagagagaaaaagggauacaguggcauccagaagucugcugggcuuagguaauuugucccagaauacaacugaaaacuguaccguacaggccacgcacgaucacuuaaggauucuaagaaccucuggguuaggagaauuaaauuugaauaggaaacagagaugcagcaguagagauacuggaggucuagucuggucaaggaugacuaaugaucuaccucuuuaacacggucuuguucuuccuuauuauugugacaggcacagcuuauaaaagggcaguccauuugggcucauucucacgguagacaggcuggcaguggugugucucagguggcugccagaauaagaagcaggagaaaauaaauguaggcagguggucaguaccuaguacuagcguggaggcucuguguuccguagucaccacaacccaugcuaccccaggagccuguagugagccuuucacaaaaaucauaacuaguccuuuguacaagucugauaagaccccacaaagcccucccuuaucucacgaagggcagacuucuagaagaaggcuucuuguauucauauucugucaagaacuacaaguccuacuaagauugcagggugagucucacuaaggcagagggcuugggggacaagagagcauaaauucagucuuuugucaguuuuaguguucagcuagcaacuugcugaaaggaagagaacucuguccauaggaggaggcagccuucagaaccuucgagguguugcucucuaguuccuagucaucaagaacagaaugcuuaccaugagaauaagugcuuacuaccaacagcuagaagaagaaaguuuuuaaaaaguaaauggacucugcauuccauggggucucagacauugagucucuuaaacaguuuuacaguagcuauucuaaguuuuauuuuuuaaaaaauuaaaguauguucagcaaauuuaaauguuaaacaaguaaaaauauaucaacagucaaaacagagaaauagaaacugaacaagaaaccaaagagaucuaaaaagaacuaaaucuaaaaggaacaacaaaugaaaaaucucuacgguccgcauuaauaaggauuacugacugaagguagaaacagugaugcuaccaggcauaaagacauaguagauagaaacaaauagaccauaaugacauuugcagcaguaucucauaauguaauguguagcuuaaaguucaggagaaaagaaaaugaaagggggaaauaugcuuaagacagugagacaacucuuaaaagguuaaugggugggggcaacauugaaaagcuccagccagcuuaaaaucagcuggaauaggaauugcacacugcauauaggcaacaauagcaaugaucucugguaaagaucgaugcaccuagacugaaggacucuucaguagcaugggcccuuuccaacuagaaauugguuaagaacuugcaaaacuauuugacuguaaguaaguguguacgguuuuugaccuaucugaauaauuucacuaagagguacaugccuuaagcaaaagcagucgguuuguacaaaccaguauccacgggacagaugggaugauuagguggaauuacagcucugaccagucaagcuugugcaguacagaguacguagagggaggugggaaguuaacagggagugucuagugcaacaguagugauucuguacacacugugaugccgagaaccuauucauaccuaagaaaguaagugaagcaucaagaauacagauguggggaauaaaagaacaauagaaaccacauguuuaaaacacaagagugaggaagagaaguaaaacagugaggugguagaggagacuuacacauaaccauaauuuuauauaggcuugacuacuaccaaaaauauaaguucaauaaauaucaagagccaaauauaugcugccuacaaauuucauuuuaaauaugaaaacagaugcaaauugaucaaguauaggaaaaauucuuuuaucaagcaaccagaaaaugaaauaacuacuuuguuuucagucauagaauauuaccagagcuuuuaaaguauauggaaguauuuccuaugagcaagugaguucaugaaggaaauauuaauacuauguauuuucuagguguacauuuguaaaggagcccacagacuuacacagagaaaguccucacaacgugguucagcguauucagucaucaagaugccuuagccucuguugugugcauuacuucacauguuugugucuucaggguuuugcuaugccacauaaauaacuaucacacuauuccuucaccuuaucaaaaauuauaguuaaacucauacauggaacaaugcaaguuuaauaggauuuggauacuauuuuucuaaaguauaaauuuuucuuaauguuuuaaauuuugcaugguuguguauuuugacauuaucaauugauuauauugcuucaugagcuaauucaauggauaaaaaauacucuguuacuuauaccagaaaaauguauguaauuuccggugucucuguuuccugaguuuuauucauuuucuucuuugucccacuuucuuagauccaaguguauaaaaaugagcuucagggaaucaacugcucuggcuucgccucuuugacauuugaagggacuguagggaugccugucacagcacgcacuuccagcaaaguuuuuagcuucacuccucaggaccaaaaaaugguagaagcuuugcggguuugggcauccaagcacaucucggcgucuucaacuuuagugcagcugugcgaugcgcagcccaugcaguauuacgaccugaccugucagcuccuggguaaagcacaaguggauuccacagcauuucuucuaaaggugugccuuaaguacgcgaaaucaugcuuuagugccaccuggcugccuuuaaggagccgguagcauucugagaguguuuguagacugcuuuucauacugaauuuaacugaauguauuguugcugcgacacccccccccccuuuuacauaguuguacuccugcauuuuccugugcuuuccuucagagaaaaauaguaucaucaaguaugaauuucaggaagagucugacacucacuucuuuuaauaauaaugaguuacagaacaaugacacuuuuguguuaggauuucugcugcuuuguaaagucaauucuaggucggacaguggugccacucgccuuuaaucccugcacuugggagacagaggcagagaggcagagaggcagagaggcagagaggcagagaggcagaggcagagaggcagaggcagaggaggcagaggcagaggaggcagaggcaggcagauuucugaguuugugccugccugguuuacagagugaguuccaggacagccagggcuauacagaaaaauccuguuucaaaaacagacaaagaacacaaaacaaaauaaaaaaauccacaaccaaagaaacaaaaaacaaaauuagaaaagaaaaagucaccucuauuguuauccauuaacuuccuuucuuuuauuuuuucaauuuuuauuagauuuuuuuuucauuuacauuucaaaugcuauuacgaaaguccccuauacccuacccacccacuccggcuucuuggcccuggcguuccccuguacuggggcauauaaaguuugcaagacuaaggggccucucuucccaaugauggccuacuuuguccccaugucuuucacugccugguucaugggaaugggcguaaauaaccuuaaaauguuuguugguaucuuuguuuuguuuuuaaaucagcaaggaaaaaaaaaugcagucccauaaacacuauguaaucuucauuuacuccuacaccacggaaaaaccuagggaagguaguuacuuaaucuuucuccuugcuugccuguaugauagaggggguuuagcagcaccuccuuggcugagauccuuguuuaauucucuguugucucuauuuggaauaauuagaugagaaauacaguaccauaguccuuagacaagacagggacuagcauugcgguuacugcugggacauuuuaaaggaacagugaaaauagaaaucacugaauaaaauaaaauaccauguuuuugaaguugacagcuuuauaugaacaaagcauagaaauaaaaucuuauuauaaagaaaguuaaaugcaucaaguaaauaaagcugaaccagccgggcgugguggugcacgccuuuaaucccagcacucaggaggcagagacaggcagauuucugaguuugaggucagccuggucuacagagugaguuccaggacagccagggcuacacagagaaacccugucucaaaaauaaauaaauaaauaaaguaaaauaaagcuaaaccaaacaaacauaaagucaucuacaguuagaaagaaucuuaaauaaaucacuuauguucccuaggcaauguguuaaggacauugccauuuauuaaacauugaacauuacuaagaacgaaaacacuggcucuuugcagagagcaccuguuacuacucuguagcugauacagucaaaaaugcauauuuuuuuucuaaagaacuaauauaugccuguagcccauuuuaguagauaauccauuaucugaugggccaaccuugggggaaagguuuauuauauugucuuuuuaguuguacucuuugagaauuucaugaauguauacaauaaaauauuauauccaccucccauuucucccuuuaucccucauccauccccacagagcaucucauucacacuuuccugccuuuuccuguccguuguuguuuuuguuugguuuacaguaacucguuaagaucguuuaguuuugccaguauauccuugaaugugaguccauucacugggacauagaaaacccaccaaugaucgcauucccaaagagaaugauccuuccuccuccagaagcuauugacugcaagugucaggggcugcaauguacuaagcuccucucacuccaugcuugaacauuagcgguucuuaauaagaucaaggaguuuauuuuaaauucagcauugagaaauaaauauaagaaaauuagcacagcucucuugaggauagcuuaauaugucuaaaaaucuuuguaaaucauuuaaaguuguuuucaugaauuucucauuuuaaguguaugaaaaaauauacuugaaauaauaguuuaccuuauauuuagucaacaccuggaaagaaaaaaauacuguaguaauugacuguguaaacuauuuuuguaggcuagaauguucuaggacucuacagugcaacuguagacuuaaacuuccuaaaagagacuuuaguaguagucuguguaguaauauaucuacaucuguaugccgagcgugugcuuaagguagggacacuagucugcgaagaaugaauggcagucuuugcucuuaacuacuuugagggacuagaauaaugacugauuuucuuauucaucaaaaauaacuuuaaaucaaauauuaaagacaggaaaauagacauuauucuaaguuacacuugcuaguaugcaauguaaucuuuuccuuucaguccuaguacaaucguaaucuuggucccuuuuuuaguacucgauuucagguuuauuuaguaguucuguauuguaguaucauuuccguugcuuugauaagacaccuuaacccaaaauaacuuagggcagggaagagcaauuugacauauaccuacccucacaguccagagggaagucaggaagggcccucaagcaagaaguaaacacaucaugcuccaggccgcacugucucuagauguagcacccgugcacagcccaggacgugcagcagaagucaggaaggaugguaguuguuugcuggcuuauggagucgcucauacucaguuagcuuucuuacgugguucaggacagcauuccuaagaaugauguugcuuucuguggacagggccuuccugccucaaucaacaguuaaaagccaaucccccacagucacguacacaagccagucugaucuaggcuuuauuuuuaauuaucuguauaaggguauguguacguuuauacagaugucugguaaggccaggaaagugucuuagauccccuaaagauggaguuacagucggauguaagaugccugacauugguggaggaaaugaaacuaauaucuucuaugacagcuacaugcauuauuaguugugaccaucuuuccugcccucaaaaaaucuuuaaacaaagcauuaucccacuguuucucuauuacucuguucauacaauguagaugcaaaaaaauaauuuuaaguucaaauuucuuuaaacagcuucugacuucuucauauucaguuugaagcagguauaaucugauuauuuuaauguuuuucccuuaguuugccuuauaucuuuguuuuuucuaauaaccagaagccauacauacucagagcugauggguauaguggaggagauaaagagagggagaggagaguagggggagcaggggugugguauuggagaacagaaccaaagcccacagcuaguuaauauuuuauuugguaucauacagugacuuuuucguuuuuguaucugcacauuuuucugcuuaucaccaguaguucauaauuaccccucuuacagucacagauggcuauacacgguuuuaagguacuggauacucaacaacauacagcgauucauuuuacgcuugccucacucacugccuuuggauaaagagcacuaagcuuugcuuuacuuuccacggcagguaugggauggaacccagacugugcuucccuccuggagagucuccacacaagaucuaacuuuugaaggugacuugagucacaucgaacggcuacagagucuggugguagacauucuagucuacgauaaccacguucaaguggcgagauccaucgaggugauguuaaguagacagaugcuuauuauuuuguuuuuauauccuuuuuaguuuuguauaugucugucaguaauauuugguguauagaaauuaacuucagauuuauuuaucuucaagauuuaacuuauaaaaugaauaucuaaauuaaauuuaaaaacuuugaauaugauacacacacauuuuaaaauuuuuuuacuuguggauauaauugcaugauuaacucuucucuucuccuuccaaccgcuuucauguacucccuauuccuugcugccuuuaaaauuacauggccuuuucugcuuuguguguguguguguguguguguguguauuuucuaaauauaaaaacaguaucuguuccauccuuauaaauguuucuugcauauauguuuucagaguugccuuuugguauuugucuuaggguuucuguugcugggaagaacacagugaccauggcaacucuuacaaaguaaaacaucucauugggaguggguuuaagguucagagguuuagccuauuaucaauauggcagaaagcaugggggcucugaaggggcuuggaaggagccaagauuucugugucuggaucagcaggcagcaagaagagugagccucuaggccuggcuucugaaaccucccuccagugacacccuuccuccccacaaggucacuccuacuccaacaaggcuacaccuccuaauagugccacgcccuaugggccuauaugggcuuuuuucauucaaacagcaauauuucacucccaggcccccauaggcuuauagucauaucauaaugcagaagugcauucaauccagcguuaaaagaccccauagucuaucacacucucaaccccauuuaaaguucagagugucuucugagacucauggaaggcuaaacaauuaaucaucuauaaauucaaaagcaaaaaggaaauuauauacuuccaacauacuauggcacggaauagauauuaccaacacagaagaaagagaacauaaugaagaaauacuauaccaaagcaagacugaaaacaaacucugaacuuuauuccuugucugaugucaaagcacucuucaaaucuccagcuccuuucagcuuuguugauugcagccacuuuacucuccuaggugucuuugacucccuguuggcuacccuccuuaucagguaucacugcucugguaucuucagcaucugguggucuccaagacaguccagacuucacuuucaaaguuucacacaguagccuuguaugccucugugcagggacaccugugguguaugccugucucagcagcuuuccugagcuauagagaggauaugucacaacuccagucuucuuuccuggucuaaagcugccaggagcugcugcuugcugggacugaaacauggcucccucacugcauuguaucuucagcaguuuucuguuuuaugauuuccuccacugccuaagcguggcugucauggagcucacuugguagaccagauucugccuugcaagugcugggaucgaaggugugcauuacugugccuggccauaagcuuuucuuuaauccuuuuaguuaguugauagcucuuccauuuagccuuaugcagauuuuuuuuagacaagagcagaaaguagucacauucuucaccaaaauaucagaagaaugaucucuaggcccuauaugaauauuauccuccccugggcuggguccccacaguucaaaucaccuacaccaccccgucuuccauguuccugcuaguauugccuguuaagcuacacuuaaagcauuuuaccacuuuccuaacccaaaguuccaaagucuacauuccuggaaauaaaaucaugguuugccuuaucacaacaaucccuuaguccccgguaccaacaucugucuuacagaguuucuguugcugugaagagacaauauggcuaugucaaaucuuauaaaggaaaauauuucauuggaguuggcuuacaaguucagagaauuaauucauuauuaucauggaagaaagcauguugcuacacaggcaggcauauguuggagaagucgcugagaguucuaugucgggagcaucagguagcaggaagagaguaugagccacuggacugacuauagcuucuaaaaccucaaagccacccauagugacacauuuccuuuaagaaggccauaacuauuccagcaauaccacaccuccuaaauagugccacucccuaugggacuauauggaucauuuucauucaaaccagcacaguauuagauaaccaguggaugccuucuucccuguggaagacuguuucuccugcuauccgaauuccuugguugucuguagaucuuccucugacuuucagaccuugucaacuuacuuuuuccauguuagcaugccuauugauaucauccugguugagaccauacuuugcaagccuugcuggcaugacuuuauggguuuuuagacaagagcagaaaguagucacauucuucaccaauauugcuaggaaacacaaucucauagcaaccuuccugugucucuggcacuuaugucuucauacccugguuuugaaauggugccugagcuucagguuuuaaccauuagaaagccaucucuaaagcaguaugcaucuccaacauaauaauaaugacaaauuauuuuauuuaaguggguagcaucuggacaacauguauauguaaaucugcuaauacuauuuuuucauuuguaauguccacuuguaauuugcuuagaggacuagaagcaaugggaauaugugaauuuucaucauuccuuaauuuguaugaagcaaaauauuuuguauuguuaaaguuuucaaguuauuuuaggaaacaaaauuucacauucaauaaaggaaauaucuucaggccacauauuuuguuuagaagcuccuugaauucuuuuuugcucaucuguuuuuccaaaaauagauuuugaguuauugauagcugccggagcaaagucugauuaucugaaagcagagucugcagcaucugcucuggguccugccagguuccagacagccaggaagaagucucuauuccugcaugguuguggggaaguacacacugcggucccagucaucacaggucccuguguccagcagacauuggacauugaccucacaggucugucccagugaagucaagaagcucugugauaggcacaugacuaagguucuaacuccaguuccagcucucuaacuucauuucuuaaaacguucugaauuguuuugauagaguguagacauggacuaugucuuaaguauuauaccaccucuagcauacacaguuaauuugaauguuucguauauuguauagaccuuucuuacuguccauagaaauuuggcacuuuuucguaaaaauuuauauucauaaaugguagagaauacuuuuuguuaauuuuuaccuauauauuuuuaaauucuccuguaguagauaacacuaucgugaaugacaauaugcagaguggcuuggauauugucucaagagagaagagcugcuggcuucauuccauuuuaugugacaaaguaaggcauucacaagaucaagccgcagugucuuuuuccaggguuaguaaacauugaaaggaaaugaucuuagcuguagaucauuucaaucuauccauaaaacaaggagaaaacacagaaauaaaaccguaugcgugcagcccagugcugcuguugccuuuuguuaaacaaaugugcuagagcagaaaacccuggcacucucauacugcguuacagagugucuuuagcucacucagaucaguaaacagcgugaagggcagggccagggcuugugacugugucgucuuaucuuuuagacacgaguaugugcgugcaggcaccccuggacuugggaaaaauacuuuugaagauagacuuuugaauuuuucucugaagauucugucuacacagauugacucucuuuggaaacagugauaaccaucggucucaauuugaaaguuuucaugauacgcaggaaggguugguucuuuagugaggagagagggugugcacuuuuacucagcgccauugucugcuuugaucuuuggaucauuugaaaucacuucgcuuucccugugcuccugccuuagcuccacauguuccucugccugccccgcuugcuucucuuccuuaaaucucaacuggcucauugcaaaggcucuccggggagggcagggaggauuaaagaccaucugcugguuaagcaguccaacaguauuguaaauggguuuuuagucaugaugucguauccucugcauguauccucugcaugguccacuagagggugaugugagcaugcauaaguaaggaaauugauggcucgucuuuucucucacggacaucaucgcacuguagccuuugcagggcuguaucaggaugcaaaggcuucucugggugugauauaacuauguaaucuuccuugggacaaguuuuauucauuuucucacaagucaaucagaagucuucagucaugugucauugauguggauaccuuauugucggcaucucaagacagauguucacagcagcaugcaugggauaauuucauaacuuguaucggagcaggaaaagugcuuuuaauaaugacuuuguuaggaagcaugauaucgaccuccauaaacagugcgcucuuaccaugcuacaauucuuacaacagcauaaaacauauguagucauaucacacuuugucauuuaguggccuauuaauuauaguuagcuauaggagaaaauaaaaccauugcacuguaccuacuuuuucagcaaaaauuggaggauacucuuuuauacuggcauugugauuucuuucuaguuauauauuguaggugcuuaucuacuuauuaaauaaaccuuuguuccagaguaggcuacaccuuuauguuuuuuauuguaauucuuuagcuuguaaauucggggaaaauguuguaacaagauuaaacaauuuuuuaacauaauagaucauccgacacauuucauaaucuuuagucaagcuauagaacgauccagugcugccuccagaaggcguuuguaauaauaacaguuugucgugcugacucuugggaucuguuuagagaaguaggcgcagucuguacauguugaaugccgcugcaguguagugaggaagacggaauaaguagcacacugcccauucccauucucuccugaagaguuugccacagucguuccccauagagcugcacgugugaccuucuuaagccccugcugagcucagucucuguaguucagguucccugucuuucucuagcaaguagcugugcucaguguccuccuuagaguguucauucuacuuccgccuugccccacguccugcucuucggaaugaucguggcuuuuaucuuccauacacauuuuuggaauauguagaugucggaugucauggaagaccccgaaguauccggcugaaacuccuuuaaguuuaaauuuuaauaucaaugaaauuguguuucagauagcuuagcaaauguagaucauuucccugugucucagcuuuuauucuaguccuuugaagguuaucaacaucugugcuauaauaaugcuguacuaauaaauaaauaaaaagacagaugugauaaacauucuaaaacacuugcaaaguagccauuuuaauaucuauuauucuaguaucucacuuuagaguccacagaaaaguacauauuucucuugaguuuuuacaaauuuuccccaaaccucugauuugccuuuuccacgucugauguagaagaagcagguaaaggcauguggggaagguaggcgggaucccuccuccugccuacccucuucagaacauccaccaggacggagaagaaacgacuguggaggggaaagagucgugcugggaguguggcugcuucuugcucacuuccucucuccugccuuugcuccaauaguucuaaagauuaacaaggaggguuagagugcaauccucacucacuugcuuacccuucucuuucucucuccuuuccccucccuaccucccucucucccgcaaccccauuucgaccccacccuuugaugcuuguuuucuaauguugucacaacuguacugaguuuguggggaaaaggagauagaugacuucucaucacauacucaggaauacuguuuauaugcaaagaaauugaauuuccucuuauucauuccuuuuugcucauaagacuacauaaaaauauaugcaguuuauauuuuguaguuaguuugucccuuuggguagaugugaaugucuugguuuuauuuauuuuauuaaaaugggguugccugggcuguguuugaaaaugcaggcacaaauugccuuucccccauagcugauacuagaagcaauacaacagcacuuggucuuauuagugucuuugaauacccuaauauguuuucuuauuugaauucuucauugagaaaaaucuucaguucucuaguuaaagaggauuugacuaaauuuagaaaaauagcugacaaugacgaagacuaguuaguucaaaauuccauauuugaguucacauaauguguuuuacacgguugugauaaacauacaacugcuuaccaaaauuugacuuucuauagaauuugugcuuuauggaaaagcauaugguggcacagacauacauauaauaccagcagucagagggcucacgagcauuucucugccuagcaggaaaacuaacuugugaaauuaagucuauuauguuauuuugaugaaacuacaugauuaaucuuuuuuucuaaugugucauaguaagggcauuuuaugucacauuuuuaauauuauuucagacuaguucaaacaaguucuuuuccaaauauuaucaaauagaauuucauuuuaaucuuaacuaccuucacuauauuuuacugggggaccucugaaaugggccugcuuauguuguguaauauguacaggcuucauauccacguagcugauauuagucacagugcaguccugcauccaguguugucucugcuuggacaggucccugguuguuauguccuugguuauugccuccuguugauugugaaauuuucaaaugucagaaauuguuuaauuaaucccuuuuauucuaaaaugagauuucuaaaugaucuuuuuguagguuggaugcuuucuaagacucuauagccuccauacaaaacuucagccuggaaauucagaaaccagcaguucugaaucauuaaggcuggaguuccaucuccacggagggaccaguuauggucggggcauuaggguuuugccagauacaagcccuuguguggaucagcugaaaaagugaguauuuuauaucccuuuuugaaaaacauaacuuagaucuuuauuagguuacuuugcaagccuguuccucagguuggguaaggccuuguuugcuuguuuuuccucauugucuugcugaaaaaaucaaagccacacuuucaccuguuaggcagauuauaccacggaacuauauuccuaucucuaccucuguugucuuuaaguguuuucauacaauauauuuugaucauauucuuuucccuaacuacucccguauuuguccccacauuccugucuacccaacuucauguucucguuuucucucucucugucucucucucucucugucugucucucucucucucuuuaucucuagaaaaaaggacaaaucaaaacauauaaaauaaauagaaaguuaacaaugcaaaaaaaauaacaaaacauacacugcacaaaacaacagcagcaacaaaacaaagucuguugugcuaggcucugaacaauauaggaccuguccuagagcuguugauauaccaugggaaacuccaucggugaaaacugauuuucccuuuucuaucagguauaguuaaaauuaacuucuugguuagggaagggcuuucuguccacuuccccuuuucagagcugggacuuacucugcuuugaaccuguguaugucaugugcaugcuaugacagucucugugagugcaugugaguaucaguccuuuugugucugaaagaagccuuucuuuagaaucaucaccaccucuugauuuugcuaucuuucugucuucucuccugcacuaaucccugaggcuguaaagaaacagugugauaaaggacauccuauuuaagcaugagugcucuaaagacucucaccuccuugcaucuucuccacuuacagaucacuucauugacuaacaucaagugcaagaagcagcuucucugaggaggcugagugaugcucagucguaagcuuaguuuuuagaagugguuagcuacccucuaacaucugagccucuauugaucuggguuguauuguaggaggguuucuguuguagguuguacaguuuguaacugggggaaacugauuuuaauucugacccugauuauuucuuuuccacauccucuuuuguuuuucuagagcuuucaaguaugucuguauauuacuuauauuaaauuuauucaguuuuuuuuuuauauaggcaguuagugcuauaaacuuggcucuuagaacugcuuucauuauguucuauaacuuuaaauauguuguguuuucauuuucauacaaucauaaaauguuuuuaauuuucuuaccuauuuugagcuugacucaucaguaguuaguuguucaguuucauccauuaucggcauagugggaaggauggcagcauccaggcagauauaggcuagagaaggaccugaguguucuacaucuugauccaaagccagccugagggacccugucaucugcaaguagacaggagaggcucucuuuccacccagggcugauguugagcaguaggagaccucaaauccuaccuacauagugacacacauccuccaaaaaugaccacaacuauuccaacaaggccaccccuaauagugccacuucucaugggugaagcuuauuucaaccaccacauuccacuccuugcuacuuauuaaaacacauuacucuauggggaccauaccuagccauagcauaauguacaauacauuuaguccaacuugaaaagacuccauaguauauaauagucucaacaauguuaaaaguccaaaguucaaagucucuucugagauuaaugcaaucucuuaacugaaauccccuauacuucgaaaucacauaccuccaaaauaccauggcacaggaaauagguuaccauucuaaaaggucauaaugagcaaauacugaaccaaagcaagaccaaaaaccagcugggaaaacuccaaacuuuaucuccaugucugguguccaacucuuuucagcuuugcugacuacaacacacuguuuccuccuggacugguuccucucccuauuaguaucuuccucagcagguuuccuaaggcucuggcaucucuaacaucuugaguauccaaggcagcuuccacuucucagcuucuuguucuaaugucugggauccacacaugaucuucugggcuccuccaaagagcuugggucacuucuccaucucuacccucuguagcacucuaggcugacuauaauccacugacugcuguuauucauggucaucucaugguaugggcaucucccauacacuggggucuucugcugcaagugggcugcacuuucaccaauauccucuuauagguucucuucauggugcuaagccucaacaucuuugcauggccccuucaaucaguccugguccaucaauugcaacugaagcugcaccuucauuuuucuuagcuucuaauagugcuaagccucagcuacccucugugacccccacauaccuucaaaaccaguaccaccuugguaauuuuuacacauuagccaguccaaaugcagcaugagguacaacuuugguuaucuauggaacacagcuucuuugugcucucagaaaacacuucccagaagauuccaccucagugaugcuggugucuuuuuaaucacugcuaguuucuucgcuucagcuaaccagcaucaauugucccaguaaccccuuccacucuugacucuaaagccaaagccacguggccaaagcugccaaguucugcugcuugcuggggcuggaaaaugccaucccaccccccacccccauucuauuaucucaucaccagauugcuguuuuucaacuccuucaauugccuaagcuuggcugccccagaaguagcucuguagacugagauugaacucagcucugccugccucugccuccugaaugcugggauuaaaggcgugcgccaccaugccuggaccuaagcuuuucuguaucuguaacuugcucuguaccaggcuggccuugaacucagagaucugcuugcaucuuucuccugggauuaaaggcauguaccgccaggccuggacuuaagcuuuucauggccacugugccucaagaagcccuuggcguccagcuucaaagucuggaucacucaugugcccuccauuuucagauuguuguuuguuccagauauagucaaguugacaacugagaauacccaucauaauccguuccuuaccaguuuuacauaaaaucauaucuauauccuuauauccaaaugaaaauaauaaucgggucauaaaagggauaauugccuaucccuuguucaacugcaaacacauaaaugauaaacucaacugggugggaucuuuccccaaggucaccacuccuuuaauuccauuugauauccaugaacucaggauuuagcuccauuuuucuuccuugugccccuuuaauacuugaaccauacauuuuguuuuuccuuucuaagcuugcuaugcuugaucaaauugcuauucguaagaauauaccagagaacaaagucucugcugggguuuuuugagacuugcuuugucaaugcaauuaaucugaaucucuuuaccuuauacucaaguacacucuuuggacaagggcaaaaagcagccacacucuuuaccaaaauaucacaaaaauaauuucuaggcaacacaguaaaauucuccucagaaaccucuuaugccaggcccacagaguucaaaucaccuuuagcuccaaugucuuccccauucuuacuuggguggcccauuaaccccacacugcuuuccaaacccacagucuccaaacacacauucuuucaaauaaaaacauguucaggccuauguuaguuauaccucagucccugguaccaacuucucuuuuaguuaggguuuccauuguuggugaagagacaccgugaccaggcaacucuuauaaugaaaaacauuuaccuggggcuugcuuacagggugagagauuagugacugacagcagucaggcaaagcugagaguucuguauuguuaucugcagacauccagaggaggcucccucuccacacugggcgcagcuugagcauuaggagagcucaaggcccacccccacagagaaacgcuuccucuaauaaggcuacaccuauuccagcgaggccaaaccuaacauugccacuucccgugggccuagcauaucuaaaccaccauacaaaucuaucgauuucuucuaguuuguuuucaagaccugaaauucugucuucuuuaggcuuaccuaugaggguuuuuuuguuugacuuuaguuuuucauuuccauuuuuauuucauuuuggguuuucuuuauugauuuuauuucuuuguuaaagucuacuuucuuaucuuuaauuguuuucauuauuucauucaacuguuuguuauuuucauggucuucuuuuagaaacguauucauaaucccuuuuaaggucuuugacuguauuuauauuugcuauuuuuguucuuguuuucugcuuuggcuuaauugcuuuucucagggcugauuguaauugguuuaugggcuuauagaggagguguauugucuuguucuucacuccuggaucuuugcucugugacuugggcaucugcaguuaggcuguuuaagguguuucuugcuguggacaucugauuuucaauuuuugaaagacuuucuguucuuugauugcuucuacucaauuugggauuccuguuaacaagcuguucugguccuaggagagggaggcgguucugggaucaguggcagagaacugcucugcuggcuuggugggaaggcaggaaggaauugagauagacuagaaggaauggcugaaagaagugacuaggaauaauuauacucaagcaucuguaccaagguguugaacugaaagagggucugacagguaggccggagcuggacuaagguugguuauguguagagaggucagaauggaacacaggaagaagaaugaaggucuaccugaacuccaggcuaggguggcagucacuggucccugcaagaaagauuuucugcaggucaguggagucagaaagcaauguagauggauggaugccaagggaaggcugagaagggcuaaaucccagauuaaucuuacuuuuccaagcuucagugacaucauuauuacugauaauguucaccauuaaguucccaauuuuuuuauaauauuucaucaacugaguguucuuucuaucugucuaacccacugcugcugauugugaggguuuuagaggucucggauaaucugauaaaagcuauagacuauugauuagaaucauacugaaugauauaacuuaaugaacuggauuuuggggguauaguuaaguuuuccuguuaaauuugcuacacaauuugcuuuuauauucuuccauuuuagagcuuuagaaggugcaaauuugccagucacugagaccucaacugguaucugucaaucagaaaauggggacagcucugcacuaucaaguaaggacaauuuauaacgcugaucuuucacuuccucauaaguguaagcacacuuuccuuuucaguguuuucuuacaugggucucucuuuucaguucaucugacuauaauacaggguauaugugcauguucauuaaaguaacucauuaaacauauuuuuugucuuacaugggucucucuuuucaguucauccgacuauaauacaggguauaugugcauguucauuaaaguaacgcauuaaacauauuuuuugucuuacaugggucucucuuuucaguucauccgacuauaauacaggguauauguguauguucauuaaaguaacucauuaaacauauuuuuugucuuacauaggucucucuuuucaguucaucugacuauaauacaggguauauguguauguucauuaaaguaacucauuaaacauuuuuuuugucuuacaugggucucucuuuucaguucaucugacuauaauacaggguauaugugcauguucauuaaaguaacucauuaaacauuuauuuuguccuacacacuaucaagcuugguucacccuuaaauauauaaucauauuuuuaaauaaaagaauaauauuuacuugauuuuugauauguguauauaguguuuuguauucaugcacacaaaaacauuacaugaauucccuaagcaaccauuuccuugucaguuucuaaaaggaacaaaaggcauugguacucccuugucuuaauuagcccaaguugguuuuugcccaaaccuggcagucuaaugcauaagcaugagucaucuaaaucucucaaagacaaccuucuuguugaucuuaaugggauugcuuuuggauacaccaugugcugagauucaucuaugcuggaaccugugcccuugguucauuuccucaugcugagagaugugcugaugaguggauaugggguuagaagcacugucuguguccuuuccauguuuauguggcuuuaguaucuaccaaaacauccaguggcuauaaauacgcuuuugggggggucgaagguaucacuuaauugguuuauuuagacguauacaccaucuuucaguaauaauuccuaguagucacaaaaccauuucuuaaaagacaaaaacaccccccgcccccacccccccaaaaaaaauuaccaccaacaaaacaaaacaaaaacccuguguucucugugaauggccuucccuccuuugcuaacaauuaaaacauguguugauuucuaaacuuuccugguuugccuaacuuucuaucaauaccaaaguuccuugauugauauacuaaauucuaaauucucuauauuuucccucaaagaaagaagacaccuugccugucacauuuuuauaacuaagccuauuauuuuuguuaguaacaccugaauuugaggaaaggagacauaucaacauuuauuucggcuuucuuugauuucuuuggacaguguucuuuuuuaaguuuuacccuaaguuucuaguggacauguuaaagagcuauguaauuaugugauuugcuuuucuguuccuuuagacucaggaucaggugcaguaucaccuuaugaagaagaacgaugucaacaagucucugcuacaaguaagacuccucacaauucaguaaccagcauacagcugcuugucuacacuucccaauuccuuccuauccaucagucaagcuagauuuccugggagcaguuaguguguguguguguguguguguguaaccucaaaugugaaaugaggcauguauucauuuuucccuuaaguugaucaggucugcacagcuguuccccacaacgcuuagccacuuagcagagggaggaagauguauuccuugaaggaaggcuuuguuacauuacagcuaugucuagaagcauuuuccugacugagcuuuguagggccugggaaaguguuaugugccugaauuagucuaagagcugagucagagcuguugcuuuaaacugcuuagggucaagaacucauuccaguugucacaaaccuugcaguuuuuauuauuuauuauuuauuuauuuauuuauuuauuuaguaaauucaucuuguuaauguuugaugaaauccaauuggcauguaagugguggccuauugaauuaucugagagguuggcagugaacugauugacacucuauacagguaauauucauuuucuuguuagaauggucuaucaaguuuccuauaaguuagaaguucauggaaacuucuacuacuucuauauuaaaauacauaagcacauaguauuuaaugguauaaagaaacauaagggcauuguauauaauuaaauuacccauugcuccaguuacucagcgucuguuuuuuaaguuugcugguuaucugcugugugccugguacaguauccaucuagaaacaguaacuguagcugagauugauuuuauaguaagucuuugcuucaggacaguucaugccaaaugcagcuaagacuccuguacauuagauacucugauuaaauguaaaacuucuuuacaguacuuaccaaucaccaacauuuagagaaaacaccacugugugccaucuugacgcaaaaagcuccucaacaauaucgaguccgcgccaaacugagauccuauuugcccaggagacuuucccagucuguuaaacuucucuguccuaaaugucauucaguguaaguauuucccaaaaggaaaacaaacaaacaaaaaccauuuucaugucauacuguauguguuugcguguguguauauauaugucuguguguguauauaugcauauccauauguguaugguugccuguuuguguaugugaaacuguaaaucccaaaauaaauuaugauuugauuaauuuguaguauuuuacaagaaugcugcugacucaaagggaaaguacuaaauuacuccaaaaauuccuucugcauaguauauaauaaauaaaauagucuauaaacaggcuuaaaauucacgguuuaguacguuugauauaauagcuauaacugaaaauuuucugucaugaugaauaaugguaauguaauauguacaaugucuuucuucccagcacuaguuacgugaauauauacauaauauuuuugaaaucuuauuauuacgaauucaucacaaaacgaguuuagauaaugaauuuuaucuccuauuacucucuuuaugauaguguaccaucuucucuugaaauauagaaaaugguauuuuggaaaauacagagaguccaugaaaauccacaucagauaacgucuaucaagcuaaagcuuuagugcacuaucacguacaaaacacacccaaacguguacacauaauaugugugugugcauguuauuuguuuauauaucucuagaauaacauauauuuuccuuacaaauuugagauuguagaauuuguaaagaaauuugaucuuuaaauccaaggaaucgguuuucuacccacgugaucuuaccuggacagugugauuaaacuacagaaauaaagcguaaagauuaccugacguuccaaacagcuggugacagaauucggacaagcaauuagaccucuccucuccucuccucuccucuccucuccuccccuccccuccccuccccuccccucuccccccuuucuuucuuucuuucuuucuuucuuucuuucuuucuuucuuucuuucuuucuuucuuucuuucuuuccacuccauauguuauuccccuccugguucacccuccaacuguucuacauuucauaccuccucccugcccaccugucuccaccaccaagaugucccacaccccacgagaccucuaaacucucugggaccuccagucucuugaggguuaggugcaucuucucugacugaauccagacccggcaguccucugcuguauauguguuggggagccucauaucagcugguguaugcugccuuguuggugguccaguguuuaagagaucuccggaaccagguuauuugagacuguugguccuccuacugggucacccuccuccucagcuucuuucagcuuuucucuaauucaaguacaggggucagcagcuucuguccauugguugggugcagauaucugcaucugacucuuucagcugcucauugggucuuucauagcacaguugugcuaugucccuuuuugugagaguuccauagcgucaguaacaguagcaggccuuggggcuuccccuugagcuggaccccacuuugggccugucaguggaccuucuuuccucaggcguucuuuuccuccauuuccacccaugcaguuuuuucagacagaaacaauuauggaucagaguuuugacuguggaauagcaagccgaucccucucucagugcccugucuuucuccuggaggugggcucuacaaguuccuucuccccccuguagggcauuucaucuagggucccuccuuuugaguccugacauucucugguacauuccgguagaugcccuguaaccuccuaccucccgagguugccuguuuccaacaugaucugacacuuagaccuuuuuguucuaugccaugcuauuuguacuccaugaacauuuaugauuuuaugaaguauuacuaaagaugaaugaaguuaauauguuuuaaaguagguacccuguaauagggagauuaacuggggugaauccagggcuacuuguauagcugucuaccaacagacuuaguacugggaauaacuguaaccugggacucuaaaccaagcaugagucaaggagacaggacaacaggugaagaugccugcuaacaggccuguugaccugaaaaccuacaugauaggagauuguugucugacuucaacucaugcaccaugacauguguucaccaacacagaggcaguaugucuccccguuaugacacagauuuaucuugccauauaauguugaacaucuauugaauaaaauccauuaaaucugaaaaaugaauaagaaaauauagcugauuuaaucuguauaugaaauauuuuuaaauuuuauuuuauuuuuaauucauuuuuuacacuccauauuccauuccccauccccccauccacccuuugacugcuccacaucccacaccuccuccccaccccaccccauuuccaugcggaugcccccacucuccaccccacccugucuccacguggaugcccccaccccaccugaccucuaacucccuggggccuccagucucuugaggguuagguacaucaucucuuggauuuguucuacauucaaucauuuuaugaauguguguguuuuacccacauguguguauguauaucauguguaugccuggcacccacagagaucagaacuagaguuauggaugguaucacggcuucauaugggugcugggaagugaaccuugguuuuaugcaggaguagcaaguuucaacacuguaaccccuaagauuauuuuuacuuggauaauuuauuacauuagaauuuuugagaauuuauauauagccuuuucugauucuucauuaucaauaauuuuagacaagaaguuccacauggggacaguuuggauaaaauuuugcaagaugcugcaacugaagcuccagacaucaagcugaaagcgacaucauuguauuauucaaaagucuggaccacugaagaccagggcggacggcaggucgcuguucauuuugugaaaaauaauggcauucucccugcuucaagugaaugucuaauuuugauagaagguaagagacuuguuauuugguuuuuagaauauuguuuggcaaauuaauuauguuaacuaugccuuauaggcaccuaguagaauacuauuaauuuaaauuccccaaaauaguacauuaacuagauucaaauauguaugaccaaacacuuuuaccugaauugugcauuuucaacuuaugaaaacuugcauauauccaacuuguuggauuucuaucuguaaucuugucagcuuugagcagaucuaguugaauaacaauguaguagaaaggcugguugcuuaugugcagcggauguugucuuggccucuggaugucacuguuguuucauaaaaaugugauaaauguccucuacuaauaaggaaaagagccuugggaagccaugauaaugacaaauuuaaaagaguagaauacuacuacuuuuuuauucucuggguuuuuuaaucuaauuuguauguaagcuuuuuuuauuuuguuuuguuucauuuuauuuuguuuuauuuuucuccugcugaguuuaaguuuucuucuaaauuuacaacucccuuucugugccauucuuuguagaauuuacuguaucucauguguuacuuauaugucgcaucuugcuccaauuauauuuguguuauucaagaauuaauuaauuaauuaauuuaaaggaggaaggcucugcgaagucucuaaacuguccagcaaguuccacagugugaugccugugcgguccggcccugagagccuggagcuccuuacccuuucagccccguuccucauacagggaaaggugcaucacuauggguauguggucagcucaagcucuuggcuuacagcuaugucuccgugguuuauccaccaggcugcucuguuugcaguagguacuuaccuguacuaguuuguaguuagaaacaguucgcaagcuauaaugauuguguuagaauugugcagauacaauacagguucaauaaacucuucuuuaauguugaguuguaaucuuuuccagucaagugguguguagcauaacacucacaugcuaggcagagauagcaaauuaagaauuuggguggacaacaggaucauuaagguaggcagcugugugcuggguacuguauucauuaauuagacuagauguauugauguaauuccauuaugaguucaagagcauccauacuaaauuuuucuugaauaguucuauucuagaacacguauauacauacacauguacauauucuguaugcaugguaagucacaguggguauaagacugaguauuuucuuccucagucauagccuaaaucuguuucuuucauaagaguaaguugcuacauaaagggccaguucagaauugcaaauccaguaaguagauuccacagcugcuaagcuugcaccuugcagagucacugccacugaaaacuggcagagcgugaggccuacagaccuagaaggaagagauggaaagcgcccaguacugcugaugaaagucacccaaaaaacaccacuuugagaagcccuguccugcagccuagugagaucauauucucucccugucgcccuuuccuuuuccuaagguguagcauuuggaagucauuauugccaaucaaacuaaauuuagguuuuuauuauaaaauuacuuucugccauuaccaaagcuacuugguugugguccuuagagugacagugagcuuugcccuuugauuuguuuuauacacaauggauggaaaccuucagcaaugaaauaaaauuaauuaguaaccauuuuugcuauaaagcaccuagugucucccugucuuugaaccuucugcaaggcuuaugugccucuuaguugaaauaucaaaauccaucauauucuguguuccuuuuaauaugagccacuaacuugccuuaucauugucuaauauuagugaaucauuuucauuccauuaucuuucuauuauuacuguaaauaaagaaauauguguaauuugucaauuaaauaauaagccugaaaacaguccuauaacacuccuguauuauccaauuaagugaaaaauaguguuaaauuuacuucuaaucaucuuuucuuccuauuucucauagacauucaaucaugccuaauaaaguagaauuacuuguccuuaaaauauauuaauauauagggagaacaaauucuauaaaacgauguccaauuuuauauguuagaugguuacuggcugucaggcaucagaauguauaugacucugaauaugggcuuacucaaaacaauauuuuaccuaaaauauuacuuuucucaccuuucauucagaauaacuuuuucuuauuuauuugguaaggccauggaggucagauauugcuaacaaagccauaaauucaaacaguuccugagucuuuuuguuuuaacaagaaaacucauagccaaauuuauuauuagauugagaguccaauuccugaauguuaacauaaaagaucuaaucucaagcccauuuuuuuaguuacugugaagagacaccaugaccucggcaacccaugacagaaagcauugaauuuggggcuugcuuacaguuucagaugcuauauccaugaccaucauggugggaagcauggcagcaggcaggcaggcguggugcaggaacaguagcugaauucucccaucuuaccuacaaguuggagcuagaaaaagugagaacgggucuagugugggcuuaugauaccucaaagcccacgcccagugauacacuuccuccagcaaggcacaacaucuccuaagaguuccuucaaagucuaccaacauggacccagacauucaaauauaugaggcuagggggccuuucucauucaagccaccacacccacaguaucuuuaauugcuuuuauguggaaaguuauucauaauucucuugaaacaagcauauuacaguauagacaguauuauuauuuuuuauuuaauaacugacucucuaaaacuguccauucuugaauaggaugugauaauuaaauagaauuugauuauauuuaaauauuuacuguuuuucacuuauucauuucagauguaaacagugcucaagcuugaaaccuauacaaaaucuaaacucccguuuucauaaaggaccguggacuccuuccucuguggcagaagguuagauaaauugcuauguuaugcaguuucaauucucccuaucgucucacugauuuguucuuuaauauuuauugaauuuuuuuugucagcauuaggcuaacuuugcuaaguugaaaucuguuuacaguaauuguuuugaggaugaggacugaauguuuaaauuacuugcgaauauuuccaagcuucguaaucacauucacauuuuaguacuuggucguuuguuuuccauuuaaucauugaucgcaaacauagguccugagcaaauccuucugacucuuauucuagcguuggaagagauguugagaugacuguuacauuccucccaagucuuuagccagggagaggagucuuucucucuuaaaugcaucacuuaucacuuugcccuugucuacagcucccacgaccagggcaauuucuagauagucauuaauaauuggagccaagucuauacagaaguuacaugggccauguccugucuacuagaauuauucaguguauguauccauucaaucuucuauaaggaaaacacuccagguuugacaguaucuauugugccuccauugaguuuauauuuuaaagccgacacucucccucccuuuaucacuuuuccucauuccuuucuccuuuaucuucuccacgagcauuccacuuggccaauucgcuaaucagaauuuaucuuucaaagauauugacagcuguagguaucguuugggaaacucagaauaauuuuuuuaaugaucacucagauucuuccugcuagacuggaguuuuguuacauaaacuaucuuauauaaauagaugugcacuuacggggggauugcuuuuuaugucuagcuucaugauaugacuaugucauacccugcagucuauguuacuaugaacugaacuggguaauccccuuucgcauuucucagcacaguuuuugaguccaccauuuuuguuucaguguaaccucuggggugccuuuugaagcuccgaacucuguuccucuguuauugcuauugaauacuaaaauucugucuguugccaauuuauucuucugccucaucugccuguuuaauuaauucucuacuggaauaugggcuguguggauggaagguaauauaauauccuauacauguaugcaguuucuucaacuuuucaguaaaaggauguuuacccuauuggcaaauucucaugugauuugguguaucuaauuuauuaauucuucuucacccucgcaaauuacggaaucccagauucuaacaauuuuauuccuucagccaaauaacuccuaaaacaaagaaaaagacaaaccucuguccucauaauacaaauaaggauaaacuaagaaagccacuaaccggccuguuccuuuuuagagcauuaaauuguaauuuuaguuugacuuucauauuauuagacugcaauguguuacauuuuauuaacacuuuuuaugguuucugucaaguauuaagauacaguugcuuauaucauuagacuagcucuacauaaauacauuggucugcuucaugaauuuaacagaauaauacuggagcagacaguucaguuccuaaauacacauuuucuuguaaauucuuuuagccaacaucauuggcagcuacaugauagaguucagcuuauaaaacgucccguugccagacguaaugugcuuuuccccuccccagcccugggcguugugccgcugcaguauguguuuguuaugguuuucacucuggaugacgggacagggguguuggaagcuuaccucaaggauucugugaguaaugggaacugcuaaagauauuucacuaaaauuuauauuuaaaauuuuauauacauauauauauuccauacuucuuaguuuuacuucaguguaaauuauugagaacuuuaaaacccuaaaauucaguuucuauguauuuuguucuuagaaguauuuaaaguaacuuaaaguagauaaauaaaauaggaccacauaaaugcgauauuaugucuuugccuuugauuuuuauucauauuuuaaaaaauauaaaguugaggaaucaaaguuugaggcgacauucucccugucauacagaaguucugcuacuaggaagcagauagucacacugccguccuucacuaugcucuguaaggcuccacacauucaucuuaaacgaaaugaagccacuugauaugcaagcauuguuguauaagccgcagagaagcggagcgaaggcucucauuugugauacucauagcuacccaaugacgaguccuugaggccaccgcuagcuuugaucguuugaagauaaccauccucuccguauaaucagagccgccuauuauuucccuguguuguguggaguccugacaaugaggaaagauuaaccuaggcccugaugugacuugccauauauguucucauucauaacugacugccuguguggcugauggcuuucuuccugagguaaggcuaaugauguaugucccaaacucuucagcuucagaugacauuguuagauguuccagaguagcccauaguuccaguaggcagucagucaagucaggggcucucagagagugaaugaaacacuaaaagcuaagaggaagaacagccauuuacuagggugaggggguuucuuauuugggaaaugagggguguuuuaacuuuauaaaucauaauccaauuguuuucccaauucauccauacacuuauuaagucagcugcugugugccuuguauguugaacauugaagaaauaguuagcccuggcguccccuuguacuggggcauauacaguuugcguguccaaugggccucucuuuccagugauggccgacuaggccaucuuuugauacauaugcagcuagagucaagagcucugggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagaggcagcuacaucugggucuuuucaacaaaaucuugcuaguguaugcaauggugucagcguuuggaagcugauuaugggguggaucccuggauauggcagucccuagaugguccauccuuucgucucagcuccaaacuuugucucuguaacuccuuccauggguguuuuguuccuauuggacacgcaaacuguauaugccccaguacaggcggacgccagggccaaaaaaaugggaauggguggguagggaaguggggggggguaugggggacuuuugggauagcauuggaaauguaauugaggaaaauauguaauaaaaauauuuaaaaaaaaaggucuaugugaaaaaaaauaaaauaaaaauaaaaaggucuaugugaccuuccuggauuaguugugaaauuuuauaacguaugucuauuuuaaugaauaaaauguuuugcaauuuaaaaaaaaauaguuagcaaagcaaaacaauuuucuucucuggaaccuaaauuacaggaggaaaaaaaaauaagugcuuguuucuuaauguuagagucuaucauaccucacaguagauuuacuuuacaggguacaaaaguaccaucagcauuacugcaugaucguauuguguuugugagugcaucucaaagcuguuuuaccaguaaagcaaugaaucagguuuuaacuuagacaaguacuguaguuuacaguuuucacaaccuuaggagacagaugaauauauuaggucauuuuagcaaauuagguguugaaauuccgugcauugaagcuuuuucuuuuuuuauugaaauguuuugcguguguguaugucaguucaccaugugugugcaugguucguguggaggucagaagaggauaugagauccccugcaacaggaguuacagguggcugugagccacuuguguggguacuggcaaucuagccugaguccucugcuaagggagccagugcucuuaaccuuugaggcgucucuccaaccccacuuuggagguuuuucaaaagauuaauauuuccugugcuuaucauuuuuaggaacacuuuuucaagaucccagcaucugaaguccucacugaugacgaccuucagagaagucuagaaacgaucauggauaugauaugucccccaggaauaaaaguugguaggcaguaauuaaaagaugccauccccaacccccuucucucucucucucucucucucccucucucccucucucucugucucucucucucucucucugucucugucucucucucugccucucucugucucucucucucugucucucucugucucucugucucucucucugucucuguuucucucugucucucugucucucucucucucucucucucucucucucucucucucucucucucuguuuucuuagaaaaauaccuagcauguuucaaaucuguagccuggaaguaagccaagugugaguccgguugugaaaaauaacuguugcucauauuuuggugugauaguggcugagauaaauaaaaauaaaaguguuuuaaaauaguuugaaauacacuuaaaauauagcaguuuuggugacacuacauuugacucugacuuuacacauagagcauacagacauugaagcuguaauuauacaaaagggaugcaauuccuauacaaaccauguccuaaaaauaaucugcguuugucuuguuugacuuauugacgaguuuucuuuuccaugcuaauggacuucuggauuuuuaauuuuuacuaugcaaaauugaugaacuguaguuguuucugcacaaacacuagcugucaacaugcuccugccaaggacaaguuguaccagauaugacugccaccauggccuucuguggccagggauuccauuucucuaccauguacaguuccaacagccaugcacagaagugucucacacuuuauccuuguugacuuuagggccguaccagaugcugcucagaguguccugagccuucuguugauguuagaaauuagucaacucuguucagaguguagggguggcaccacugcugccaguaugguggggguccauagcugcuuccuacagggcaggucacacggugacacccaggcugauuugaucugaacuucagguuccauuuucuuuccaacucaucaaggaaaagugaggggaggccacuaagcagucagcccugaaagguugggauguggccgagggggaauuaugacagcugucuucugcuguuggguguucuauaguccuaaucacuuucaucuguuccuuagaaaaaauuaaaaucagucagcauuacaagaucugugcuuaguuuacuaucuaagugauguuuccuuuugucugcagaugcauacccauggcuagagugccuccucaaguccuacaaugucaccaucggaacagagcgacgaauuugcuaccagauuuuugauacuacaguugcagaaaauguugucuaguacugccauugagugcaguguguaugggauuuuacaguuuuagaaaagaucaugacucuuugagauucccagaagacauuuugcuauugugaaaaaguguuuuauccuuuuucacuauaguuuaguaauuuguacagaaaaauauuuuauuguuauuuaugcugucuugugaacauaucaaaaaucccuuguugcucaucaugucgugggagguacaaaaugaggcagcacugguuggggagaaccaggcuuucuuggcucucauuuauaaaacacugggagcugauuuuacuucugugcuguuugauguuuggguuuuuguuguuguuguuguuguuuguuuuguuuuguuuuuuauaccgaagaaucugcuuagcaacuucugaacggauucucccucugcauccacacaugaguaucagguuaacugcgugccgguugaacagaugcuugucucggugagccuggcuguacugauguacuuucagaagacguaugguuuauuugggugcucuggucgcccacuuuagcguaaguguagcucugugaaccgaagaguaugccugaccuucagcauuucucuacaacauuagaaguugcuucauugcccaccagcgaauaaagugaugagauuuaugauuuuugugucugugugugugugugaaucaucuguaucuucucuuuuuugguagucuuauguaaaguauucccguauugcauuauugaggucuuagcacaauugaauguucugcauuuuuuucaacaguguuuaucaauuugcaugggcuuuuauuuuugaaaaagaaauauuuuguacaauauaguuugaugaauuuucuguuccuuaacaucuuccagauacuuuuuacacacccaacucuacacauguucuuuuucucucuuuagaaaacaaacagauaaagaaaacaagccauaaaaaacccacaugcauauauaaaaacaaucugugaaacaaaaucagaaaccauaacauacaagcaaaagucccauaugacaaagggggagggggggaacucccaaauaaaguaauaugaaaccaaaaugucua

SEQ ID NO: 2858 - RNA, 45116 nt, Mus musculus
cuacucggcuuucugcguugucucuaagaagucuuuccuaaguaacucgguuucuccugcguaaaacuacucgcguaaugccaaaagccuguacaaacuggagaucuccauugcuugagcccccagagaaagugccacaagugucaccgucaaucauuuccacaaggucgggcagcuccuuucccuucuuuuucaaggcagcuucguuauugguucacuccaugcucugaauguuuaaaauggaagaagaagguaaagaugagauaggugauuacuaccauucagcuucuugaaaauuucuuauuguuaaaauaacuuucccuugaaguguuuuaauccauaguauaaaguuuaccacucccacaaacaaacaaacaaacaaagccaaaaguuuaauuugggucaagaagguugauugaaccuguagggacaaguggacuuuuugaauuuaaaaaacaucuuaaauguuucggauagaauuuauuguauuguauugcuuagaauauauagaguauuuaagguauuuuauuauguugagcagauucuguuuaauuuaugauauuaaaacuuuuuugagucucauaaagaauuuauuagugaguuuuaauuuaacaggcauuguaaacuguugagggccuuaucuuaaaaggacucacagugucaacuacgaauaaaggucuuucuauucuaauucaaagacaugcguuuaucaguuuuuacuuuuaaguuaccaggguugguaacuucccccgccuacuuuggauugcuuuuaauugaaauauuuuaauuaugcucauguauuuagauuuuuuuagcagaguauuugaagcuacuuuuuuugaguaagagaaacgugguaacaguaaaggggacacacuccuuugcguuacaggacauuaccacuggacuucagccugugucuguuguguuugcuuggaucaguucuaaccuaguaaaacagguaccucuaggaggggaccucauuuucauucaucuucugacccaucuaacuuaagcacccuuuauaccuuaccuuuuauauauuugaagugaagauguauuucuugguuuuuacuaguuugcuuauucauuuuuuuuuuaacaaaucauuauugagcaugucuuagauacuaggucuugcccaaggcacuagcaauauagauggugaaaaagaguuuuccucauauguguauguguauguauauauaguuuuugagugggaagagauagauuuaaacaaauaauguaauuugugaacaugauuuacgguacauguugguaauuaaguauuuaagagaaaggugcuuucuggauuuuaauuuuuaaauguggauuaaauuuuuuuauuccccauuaacaagaaaucuuuaaguaucauuaauuaaaaauuaaaaguugcugcuuauuaaaaugugcuuuuuuuuuuuuuuuaaaagaaugaaaugcuuuggaauguugauuucaauggaaagcugggcucuugaugacuuuuagguuaggcggcugucaucacugcaggaaaggugugugcugaguugagggcauuuccaggucuggaggaagugugguaugauagucaugaagcuguccucagaugcacgcaggaggaugcugugcuugagaaacuaucuaaugggcuuucaugagagguauccaucauuuggauuauagacagagggugaggccugagaugagaccauucugucuccauggaauuggucaauuuauacugagggguguuauuagaagucuuaucaguaugugcauagucuuaauuuaacagauuguuuaaaauagaaguuuucagaaauucaaaaaccaaggaugugauguaaccaucaugcagagccaucauuuaucauuccauggaaaucuguuuuccauuauuuucuccuuuccccaacauuucccuggucugcucucuaacuucuccuccaacuucucuuuuuuaguaagcaaauccuagacaucaugguuagaaagaucuuuaaggaacuuguuuuaaggcaggagagacuuuugcaaaaauagauaagugcuccuggaagagaguagguuguucugagggucugaguguuucuaguuggggagauaauuguuuaaaacguuuuguaaccuggguggaucugggcugugugagaggacaguuuagcaaguuacagauauguguguauguauauauaaguguguguguauacaagcacauuucaaaugaaaaaguguauuuuaauaaugggagcuacauagauagugcccauguaaagcugacucgguaaguauguuuucuagugggagguucugaggcugguagguaagaggcuggguacugucaugugcguguugaaguugcuauauuagagaaagguuuuggaguauauuccugaaggaggagcuccuggacaagaagucugcuucuccccauagcucucucucauuguugauuuucuucuuuuuauucucuauuucuugcccccuguaaagccggucccuuaguucuuuacaguuaguagauuuuuccagucuucauagcuaauuauauguuauaguuaucaauugcuaucauuuuuagcuacugaaaagagaucuuccugauucaccaugaacagacugcuaauaaaccucugcuguuguuucuccuacagguuaaauuugacuuacaguuuguacaagauuguuuuuggugucaggaaagcaguuguuugcuccugauaacacugauacugccgggugcuaacugagcacuugcuguaucccaggggcuuugauugguuuuuaucauauccuauucaauaaucacacagcuuuuguguuuguuuuuuggaaacuuuguuagcuccaugauaagagaagaggaagagaucugagcauuuaauugucucacuuauaccuuagugaacagccacacaguugacgugcagggaauguccauguggacucuuacauucuuuauuacugcaguuuuugucaauucucaaacugaguuaauugucuguauucuacuuacgugccuagaguguuucuuaagcuuuuguuugaugaaauaaggugcugagauaugguuccuccuauuugugugcagcgagcacuugguaggaaggagagucuaaggcugcaucuguaugcacagcauaaaaacagccuggcuguucuguccaaauggaauugcuauccaggucuaaggugcagagcaguaguagcaccuccaauugaaggaaacuugcucucccaaaccccauaccaagagaauggacccuggcuuaugaggccauuaauuaggugggacauuauauucuuuaaaaaaggauuaaaugguuaguuuuucuuuacuacaacuugcuguuugagagagauacauagaaacacaguuguccuuuucagcuaccuugugucacaugaucuaauuacuuuucuacuuaucagaggauucugcaaaggggaggugauaaugacuaauggauaugaaagugaaaauuuuuguuuuuaaaaauugauaaccuacucugacagaaucuuucaauucuguuaguauccugccaagauaauuuucucuuaucaucuauacacauagccauaucaacuaaauuuauauauaucuguauaauguguauuaauguaaauaggucauugucuauacccuguuuggucccuauaaagagacucugaaauuugaaauuuuucucacuugaguacaguacuagagcauacuucagugaaaguuuuguaugccuugaauacuugucuguuuucuuucuucagaagcuggguuuggguuauucucaugauuggccagggugcuugaucagauuauuuuuaaagcuuuuggaaggguuuccugaguauagcuaagaguuuuuguuaaauguaguucucacuuaagagaaacaaaagaggcuagcaauacauaaugaaugaugccaaagcaguaaguauuugcuguuagaccuacuaacgagccuugauugagucuuuaauauggggaaugauugaggguuucccuccauugcuucauuugccuuauaaagauaaguuuuacauauaugaauauauaugggguauucucauuauuaacacaauccaagagucagugaugucaauaaccauguuuuugugugugggucggguguguguuugucuuccauguaguuuauauccuggagccuggagauccucccuuguuacagcaaccagugcagacauccaaaucugguauucagcaaauaauugagugcuuucgaucagguauggacauuuucacuguauuuuucagaugcgacaguaauuaaaaacuuucuagaaggccuguauauugguuuucuuuauagaauacuuugaguugucauauuuuuaagacaaaugaauaaacauugacuugaucuagaaauucuuuuucaauacuaccuacuaaauauuaauuuaaauuuuuuuguaguuuagagaaaucugguauauuuuaagauaaaaugcuguuacuucuucacauuaguuauucuaguucuuaguaaacuuuccugucaguuauauuaaaauaugugagcucucacucucguucguuucuuuauccuuucuguuuuggagacuugucuccuaccaaacuuuggaguuuucaguaucuccaguagaguacaggguaaaaaaaagacaugucuaacgcugagaucuucagauaucuugauuaagcuucuguugcuuuuuuaaaaauucauuuuauuuuauuuuacaugucugaauguuuugacugccuguuuguauaccacaugcaugucuggugcucagagaagcuggaagagggcauuggauaucuuggggugcaguuauaaccaguuauggcccuccauguuggugcuuuagaauugaacuuggguccucuggaagagcaaccaggcucuuaaccucugagccaccuguccaaacccaaccuucuauuucuuguagauuauuauaggaauuggcucuauauuauauuugugcaguuacaguucaguccuuugaaauaguguuacucauuacauauaagcaaugagaaguuagggcuccuauguuaauaguaagaucauagauugcuaugacccuuacagcucccuuuuccuuuuuuuaguagauuuaugucgugacauuacuguucagucaugaagccaaugaaagggcgccugauuauuggauaguagggucuugucauuauuuuaaagcugcuaucuucaugaaacauuucuguguucuaaaggaaagcaugauuauauaaaacuguggauaaaguuuuuugaagcauuuguuuuaaaauuuuacagaggagggacuggagaguugguucagugguuaagaaugccuauuaaccuugcagaagacccaagguuuguucucuguaucuacaucaccgcuuauaguugccuuaacuccaguuccaagggauccaacacccuuucucauguccucggugauugcaugcaugcgauguguguguguguauaugcauguauguauguauguauacaugcauauauauauauguauauauauaugcacacacagucacacauauaaaauacaugaauaaauuguuuuuuaaagaaaaauguagagggggaacuagaaauuugcuuuauaguucaaggaaauaggcuauccucagagaauuuguuucucugaccuccaagaaccauuuuguagccuuagacaugccuuuuaugucuguugucuuuacuacaaaagcuguuucggugccugucauaugccuaucuuuaugcuaggugucuaccuaacuuugaauacuuguuuuuacuuuugauacucaacuuugauuaacagaauaaucugcaagcuaaagucuccuaugaugaauagaucacuuucacuuguuaggggcaguuuauauuucuugcauaagaaaauaguaguuuauuucuguuuuagcaauuuuaaaacacauuuuuuuuuucauucuuuggaaugaaaaugagaaacaguuuuuuuuuuuaagaauucauaauuuagaguuaagguuauuuuauacugccuuaguuuuguuuuguuuuuuuguuuuuuuuuuagaaucgauuacuucauaaaugauuuaucuuauaaggugcuuuuuagaauguuauguauacaaaguuuguguguuuuuuaaauuuugaaagguguucucuugcuauaaagagacaccacaacaacucuuacaaaagaaagauuuuauugggguugcuuccaguuucagaggcuuaguccauuaugauggcagggagcacuaugguaugcauaacacugggacaguuguuaagagcuacauccugguccacaggcagaaagugagagggguugggaggggauugauggauggucagacaaagagacaaaagugagacacacagacaacugggccuggguugugauuuugaaacugcagagcccuaccuccaguuacaaauuuucuccaacaaggccgaaccuccuccaacaagguuauaccuccuaaucuuuuuaauccuucccaauagugccacuccauggugacuaaguguccaaguaugugagccuauagggccauucucauucaaccucuacagaagaaaaauauuuaaugaugaguccucuuaugcgcuuagucauugauuaucugggcuuggcaguucuuauguaaacuaaagaaugaggcagugggauagguaaucugaauuggggucauucuacagcuguucguuuaucuuuugaaaugugguuguuuuaguuagggauuuuaguauugugauaaaacaguauaaucaaaagugacuuggucaggaaagaguuuauuucaucucauaucuucauauuauauccaucauugaaggaagucagggcaggaaccuggaggcaggagcugaugcaaagaacauggagggugcugcuuacuggcuugcuucccagggcucacucgcaugcccauccacaauaggcugggcccuuucacaucaaucaucaaucaaaacauugcucacagagaugucuacagaccauucuaguaggggcaguuucucaguugaaguucucuuucucucaaaugacuaacuugugucaaauugauauaaaacuagccagaaguauucuuuuaaaaauucuccccagcacauuacuggaaguacuauaauuuaaauuaaaggugauguagaaaugugcagaguuuggauuaaaagagaaucacuucaucauuguguccuauaaauaaucagaaacuuuaguuucuuuaagacaguaauuucccacauuucuagcaaaucuaaaaucuacugaaguagcucuuggucguacaaagguauuucaggcuaagauaaacuuuaggagaaugggucacaugacuucgggguuuaaugcucauucuaaccugggacucggguccucccugacccagucuucuauaagcacacccucagugauucaucucuuuccaaccucuuuccacuguaacuaggucacacacuuugcauugaaaaaccuauccugguagcacuguguaucugauagauacuuggcaguaccacugugaguccaugagucugcuuagcaagagccagaggggaagucagguuggauaguagugcuugcuguaggaucugcuuucaucuucaagcacagauaguugucuucaacugcuaugucaucuuugagaucugacuuucuuccuccuacacugggcugucugugagcugguacuaauuccuacccaagcuggcuacucugucuggggaaggaguugacucauuucaccagcucauaugugcuacacugacugcuugaugguuuuaacccauucuuauugucuuagauuucaguguuugugucagguuugcacuacuuucuuggcuuaaauuaaaauuucuuucuuaccucugcuaucuacuucuaacuguuugauguguaaaacaguuuaaguaagaauuuuuggugggaggaggaaaugauauuauggauacauuuuauggagcacuacccauuuuacacagugacuacugcugcauaguuguauccuuuuuauggggaucuguuauccaugcauaaacauagccuugguuuccuccaguagaaaugguagcagacggacauucuucugcaccuuuacuuuguggauaaauuugguuguucugauuuggcuguagauuuuucuauucugaaccaugaugguuggaugacuugaaaccugcuguuugcuacaaauacaagcuucugguacuacuuccaucaugcccuuugcuguccuggagucuuucaugccugagcaaauacgucuaggauuaauaccugugaugugauaucuuuggacuucccuccuuucucuuaacaugcucaguucaguguuugugucagguuugcacuacuuucuuggcuuaaauuaaaauuucuuucuuaccucugcuaucuacuuucuuucucuuccuuucucucugacuuccuucagaacagaauuuugaagaaaaaaaacccacaauaucuuuuagguaguuauauugauuuaguugagauuaaucuguguuagucucuaaguuaccuuacagaggcaaagaaauuguagaauguacuaaaaguuagaaacaggaaaaugagggaaggugcgccaccacugcccagccaauuuuuuugauuguuauauagcaauuauaggagauuuaaaaugguacuagauauauuuuggguuaauuuauuauuuuuagcauucaucuuccaagcaugucuuguaggauuuuguucuugagagcagguaguuacacagguuugaaguuuucaguguuacagagccaucuccuuuacguacauguuuccagggaauugaauaguauuguaugugacauuuaauaggcgcuacauuaaguguuuguuuggggaaagugaaagauucaucaaguaggcacagucuuaaaguaauuuauccuauuuaaaagucauuauuguauguaucaguguuacccuuggguggaggguuuuuuuguuauuauugauguuaagguccugauugaugaucuauuaaguagcaaguucuaagguaauuuaagaagcuaaacaaaaaaaagagagugauugcuuuuuaaaaaacuaauuuggaugaaaucagcaugauucuuucuugggauucccggugugcaugaaccuuaugcuguugucuagauuaccaugccugugucucaggagaagaggaguuuuaguacgacagaggcugugucuguuugugacaaagcagucagaaaagugguagcuauuuuuuugaauaaauccauucuauuaugauggaaaaaauauagcaucuuaaaugguggcugaaaccuuuuaauaucuguuugugcaauaagacacaucuuaguuuucucauuuguaagucuguagcauuagaaaaucauauacagagaguaguuaauaaagucauccaggcauuguccugaagauaggaacaccguggugagcauugucucuuagauaucauagcagaguugguacacagaacacugacuaaaugcaggagagugagacagcuggggagaugagaagggacguugagaaugcagaugauagguuauucauaggcagcucagagaaggcuuccuaguggaagugacauccgaccuggcaucugaagguauuaggagucagaacagggaaggagguguuauaguacgagucacacggaggacagagagcaagaaaacguuugcugaaucugaccugaaagaaauugguauaccugagucaacaguaacuggcaugugugugcgugcgugcgcaugcgugugcgugcgcaugugcguguguguuugcauuuugaggaaaguguuuauaacugguaggauagagaagguacuuuuuaugcuuauuaagaauaaguaauaugcucgcuacuaaauagaacaaacuaggaauaauuaagaaauugauguuuuucuuuuuuuuaagaucaagaaauccuaguggacaaagugaccuaauuuaaggaaauaaauacuuuuacuuuuauauuuuauuguuuauuaauuauaaccucauguuuauguaagauugauaaugcuuugcauaugcugcuauuugcuuauuuaaacuuaaaaguuaaauuuaaaaguuaauuuuaaacuauuuuuaauuacauuuguguauguguguguaaauuuaguagagugaacauguacucuguagguaccugcagaggccagagaugcuggauccuucuggaccugaaguugaaggcaguuaugagcuuccagaggagggcagaaaaccaagcuugcauccucugcaagaccagaacauccucuuacccacauagccaucuuucucaccccuuuagcugcaguuuuuaguuagauuuauuuuucuucagucguuuuuccuucagugucaacuauuuuuaagaaagauuuauuuuuauguuauguguacaagucuuuugcuugcaugugcauuuguacucuguaugcauacuggguaucugcugaggccaaagagguuguuggaugcccuggaacuggauuuauggaugguugugagucugucuuuauacggguagugggaaccgaauccaggucuucugcaagugcaguaagugauuuuaacugcagagccaaagauauagcccaggcuggccucacucgugaucucuugcaucugucucuuugcuauauccugcagguauauuugccacaauaggcucuguucucauuuucuagagacaugauucuauuuugagucuagugguucuuuuaauuuagaaccaguacauaaaaauuuacuuuuauccccucccuauauucagcuacauuuaaugaaacuaaauguuuaucuguaacagaggcuuagcugaaguauuucaguccuugguuuaccucacauagcuugguaaucacuuuggggcuagauaggaaccaaauauauuagcuaucaucaacuccuuuguaauaugaaauuaguuuuguuuuguucuaugauacaagaugaauaagcuaaaaaaacaaaacaaaccaaaaacccacagauauuauauguaacuaaccaggugguggugccuuuaaucccagcagaggcaggcagaccucugauuuugaggccauucuagucuacagagcuacuuccaggauagccaggacuacacagagaaacuuugucuugaaaaacaaaacaaaacaacaacaaaaacagaaaaaaaaauacagcuagacaagaucagauuaacaaaucuucucuguagugacaauucugggaauuugguuucuuuacacagaaacacagaaauauuauaagaaucugguuuaauccagguguggggauacagggcugcuucgaagcagcuuucuaugauuugccaugugcacuagcagcggcaugguuuugccagcgcugguaguuucugugauugugagguguuuggaaaucugaggacuuuucagaggacagaaaugcuagucccgagaggcuggucauuagagggguugcuuguaguuuguuaguaguugugcucaaagaagaaacaagaagaaaauagauucaaggauccccuccccuccccuccccccucuucuuuuuccuccccuuuccuccuuucucuccuaucuagugaucuaguaaaagggagugaaacuagggguggaauagugggcuaaagagugggaaaaagaacacacaaaauagaaaagucuggcuacacuuauaaguuguauuaucuuuuuacaauagaauuuugaggucuggccuauuuuuaacauaaugauaaaauauacucuuaaaaguuaaagguaaauuaaauugcuaaagauuggguuagaaacauugaacuuuuauagacccuauauuuuucuuuuuauucuccucuuggauggugcaucuuaacuguaagcuccucucuuuccccuccucccaguccccccucccccuucucucucccagauccacugcuccucuuucccuucagagaagagcaggcuuucaagugauaccaacagaacauagcauauaacaagauguaauaagacuaggcucaaacccuuaucaaguaggagggaaagcgucccaagagcaggcaaaagagucagagacacccccuccccauacuguuaggaguaccacagacacgccaagcugaacaaccauagcauguagacauaagacccagcacagacccauacaggggugugauuacccuuuaaguguccgugaaccccucugagcccuacuuaauucauucugugaguuguauuuuggugucuuugacuccucuggcucccacaguacuuccuccucccuuucugcaggcuuucuggagcuccaccuaaugucugggugugguagacccuacaauuuuaauuacacuauguuaagauaguuuauauucuuaaguaguaccagagcuucauagacaggcaaaaaugcuuguuaaaugacagaacauucaguauuuaaaugaugcuaaggguauuauuauucaggauaccuugucaaugaaaguaacaauauuaaguuauugauauugauuaguaaguuacuauagcaaagaucuguaggaaguaaaaacaaaguuuugauaauuuuuuguugccaauuauucugugucuuuugaucccaccaacgugcauagauucccuagcucaguagcacuuuucuguuauuagaaccgaacacuugugguuauaaaugugguaggcuuggucuuggcugcuuugaggguuuauaauauaauggauaagcuauauuagaccacaguaauuauauugauaaguaauuggaauuggggcaagauuucucauggauaaagacuugagauauauaaauugauagugcuauccgaagccugagcaaaauucaaaauucccucaguaggggaaaagguucuuugcuuuaucaccaaauagcauaacuccauguuggcccagagccugaaguaauguaaacugaauuuuaaaaggauacucauauauaaucuugugguaaaaacuggaccuuuaaugaauugagaaauguguuaaaaaauaaaaaaaacccaaaccuuauuuuucacuuccauguuuagaaaagagcuggcagaaccagcagaaauggaaagaaaugaugagaaacauuuuuuaucuuuuccagaccuaccaaaucacaaucccuagggaaggcuauauaugucuuuauuuucagugcucaaucaugucaaaaccacugccuuggaauugauugacuacugaagugggagaaggacaucacaguuuggcucucuaaauugccaaaucguaguauuugcuuggaauuaaucaguuaauaaauguucugugguaggaaauagcauuggcuuuaccuguguuuuguuuucagaguaaaugugcuuuuggauuaucagguuaauaccuuuuaaaaagcgcgggucagaauuaauuuuuauauauuucuuuucccuccaggaaccaaacaacuuaaacauauuuuauuaaaagauguggacacuauuuuugaauguaaauuaugccguagucucuuuagaggauuaccaaauuuaauuacccauaaaaaauuuuacugcccaccaagucuccaaauggaugacaguaaguuuuauucauauguucacauauucaguuauauauuuuagagcuaaguauuuuuacugcuucaauguauuuuugcauuaaaguggaauugauaucuaguuauagauaauuuaguguugaagauaugaaacacuugauauuguuauauucaguuucuuagauauacuuuauaucagcauuuuucauuuguuuuuuuuccuaaucuaugaguuuaaaucugugaguauauuuauuuguauugaaauauugagaauuguuuuugaaugucuauaugggccauauauaguuuagcuaauauuugaaaguuagaauauuaaugcugucuuuaagggagcauuuuaauaguauauuauuuuaauuuaacaacuuguugcuaaguaugauugauuacauacucagacucuccuuaaguaagugaggaugcuuccaguaaguagcaaaaaaugaguagauuacuugauacuuugagaauggcagagagcauuaaaauauuuauuaaccuuuuaguguuuucuggaucuuaauauaaagguuauauuuguucuuagugaaauuuauuuagagauaacauagccaguacuagauugaaucuagacaggcaagauuauuauguuuuugugaauaaaagcaaguaguaugcuaauagucuuuguagaaccaauuguuuuuugaauguaauguacuugcauuuauaaauaauauguguaguguuauuuuuucuucuuuuuaagaguuaauguaaauucuuuacaacaguaauacuagguaacuucauuguuucuuguucaggaauuuaaacuuuguggauuuacaaaaugagauacuuacuuuaguagccugauaccauagauacauuguggaucuuuugcauuuuucagcuuaaacucaccuuuuuuuuuuuuuuguuuuaaaguuuuuugguagggagauauaaugcaaaaacugaauaauaaggcguuuauuuaauuauuguuaaauuguguuaaaauguauuauaggguauagauaaauauuuccuauuuguaagaaauuuuaauauaaagaauuuggucauauuuuaugggaacuuaagauaauauucuuuauggugcuuuaaccauccuggguuauagaaacuucggguugguuuugcuggucuaaaacuuugagacuaaaaguaauaacauuuuuaguguuuaagauauuccaugcgcuuauauuugaucguauugagcuuuuuauuauugagcuguaaauuaaaagguagucuagagaaaauaguuuaaaaaucuaacaauuuaauuaaaguaguuuuugauuucuugauguucuuuaguauauuaaguuauagaaguaauuuccauagugcaauugauaaauggaguugccagauuuuugugcauucuucuuggugguucuacauauacuuucaugaaaguauugucacacugcaugacgagggcugggaagauggcucgucacaaaagcuugaggaucagagucuuuguuucuagacccacauacaugcagaguggacagcagccugucuggagcgucccgucagccucagacuguggagacccgggaaucccuaaagcaagcugacuagcgagcagccucagugaauaaggauugaugugaugggggaugacugaauagcaaucuuggguuuccacauacacacacacacacauauacccacauauguaaacauauacacaccaagcacacucaugaaaaaugagaaggagagaguauuagaagaauuacagugguuauuagauuuaguaguauaacuagauuuuagaauuguauguggaaccauaacugaugccagccagccuuguugcuauuugguugccuauugaagggguugcuauugaauaaauaagcaaaaccagacuaauggauaguuuuuaaccaauuguuuuauuaagauauuauguugagaaaauuguauaaggcuggguuuuuauaccucauggcauuuauguugacaugcaaauaucuuauuucugugagauguucagcugucccaguggaaguaaucugcauuguuuauuaaggcuuacauuaacuugaaugcuauuauauuguauuaaaaaucauauguauaguaacauccuuccugauauuuuauccauucuggguuguaacuucuugaguuggcuuugguauucuaaaauuuucagacuaaaaaaccaagugaucguauuuuuauuguuuagagugauccaugugcuuguguauuuuauaauaagggaacuuagaagcagaagugacauuuuagauuauaccuuucucauuugguaaauuaaagcaaaauuuuaauauaguuaauaacuagguuuauauucacaaaaugcugaaaguagauaaugcuauaaaaagauacauauacgacuaaaagagguuucauuauauauuuuaaaauauuagagggugagaacaaguuaauucuuucagguuaaaaacaauuuuuauuuucuuaacagaucuuccugauguaaaugauaaacaaagccaagccauaagugaucuccuagaagccauauauccaagaguggacaagagagaauauauuauuaagcuagaacccauagaaaccaaccaaaaugcaguguuucaauauauuucaaggacugauaacccugcugaagugaccgagucaagcaguacaccugaacaaacugaaguucaaauacaggagacaagcucagaacagcugaaagcaguccccgacgcagauacagagguggaggaggccauagagccuccuucuauagagacuguuguagaugaagcugcagcucccacugaggagcaaccucaggaaucacaggcugacuuggagacgucugacaguucugaccuuggucaccaguugauauguugucuuuguagaaaagaauucaauucuagacgagguguucgucgucacauucgaaaaguacacaaaaaaaagauggaagaacuaaaaaaauacauugaaacacggaagacuccaaaccagucuucaaaaggacgcaguaagaguguucuaguuucauuaaguaggagcuguccaguuuguuguaaaucauuugcuacaaaagcgaauguaaggaggcauuuugaugaaguucacagaggacuaaggagggauucaauuacuccugauauagcgacaaagccugggcagccuuuguuccuggauucugcuucuccuaaaaaaucuuuuaagacucgcaaacaaaagucuucaaaggcugaauacaauuuaacugcaugcaaaugccuccuuugcaagaggaaauacaguucacaaauaaugcuuaagagacauaugcaaauuguccacaagauaacucuuucuggagcaaacucuaaaagagagaaaggcccuaauaauacugccaacaguucagaaguaaaaguugagcuagcagauucuguagagucuucacccccuuccauuacccauucuccacagaaugaacucaagggaacaaaucauucaaaugaaaaaaagaacacaccagcaacacagaaaaacaaaguuaaacaggacucugaaagcccuaaaucagcuagcccuucggcugcagguggccagcaaaaaaccaggaaaccaaaacuuucagcuggcuuugacuuuaagcaacuuuacuguaaacucuguaaacgccaguuuacuuccaagcagaacuugacuaaacacauugaguugcacacagauggaaauaacauuuauguuaaguucuacaaguguccucucugcacuuacgaaacccgucggaaacgugaugugauaagacauauaacugugguucauaaaaagucaucucguuaccuugggaaaaucacagccaguuuagagaucagagcuauaaaaaagccuauugauuuuguucuaaacaaaguggcaaaaagaggcccuucaagggaggaagcaaaacauaaugacucaaaacaggauggcacuuccaauucuccaaguaaaaaguaugaaguagccgacgucgguauugaagugaaagucacaaaaaacuuuucucuucacagaugcaauaaauguggaaaggcauuugccaaaaagacuuaccuugaacaucauaagaaaacucauaaggcaaaugcuaccaauucaccugaaggaaacaaaaccaaaggccgaaguacaagaucuaaggcucuugucuggugaggaacaguuagaguuuuguucccuuucccccucaucgaacuaaacaaaaucauuuggccauaauuuauagcugguuccauuuuaacauuuuuuucuuccauaaaucguauggcaguaggaacuguaagagggaugguuauugcuuuuaucucucagcaaccuuuauuccaguaguuugggaacaaaaguugauuuuagaacuugccuuccacaggacaaugcaauguagcuguagguagaugacacagggucagugcuuuuguuuuuguuuuaauguuggaaaauauauacauuuauuuuggucuauguuuacauagaaaucucauguuuaacuaacuugcacaaguuuaauuugacucagucuacuaauuuuauuuagucuacuaauccuaaugcauuguaggaaaguuaaauauauuagaaugaacuuaugaaggagauaauuacaggaaaaacauuuuaaggcauuguaauuauuguaauuuuuuaaaaaugguuaaguaagguguagcauuagaaaaaaagucuccagauggaauuuagaaaaauuaacauuauuacuuuuagcacauuacuuccaggggaagggggaaguuaguaaacauacguuuguuaguuuguuucuuuucgggauuauauguuagugaguuuuuaaauuuugaucuauagggaagauuuuuuagguacauauauucuuguuucccuuucuguuuaauaaacuuauaaguggucauuucaauguaguuaguauuauucaguaguggugugugugugugugugugugagagagagagagagagagagagagagagagagagagagagagagggagagagagggagagagagggagagagagagagagagagagagaggagagagagauugauugauugugaccaaaaggaaagcaaaacccccuuuggaagagagaacaauucuacuuuuuaaaagaaauuuuggaacaaauuaaauauuauaaaaugugaugucaaauagggaguggaccuucuauacuuguuuuuguaagucuuuaucuuuaaaguuugccugcagcaucuaugucccuugcacuuagacauuuaacaucccuaguaguaaaugagucugagauacagccucuaaagugaaguucuuaguuugacugcuuaguaguagcauguucauguuaaugugguuugcuugucacacuguuuuuacuuguguggaaaacuuaagaugaaaccauccuuuagaagucauugcuguuguguaauuugaagacaagguuuuauugguaaacucaaaaguguucauuuauuccuauuucuccucagauaacuucaagugauguacgaaaagguuuggaguucauuuuuguggaaagacuuuaaguuguuagaaccacuaaacgucuucacaugguacuaugaggaaaaaaaagaacauuuucauaaaauuucaacuguaacugcugauacugacuaaaacaauaaccaucuaaccaguuucuaaggcaaugcccauuccagcacuuucgagucgcuguaauaucauauauugucuccauagaccuugaauauauggccuacaauuucuacaaaaauguugggaauuucacuuuccaaauaauuuguugauuaaaaugaucaacauccugaaggaaauaauaguuuucaauugauauaaacuuuguauuuuuagugguuuaaguuuauuuugcuuuacaugcaaaauuuuaucuagauuguauagauaaauaugauuuuuuguagagaguauguuaguaggaucaaaagacaaauuaguaucaauacauuaugaauauuuaguagccuacugaauauuuauaauuauuugaauccauuuaaaauuuuuucuuuagcacuuaaauguuugaaaguuuuauucuaaaauauauacuacaaaaaguuccaguucauuuuaugcauagaucauuauuacauuuaucauuuguaaacauuagacguuuuuaugaaaauuaaacauuccccuauuuuucuuuaaauuuuauauaaagcacuuuaaugauagaugcaaucuuacuucucaguuccuauuuuuuuaaagaacacacauuuacuacuguuuauaugaagguaauaaauagcuuacugauauuuuauagaugcagacaauccaugugcaaccacuucuuauguuucuauuuuauuucuuuaaguguugcuggaaaaggaagauagggguguccaucuuaguuuuuucucccaagcaaaaauuuuaaaugaccccuuuagauaauauuugaguccuacuguaaaauugaaaauaaugaauucuuguucaucuuuuguaaucaagauuuuaggaaaaaaagaaauacaucuaucuuuaugaaauuuuggacagguuuuguguaucaauauuuuguacuuuuagggaaauuuuauuuuuuaguaauuugugucaaauuauuuuaaaagguacugcagaaaauauaccauguuuuuauauagguucacagcuguacuuagaauggacccuguccaucuguauccuuuuuguauaaauuuuuaaauguugaagaucuagaaagucauaauaaaaugcuucuauagguagaaaaucauuuauccuucucagugcuuugcacuaaaauauacugugaaaggaauuuagacuguaauuguugcuggaaauguucuauauugaauguacauguuuauguuggaaaaauguacuauaugugaugaaauaaaccagacuaaaaguuauuucagcuaaaugugcuucaacauagguacauugguugaaacuuaaauguuuuauuaucaaacuuacucagugacuaugagcagcuacacuugaauuauauccugauaguuuuauuuuuaagaaguaaugauuucucuuuaauuuaaaaacagauuacuuuuccacagauggaaaauuuguacuuauaggucuaacguuaaugacuaauagccuaauauauuuagggaccaaauguguaguagguggcauuuaauuuauaaaccaucuuuauuaguugcacauuauuaaaccuguauuuuugacauuuucaagguguuaucuuuuugugcauuacuacacacaauacauccucuuugaccuuuuccagucuguuuugcuuguuaauuauuguaggaaagucagaaaaauaacuugauguuggaggagggaagagaauaccagaaauccuuuccuccacuuaugagcuucucaggacuauucccaggacaguuccucuguaauaauuccugugcuauagaacaggaccuuagaagaagaaagcacagguuccugugucgucaaaagauuucuuccucggccguuauagaaaagagaugcucuaucagaacuugccuggauuagaagcaccuaggugguggcauuuugucauaguagacagaagagaggcuaaauugggaccaguuugggucaaacaaggguauuugaaaguauugacuuuucuuguuccuuucugaccugugucccuacuuuuuggauuuauugugccgaaaccuuucugcaugcagucuauaugaauguuccugugacuuucucuuacuguaguguaaagugagguaguagucaucccaaacuguuuauuuauauuuagaccuguccuugauuauaaaagguuuaucgacuuuagguacuauuugaucaagaguuuuuuuuuuuuuuuucucagccagauaugauagcacaugucuauaacccagcacuuaggaagccgaggcaggagaauuuuaaauggccacuguagguaacauuugaucccuaauguaaaacugaaagcagugcguuccugucccucuuuuguagucaacauuucagaaaaaaagagauacaucuuuaugaaauuuuaaaauaaaaaaugucaauaauuuaucuuccuaaagauagcgucucuuccuaagugcgguguaagaacagaaacgguagcagauauaguuuauacgugagcuuguuuggaugggauaauacgcaugggaaguggaugaggaggucuggcugagagcagacgagugcucaugagaaugcacaggcugacaguggaauacacacacagggggauuugguguucauccuuugcuuuaagaagaaccucuuggaaaacaaauuauuaaguuuuaacauaguuuuguuuguaugaaacagguuuucguuugcacgggcugcuuuacuguugaaaagugccuucacauuuuuaaaaaguacuauauugauuucuaggcaauaaauucuucuacuaugcuuuaaaaguauggaugcagcaguggaaaccugugugguuugcuaugacuuuauaucaugaaagcagagacuuaccauauagauacaugaccacacacacacacacacacacacacacacacacacacacacacugauucccuguuguaacaucaaaauaucuucaaauagcaugauguagaaaugucccuuugacuuaggaauuggguuaauaggcuuccugcaguggccuacaagaauauuuuagauucuuauuuuggaguuguaaaaauuacaucucuaauagaauucauaguccauuaugaggauuaugauuuagccauaguuauagaguugaucugaagccaacucuacauaggauacauaguauaauguuggcucuacucuuagacaaaaauacuccuguguuuuucuuuguacgucaugguuuuaugagcuaaaauauacagauaggcaaucuuagcagcccauugauugcuucucaggcacuaggcacaugguaaaaugcagaauaagaccugcuuuccuuaaacuuacuaaugaguaauuucccuuucuaauucauccucccuuuuuaauuuaugucuaucauuuuuccccuagguucuagcucucaccuugccguuucucuucaguucgauuaaaagagaucauuagucccagauaguuaaaauauuuggagcgacaagagcauguggcccauuuccuuuuguaucuucauuguuuucacacuggauuugggaggaggaguguuuucaggcuucuuugacuauguuugauaaccauacauuuagaagcacaaaggagaacuuaaaaaccauacacgcaucuuguuaggaagaaagcucaaagauaaaaguuuugauguuuguguuuauucugcaaucaguugguuuaauuguauauuuuugaugucaggggacugauugugucuugaguucauauaguacucaacacauuuuccuauauaucuaagcccccaagggguuugccuuguagcucaugcuggccucacauucauaauccuccuaacuuagccucccuaguguugggagugcaggugugugcuacggucuuugccccccccccauuauguuaauauugcugaguuuugcuuacuaccucuaagaagaguuuaugaaaacaaagauaaguccuagucauagcuaauaauauuuauacaguacucguaugccaggcauucugcuaacacuuuguauacauaaugccuguaaacccuacugauagacuuaugaaguaagaccuguuucuucauuauuacuaugguacagaaagaaaacugaagcuuggagaaguucaguaauguauucaaaccaaaguguacauccuuagucaacccaaccuuaauguuuacaaauuucaucaaaugcaaugcaguucacuacauaguuaccuuacuggcagcauauaauauuucaucauaugcagugcaguucaccucauaguuaucuuacuggcagcauguaaugagcugaagcuagacuaacuguuaaaauuuuggauuuauuccucacgugagcucugcaaauccacucuggcauuuucugcuuuaguuauugcaccuaugaaauuggaccaguguauuuuacuucauggguuuuuuucccccugaggagaagaugaaaacuacaugcaaaacucagagaacauugucuagcauguuauaaauguuagauguuaucuguuuagagacgauuuaaauggcacagggcagaugggaacuuuauuauuauuacuaauuaaauuuagauggaaacuucugcaugggaagagaacuuuguuacacaccaguucuguugcuuuuguaagacaaccaacauauuugauaucaauucuccucuaaucagauguuaguagcuuaucuuuccuaguuauuuuuuucauugcucuuaaaaagauacacgggaguuuauuuuuucuuuuucuuuuuuuuuuuuuacauuaucucuaauacuuuuuauugacugucaucuggaucuuuuuuuuauuagauauuuucuuuauuuacuuuucaaauguucuucccuuuccuauuuuccucucugaaaauccccuaucccuuccccuccuugcccugcuccccaacccacccacuccugcuucuuggcccuggcauuccccuauacuggagcauagaaccuucacuagaucaagagccucuccucccauagaauguucauuguaaauuaagguuugguuuuauggcccucucucauaaccauucaucuguuucaaaaaucuuguuggcaucuguucugagacauaaauauuuuuggucaugugaaaaauacugacauggaacaaauacuaauugaagaauauuguuggauuuuuaaaaauaaaacaagccuuauagauaaguaguacuauuugaaggcauucucuuauauggacagaauagauauuuuaggagcacucuuccuggauugggaauguuugaauguuaggaagaaguaaagaaacagcacucaucagaagccaguccagugguagucagugaaggcaguacuccgaaucucagcugagguccugcuguuaaaauuacuggcugggagaguuuacucacaaaccugaccauucuugaucuuguuuuuuggucuuggcacuuuuguuguuccacuuugcaucucuguggguggggugggggggcacggggauugaaaucuuaaagaaauguggcugcuuuuguuacuuuuuuguaguggugcugagaauugaguccaugaaccuuaugaaugguagggcacugaauggcauuuuuagccccuucuauuuugauagggucucacuguguaccuuagaggggccugaaacuugcuauauaguccaggaugaacuuggacucaagauuguucugccccucaguguucugggugcugagauugcaggcuuaugccucucaugaugaucugguacucaaaugcucgugucuaguaucugaggcauauuucuggcaagugaaauaaucuuuaagugauagaaugauaugguuaaauuaucuaccucucagaaaaaccaaaaucccuauuuggaugcuugagcaauaauaacuagccuucugccuuuacuguuccauguggucugcaacauuuagaguaucucacaauguuguguauggaugagauauuacuauuuaagaauuaacuuuaaaagacuauaguuuuccuuauaauuaggguuuugaauauggaacauugaucucuuuuauuugagaauauacugaaaauaaauuagcugugagaaacagaaccauaucuuucaguuggacauucucaguuccgcaaacgguuuuaagaaauaguugagauucuuauuggugucuuggcaacccugaacucaaaaguaugugcuaauuuugacugguagcuuucauuuugaaugggacuagaaaaggaaggaauaccuguaagagaaaaaggaaugaugcacuagagaaaaagaaaugaagcaguaggcacaggaaauugaauuacagggugaggugaaguuugggaguuuagggaaagagcuuccuuuagcuuuuugcauagagguacuuagagaaauaggacuuucuggaggagaguaguuuucauuuuuuuuuuuuuuuuuugcuuacuaaauauauguaguuccauaguauucugcccacugggcaucuguggguuucauguugagaauaucugaucauuaucuuuuguguggacaggguucagggugugagacagccagugggucucuacuuuuucauaagagaccuucauauuuuccaguugucauuucuuugcuugaccacuuugacuaaucaacauuuauucaaugugauucugagaaaaucaguucauauaccacaaaaauccucacacaaacauuauauacacacagaugaaggagcuuuuaaaugagauaguuuuguuucuuaaaacuauucuggagcucuuguuaauacugaauuguuaauauugaauuuauaaugaagaguuacuuuuuugugugugcauauguguacacacagauguguguuguguaucuguuuguguaaaauacauaugcaggccagagguugacaccaggugucuuccauaauuguguucuacuuuuauguuucgagacaggucuuucacugaagcugguucuuacugcuuagcuagacugaagcuggcuuggaagaaacugccuguuuuucccaaaucuccaucccuguacuggaguugcauacacaggcuuccaugccuaacuuuuccuguagcugcuguggagcugaaucucagcccucauggcugcacaacaggcacucuacucauguccuaagaccuaaguugcuaaucuuuaagguuuaucauucuuuuugagcuucucucucuagacuagguaacuaggguucauuaacacaguaucuaagccacaggaacuauaaaauagaugggagaaucagaaggcuugaauugccagcuaccccccagcuugucuagugucuaaaaguggaugugugagugugugugcacucaaaaaacagcuguuaggaucuuucauucuucuuuuugguugcaagcauguaauuuuguuuggcuuguaucugguaaggggaggagguuuuucugaaaguuuuaugugaaaaacauaagggagacagaaguggccaggccuuguggaaauccagacaaguuggcuucacuagauuuucacuagguaggcgauaugauaucuaauggggaaaucgaggcaacucuagugauuggguauugcagucuuggcagcaagaaguacugugucucuucuccuagcucuucuaagacuaaaaagauuucucacucugucuucucaauauauuuguagguacuucucaccuuucuggcaccuuuuaucuguuuucuuucccuguguagcuuuggcucagucucuuaauggaaaauaugauuaguugaauuagguauauuugagcaaauuucucuuucaugcuggcuucauagguugcuggcuugucugcaguguggucuuugggcaggcuuucucugcugguccuaccaugcggucauuaugggaaagucaggagcauaaaacaugguccugagcccagcagaaggaaucgugauggaaauauuuaaaggauauugcuacaauuaggguuugaauauacaugaaaacauuagcauugaaggcggcagguguuugugacugcuacacuaaugcagcauuaaugguccuucucauucucugcgggggaguuuuggccaguguuuguaguucuucugaacugccugcugcauuaccaucucuggcugugcagagucauagaaauccuguuauuuucauggagaaagagcucuuguguuuccuauggcagcauuuaggucauucugucacaaguuguuacagacaucccauuacacuguauaguuucagcuagcaauuuaauucuaaaauucgauccuaaaauuuuaagguauuguucuugcuuuucugucuuauguuuuuggaauuugacuuacuaugauagcugauuucuguucgguuagucuugauguaccugacaccauucuguacuuuuggugauaagagucugcgaacuuagguugaagucuuggcucauuuauuuacagcuucgaaguguggccaaguuacguaucaacuucaaauuucuugucuauaaaacaaaaaaaaauaauauuagaaacuaucuucuauguagguuuguugugggaauuuuauaaauuaacuauacaguauauauaaagaguuuauauuguauuuaauauacuuggucuucuuucccucuuuuaagaguccaaaaacacuagugacucuuguagugaucagugaaguugcuaucaaguuacugcugaaagacuuucuagcaccuaguuucugguuaucuugcuuggccauauguuguucguuagccuuuugagggagcaucacucuaacuguuuaguguaaagucagauguaacaucuaugauaaagccaagauacacaguaguuuauuaaguuagagcaaaccguuauuuuaugggccuuaaauuugggcuggagcuugaugcuguuuuuggcagaaccacuuaguacuugcuucuuaacuguuaguaucuuauucaacaauguauaguucuaagucaugaaauucagggaagcacucccccacucuauuccucucucucucuuuucccuauuucucucuuucuuuacucaucuucuccacuccuuuuuccugguaaacauuaggcuguggguguaagaccauauuuacaggcaaguauugccagugcuuugugcuauaccuggcacauaacagguauuaagagauuguuaaaagaagggaagaaaagaaccaggacaucaguuucccguuuaacaguacuccacagucugucuuggcuuuuguucaucaucuaauaagcacagccuuuaaccaugagcugcuauuuaggucuguuacugugguuuccaucuacuuucguugugugaaucucacaauuguggcacugcuauuaaguagugcuugcaaguucaaacuuacagaagugcuauauugacuaaugcucuguaauugcacacuguaugaguaugcuuuuaauaacuuugauaaauuuuauuuuaccuuuaaugcauacuuauugaauuuuacaaaaugcaacucacuuuugcaaugaauuauuguccuuucuagcacaucccucuuuuaugaguucucgaauaguucucauaucugcccuuccgguuaccuggcuaaucagaauccuggaaaugauguugauguuccccuccacucuugcuggcaucacggaucaguguguaucaugauucugaagcuucauguuuagcuccugcuaucucucccauuaguaguuuaguauagaucuugucucuaacauuccguuuuguaagucuuuuaaccaacccuguuuccucucuuuccuccaugcuguugccagagcugauuuccuaaacacaggugugugcuguguguucacuacuuaacugauugacuuauccuucaaguagcagcuuaaauguugcuucucaauaaaaugugucucccugaauuucaauaucaucuuuuccuaguguccuccaaugguguuuguaaucaugcuuauauugucaauugauuuguuuaaugugugucuuucuacugaaaauguuuauguaagggagauggugacuuccauguuuagcacauaguuggaacauagugguaguuaaaaccuguugaaaaaauaggugaaugagaacuuaaggauauuacaggacccuaaacucuuuacacuuacagacauuaguuuguagugcuagccucucugauauaauaaugggccucuuucuuuugucuuuuacauuuaucccugcaaagauagguguuacacugccccacacuccacuauagugaaagaaauguggacccuuuccuaaccucagaaucuugauucaguuaaagagcucuagagucgcucuugucucaugggguaaucucacuucugaggaaacucugucagguaacagucuuuauuagguaaucuuccugugcauuuuccucagaaauccuuuugggagagauggcuuuuaagguggggcuuggaauaauugugucuauauagcaguccugcgcuccuugaggucagauaccuugcacagacuuucaguguguaccuucuguuuuuuuagcaucuuaggagauaauccauuuagauuguuauuucuggugacagcagcuuucccucaaguucuaaggcuuaaaaacaaaaugacugaauggugaccuuuucgaaagguacacuuccuuuacaagccaugguuguuccuccaggaucaugcugaguaagggauacuuggaacacacagaaugagucagggcggaugaaugaauucauugguuaaaucuacguggccuuuuaccugguuaaaaauucuucuuuuuagaguuguuuauguuuauaaaauauauauggaugguuuuucugcaggugugucuguguaucauguguaugccugcugucugcagaggccagaagaggugguugaauccccuggagcgggaguuacagauugucguuagcuacaugugggugcugggaaucaaaccugguccccuggaagagcaaaaagcguuccuaaccauugagccaucucuucaacuccuccucuguuauuuuaaguacacuugagccacuacuuugugccgaaaggacagugccaagcguucuagggacugaaaaaaguaguauuacuuuuuuauucucaagaaguuuaaauguugacuuuaaauuacagucuuuaauuugagcuauguguuccaaaguacauuuucauaucauauuucuuaaucauuacaaaaguuuugaauuaucuuccuuuuaaaacguuauuuaguuuuauauucucuuucuuacaaagauauucuuccugauuguucaccuuagaaaugagagucgccugucuucuuccugccugcaaaccagcauuagccucugcccucuucucucagcccuuuccaucucaguucugcccuuccuuuccugagcucugcccucucuugacuuagagcaccugugucaugucugaagcagcuuaaugacuaaguugauaaccauccuagccagccauuuuguacuuacaugcuagccaccucagucuggaggcagagguuuacuggaguggaaagcccaagccacacuccuacaggaacuguagacucuuugagguuucccucccaucucuucucugaggacuugcuucccuugucuccaggccaguuggcgaugucccuucaguauaucaguuccacuuuacaucuucuccucuucagcaauuacugcagugagguuuuuaugguggggucucccuaacuaggaacaccauuuaaaggggggguguauccauuuguccugugucuucagugcccagcacagaaucugcuacacaacauguaaccaguaaauaguaucugugcaggaaaugaguuuugaguggagucugccaguuuaggguccucuaaaacuucuucagaaauauuccauggccauuucuuuauaagaggcacuguuaauguguaucuuuauuuaugacuuaauuuagacuacacacauuuguauccuuggauugcauggcucuaaugacaaucugugaaauuauuuuuuucauacuuugguugaguaauacaaauaauauuuuucucuuggaugauucuuaccauguugcuuaaaaaaucccccaggguuguuguuuagaauguauuuuguuccaacaaagagccugaguggauggaucucuuuagaacagugguucucaaccuuccuauugcugugacccuuuaauauaguucucaugguguggugauacccaaccauaaauuuuucuucauugcucuuuuauaacuguaauuuugccacagucaugaaugcaauguaaauaucucuuuuccaauggucuuagcugaccucuguggaagaguccaccuuaccugcacccccaggaguugcaacccacaugcugacugcuuuagagucaggcauccuuccugguugaccucaucuuuucuguagagacaggugagugcaaaggacacaaaucaccauuugucauagguuacaauauagagugccuauaauauuuugaauacauaaauucuuacuuucaaaguacaagaggaguuugguuuuuaaaggaagucugugaggccaguuucuuguguuauguuaggugguuguuuaaccagaguaugaauuugaacugccuguguaaaacuaaaaacgauaacagguacgugggcuugcuuucuccuugucuauauacugugguuucuggugguggcagcugacccuauggacaaguugugucuugucugaaaugcuugagaccugaacugccucagaugugggauggcuuuggacuguggauguuuccauaugaaaugacaggacaccugaugggaucuagcaucgaaacugaaguccauuuuuguuuuguagacacucuaccugcagucugaagaugauaguuacuaaguaucuuuaaugcgguugcguuuugauuaugagccaccauaugaggucagguuuggaauuuucuauuuguguugucauuggcauucaaaaaguuucugacuuuggauuucuggaucuguauccuguuacauguuuuaaaauguugugaacuucuaccaugugucauagcccuagauccuuuagccuccuaucaccaacucuagugaaauugaguucauuucaguucuuauuagcaaagguaauugaguuauuucaagacuaugaaacuguguacuucuguacugaauacaucuaaaggaccugaagcaaaaccgagcacgaguuuuguuuggggcugugaugcaugagaggaaguuugccauuaugacugcagugcagugggaguugaagggugguguagaguuguuucccuguuccuggugcaugagugggugguagccuaggcaugcagucgggcagguguuugcuagcuccaguuagcccagauuccugacugagucacacuguuguaccacauguuagugaaagaguuuauuacuugugggacaaguugugucugaaguuugauauuuauuucaauuuaaagauuacaaguuuauuuaaacuuuaaugaguaggagaugaaauaaacauuaaaauaacaguggagaaguuaguauuacaguaauaaguaaauuaaacauuuuuuguguugauauuuagacagagacuuguaguauggaacuuauuauguagcuuaggcagggcuugaacacaaauccuccugccucagucuuucacaugcugauaucauaguuauaugccuugauuaaauaccccccaaaccccacagagcauuuauucagcuaucaaaagccaaagaauuucuugggcuacguauucuacagcuucugcuguuguguguuguucaucuguauacaguucuguuucauuaauccuauagacauuugagcucagcuuuguguguguguguguguguguguguguguguguguguguguguguugggugcuaggaaacagguucucuguagcuccuuucaacuguugugagaggagugcacuguaaggacacaggugugaucuuaaggcccacugggguugggcaagccacuucuaauuccuaaguucaucccugaguuuugaaagaggcacaagaaauucccagauagagacuagaaacauuagauuaagaaaaggaguaugagaguaggcaauggcuaaauuuaagauguuauggacccaauaaguacuuugaauuauauuuucaagauuaggaguaaccauugaagaacuuuaaaugggauuuucucauagcaccgaggagauguguguguguguguguguauguauguauauauauauauauauauauauauauauagagagagagagagagagagagagagaaaagauguguauggucagaaaauuaauuaggaaccaacaacagccuguaagagugacauagcuuaaauucauguaaauggcagaauuuacauaauaucaauaagacuagagagaaggcugccaacacaauuucaggaguggaauuuucuggacgauggagauaagaaaugaacugggaugucuuccuguuucaggcauuggaguugggcagaguuguccaagguagggaggacaccgaggaggaggaggcgagggagugggcuaaguuuuagaugugcugaguuggaggugcucucuguaucuuaaguagaacuacucaacaggagaagaacacucagguuaguggucaggagaaagauugcccaugguagacauuuaggaauuauuagcauugaugcagauguggaagccacagguuuugaagaaauuaccagauaaauggucgagucacugguuuauuugguaauuuagggugauaccuaggucuuauguuuguauuucagugguccauuugggaaauagugucuggcuagcacugguugucuguggcucugucucuccuuaucuaacagugcauuugauauuaccucagcaguagugcaugaauuguaauagcaugaggaaauaugaguuaaucgguguguuuuacuuacucagagggcuucugagauaaaucugugauacuuacuuuaaaagaccaacuuuuucuuuuugccuuuuuguuuucuaaagaauuauuuauuuuaugucuaugaguacacuauagcuauuuccagacacaccagcagagagcaucagaucccauuacagauggcugugaguuacacgguaauuacaugguaauguuauugcugagaauuuaacucaggaacuauggaagaacaaucagggcuuuuaaucacugaaccgucucuccagucccaaaacaccuaucuuuuaaagauaaauauuuuauuuuuggggggauaaaacaauuuuuaguguuuuuggagggaacaagauuuucuuuugaugaaucccauaguuuuggaauguagguguucuugaacagucgcuaugccucugaccagacagcaauugacuguguuucaacucaggcagcauaaaguaggagcaaggcauagagaccuaaguuuuaaucuaaagcacccaggcagacaaagcuaggagcugcuggauguaccucuaaccccauuaucguggcgauagcuauauugauuccagaugcugccagccaggcuagcugaaauagaaacugagggggaucccggauguccuccucuggacacuugcaugugcauaaugggcacauggucccauacacucauguucauguaugacauacaucauacauaaagacuuuauuaaaaaguaggguauaauccaugugauuaauucaguauccauagcuagauuauaaaggagaaaagaugcuauuaaaggccgaacaagugauuuaaguaugucauuuuuuuuuuucagagcugcaucuuuugggcuggugaagucuuacauguuagaacauuguuguauacauugcucugaaccucacuguccuuucauugucuuaccuguuugaaggaagaaccuagcaguaggacuugcuuugaguuugggucugaacagucacccgaguugagaugaguguuuuucugagacaugggcaugcuugcuuacuguacaccaagguguccuuaggaugguucuccagguggcuuuucagaagucagcacuacuuaucauugagcccaggcauucaguacacaaaguguaaguccacaacccuuuuggggacugucuuuaaaaauaugauuuuaaagggaagaauuccuaggagacugugugugauguuucaguaaaguuuuauggacaagucaggacccuaaaacuuaagcucaacaauagaacgcugacagacaugaauuagaagauagaguaaagcuauucuuuuguucuuucaugaucuauaaacgaauggaguggggcuuauaauuucucauucaaauucuuuggaaguaguuuuuuuccccuuguguuuuaacuuugaauaaaucacuaaauauuagaacaaaggcccgauauuuccaucacacaacacaaaacagacugugguaucauagaacuguauuauaaacauuuauuuuuaauuuugugaacacugauccugucccaccgagcagucuucccauaugccaauguaugcucccgcaaagcacuagggcaugguuauauguguaauaguguacuuaaguguuugaagaauaacaaaaaccaguagaguuucagaauauguucucugacuugaggaccucacuuguuuaauggaauuuucauacaugugguucuuucuugccuguaugccaacauucaagagauuuuguuuggcaaaguuuugcaaggucuaucaguaugcucucagugauagcacacccauucucugucccucuaacagugagcaccaucaacauguaucauggauuuugcccguacuuguuuauacauugucucuuucuuuaccuuuuuaaguugauuacaaagauuaaucaguagauuacaaagauagaaguuuuuuuuuucucuuauuuuuacuuagaugacuuucuuuuuucacguaauaaaaacucaguuugugucauucaucaggcccaauguauacuuuuaauggaaaacuggcaccucuugacuuccugguuuugugcuuuuuggguggagcugauuucugagugugagguugugacaggaaauaauaugagguaccugcaagacaacacugggaacacuugccaaagguucugcguaacuauaauuuuucucgucccuaggacccugccuacagaaagguugcgucuagguguauguuggucuuguagugagccuacucacucagguccuuuaaaaaagucauuuauuugcauuuagauguauguacuuauaugcacacaugcugcuccuauccacagaggcugcaugggguuggauccucuggagcugggguugcaggugguggagcugcucagugugugcaacacuggggcccaaacgcugcuccucuggaagagcagcaagugcucuuagcuucagccagucagucuguguaucauucucuaaagaaaguugggcaacucaguguugaaaaaaauaauuuugagcauuucuaaugaacuuacaacuuagaagcaagccaugauaagcugaacucaccaucuaacuaccuucuuacauugccaccuucuaauuugaagagauuccuguuguugaucacuuuguccguggugucacugucccuuugcuggucauacagacuucagagccuguccucuguaaaucuguuccugcugguucuagccuacagagacuucuucucccaaugagguuugaacaucugccuuucuacucauuuucacuuuuauucuuuguaauauugcauccauauuaauuuuccuguccucgugaaucagaucuagcccuuggagaccaaggcuacuuauuaucaaugaguuuaacacaauggcauauacggcugucacugaaugagucgccaggcuguucccauuuaccuugcccugcaaggaaccagcugagcuuugguuucuucagaugcucuuccuccuggcgcugucuguguguuuuccuacuccggccgcuucucuguuacuguuaucuaaccuuuaaagaagauuagaaaugguuuuaggaaauucuugggcuaugaaaaucaaaggguucauuucagcauuuuuuaauuuuaggauuuacuuuuaaacugucauagaagucugccuucuuuguauguccgucuaauauuuguucauguccugggaugugcauguuggaggcgauaguuuggaugugcacuuaaccagaauuguacuugauacagaacagaaagaagagaaacacugucaggcuuggaaaccuggauuuucuuccaauucuugauuacugugcucuucuaccagccuucaugggacccgcaggcaguguaaauaaugacacgguguaagcugccgcagaggaaggcuuauaguuuucugcugccagcuggcauuguauguacaccuauuaagccguauucugcugaaguguagauggagauguagagccuuaguguaacuucguuuuagaauggagaaaacugauuggccaggccacguguagucaaucacugaaggaacagaacgaggcugucucauaaggacuguuuugauagguaaugugcaugucugaaaaagcagacugcaaaaagugguguuguggaaaauaguuguuucuccacuacaucccauucuuuuuuggacuucucuagaggugggcaguuaccaguguugugggcuuuuaagacauuugggcuguucuauguaucugcaaucauacauuuacauguuacccuaaugcaaauugcaacauaucauucauaguuuugguauuuuuuaaaaagccucuucaauaauauaucagaaaauuauagaguccagguauuuuuauguuuugaaaguccaugaacuuccugccuauguaucauuuaggcaacugggguuugcuaagccaaaugaacagauuucuaaaauaaucccuuauuucaaguguaucauauggaauaaucuguuuaauauaguauacuauuuacaucucuucuagagagaaacaagccauggacauggauugauuuuauaaugaaucaugcugauguugaaaauauuuagagaaauuuauacagcagcgauuacugcuaguuaccaaaaguagaaaucagaauauuugcuuuuuuguuaacaaagaaaagaaaggcagaaggcugggaauauagcuuagugguagugcacuugcauuauguaagucaggcccugaguucaauuccccugaacagaacaaaauaacaacagaacaaaaaacuaagaacaaaaugacaggaauucucaggaaauuaauuuccuuucagauuuuuauaaaaaucuaaaugguaaugugcaaauagucuuaggccagcgagaagcaaccccacuauaaauauuaagcugugugugugugguauaagcaaguaucugugugguuauguucuguggaagugcauauguggaggguggaggcuaacacugccuguuuucccaaauugcucuucacuuuguguuuugugaggguuucuccuuccguuuggaguucaucauuggcugggcugguuggcugagcuggcuggcgggcuagcuagugagcuccagagagccucuuguucccagcccgcuauggcugcuggggacccuaacucagucuucagagugaucugguuugggcuucucuaaagugacugggugcuaggggacacggacuguaucuagccucacaaguacuggcgugugaaugccacugagccacuucuucaguuuacacugggaaguagcagcuacagcggcuucucauagucacaauuugccccugguaggcaaauuugggagagcaaauuacaauuaguuuucuuuucuguuuccuuuuaaaaauauuuuuuuauugaaaaaagauauucuuuuguucauauaauauauucugauuaugguuucucuucucuacuccucccagcuccuccccaauuccucuucuaucuauccaccuccuuucugucuuucauuggaaaacaaaagguuuuauaagggauaauaauaaaacaagauauaauaaaauuagauaaaauaaaaacagauauauuggaaucggacagaagaaacaaagaaaagagcccaagaaaaggugcaaaaaccagguacauaugcacacccaagagucccaugaaaacacaaaacuggaagcuauaauacaugugcaaaagaccagcaggguaaaaaaggaggaaaaagaauagaguaaaauaaaagaaaaagcccugacaugacauugagacgaggaaccuucaaagaugccucugagcuuguuuucuauugggcaggcagccugcccuuaaaaauaguucauuuccccagugagaaucccuuggcaagagcuacauuuucauuugcaaauaauuaucaguuggagauaucuucuggauuaggcaugugccuacuucuccuuucagcucuacgacucccaucugauagaccgauguaggcccugugugugcugccuuagucugugagcuuagauaguguugauccuguugacuuagagggccucuuucccuuggugucuccauccccuccagcuccuacccgguccaguucuucacucugcacagugcccugagccuugagggggguggggggauuugagcgucaucccauuuaggguugaguguuccaaggucuuucacucuguuuaauaucugucugugggucucuguauuugcucccaccugccgcaggaggaagcauuucugacaauggcugagcaaguacugaugugaguauagcagaaugucacuaggagucauuuuauugcuacauuguuuugcuuuguuuuguuuguuuuaguacagagaauuucauuuucccagagguuccugggcuauggcuucuuagguucuugguuacacaguguuggguaugggcuccaucccauggagugggccuucaucagauacuauaguggucacucucauaggcuuugugccaccuuugcacucagcacaccugguuggcaggacagcauuguaggucaaaacguuuuguguuauguuugguaguguaagccgagugucuugauaaucauugagucagcuuagugauaaaacuuucucauaggaacaugacugucuguuacucaggcauucuaccucuuagaccaggccacacacauugaauacauuccuuaauucuugauuuuuuuuuuuacuuauggagguacagauuaucucacugggcauguuuguuuguuugguugguuuuugauuguuuuuuuuuuuaacuagaguuugacaaaacuuacuuuaauuuuaaaaaauggagguaaugcauaucaaaacacuuagugccugucaccacgcaaguaacugcuaaugucaaaaguaccgucagggcuaccucacuuuguuaaccccaggaucaaagagugccuuuugggccacuuuuguagacaacuguucuauuuuaucuuauauauauugaauaauuuucauucuucuaauucuuucgcauuugcuuccuuaauuuauccuuaaugcugacugucugaauuagggcaauaucauuucauucugcauuauuuuacaacguuuucuauuuaagauaucuauuauuuuaaaauuuuaguuccuuguacccuuccccaguuucucccaucuagaauaguaauuuuuugggauacaugaucuaauguuaugcuuggcuucauaauguauuugauuuuuguguuguauuuaaguagaugguaguugugacuuuccccagguaaccgugcucuuuuucaucucaggccuugcuugaauccucucuuauauggugaaaaguuauuuuuaaaaugguaguaguguguucuaguagcgaguuggccauaguguugggagauuaugguugaaaauuaagaguagaggcagaauguugcuuaauucagcaggcagcaguggcacugcugaugugacaaacacaaugggcaaacaagaacuuucuggcugaaugugaauacagagaagaugauucagaggagugagccagucacccugucaguaacaaaugcuguaguguucuccccacccuucuggaggaugggcuuauuagaggggaaaugguggagaagucacuauagacagacuuauagugugcuugcaaaacuacacaccagugugaaaauggucucagagggagaauuaagaagcagagagcggggagaaaggacccaaggggcugaagugguuugcagccccauaggaggaacaacaauaugaacuaaccaguacccccagaacuuccauggacuaaaccagcaaccaaagcauacacauggagggacucguggccccagcugcauguauagcagaggauggcuugucagucaucaaugagaggagaggcucuugguccugugaagguucuaugccucaguguaggggaauucgaggacagggaagcagguguuggggggcuuggggagcagggggagggaaaggggguuucagaggggaaaccaggaaaggggacaacauuugaaauguaaauaaaguaaauaucuuuaaaaaaaaaaaagaagcagcagagaacagaagaggagcaggucauuucagacccuagcaaugagagagagagagagagagagagagagagagagagagagagagagagagagagagaaugaauaugaauauguguguguaaugcagugguugcagggagaaaccuuuuuaauaaguuaaguggcaagaagagcacacaugggaaacacuuguuucuauuuguuuuuucuuuuucuucuucuucuucuucuuuuuuuuuuuuuaaaggaaauuagaguuaaauauuuuggcucaacuuucuaaaauaugguccaggaaagaaaaaugauguagguuguucaaguaccuuggggaaagcagacaguggugcuguuuuucuuuagcaugcaacugauaaaaccuguuuccauaauaccuguuuccaugucuguuuaguaucagcaaauaaacccauuucagaccuguggaagucggaaagacugucggcauuuucagauacgcuuaccucugcucuagcuuucagucccacuuacauaaauauuccaacggaagggaaaaaggcaggggggaaggccagaugguacaccugugauaucgggcacauagcaugggguuccgguuuggugagcaaaggacuuugcacaauauuggaucucacgauuuugcauaucagcagcagccacugucuuucccagaggaguugccaaaaagcaggacagaauauauuuucucuguaccacacagaaaauuucugacuuagcagcgugauaauuugaacuugaugggagaagauauacuguguagguauucuaauacaagucuuggaggaguuuggugucccauuauacaggcuaacuuaaacugccaaaaaaccauuguauagacguguugccucagggacagugacccaauugacaguaaagaugaaggacauuuugcugugauaaaggucagaucacagauuuaauaaguuaaucaaguaucaucaagaguuacuucuaagcaguugaaacuuacuccauuccaggcucuccccagccccugccccaggcagcaucaguuuuccacuuuugaaaaggagcaaugcaggggaagccacuguauggucuuacacguuuauaaacguucaggaagucaguuucuaguguggucuguacaagcuucuggaaggugaccauaucuuuaggcagaaccucagacucgucuuuggcucuccucaaagguuaacaacuauuuauucaucuaguguggggacagugggaugcuuuuauguaucugagcagaggaaugacaggaaaugagaaggcuccuuugaagacugaaaagcaaagccuuggccuguguacagugacagggagucaggugagccuugggcucugacucauccuaauaauaggaaaguaauuuucuagaugcuccuucucagagaugggaaccuuauguuauuuauguuugcuguuacugucugagaaaggccccuaagacacaauguacauuccaaaauauuaaauugaaaccaggccuggcaagauggcucaguggauagaggugcuugguaccaagccugacaaccugaguucaaucuuuggaacccagugguggcaggagagaagcaacuccuaagccggcauccagccuucacaugcccuggaauacaaacauaaguaaauauuccuaaguuguuauccagccuucacaugcccuggaauacaaacauaaguaaauacuccuuaaaaauaguaaaaaauaauaacuaacuugaaaucacuuagugaugguuaagacuuuuaaaaaagauuuuaucauacauauacauauauauguguguauauauacauguauuacacuguagcugucuucagacacacacacuagaagauggcaucagauagauacuuuuacagcugagccaucucuccagccccaauggauagacuuuuuaagagcuaaugcuuuuaacaaaagcuccugccgccuucauuuugcucaagaaggaaguuaacaacaaaugcuugguuucuugggauuuguucuuuucauaaauuuuauuuccgacaugugauauguuuguuuguuuguuuguuuuuacuaaaguuauaccucuagguaugaugauucuauccaaaacuuucagaaggcaggaaacuuucagggcaguaugacuaauuaugccaucaacuuaagcaacaaagcgagcgcauucccacaaacaccuaacccuagauuugcuuaucacugaauagaauccaucugacaacugagguugcuuuaguuuaaaauauuuuugaagcuuauauuacaauggauuuucuaucugauaacaaagcccugggcacuugucuauguuauuaucccaugugcagauuccuggaauaauuuagcaaaauuauuccauuuagucauuugcucauuuaguuauaaaaugcauuauaacuaaaagauccauauuuagcuaauaguuccuuuauucuuucucaguuugagugcuuucaguagaaaccauuacagaaacugaaacacuggcguucacuaaaaugucugcuccaaaagcaugggagguuuuucuguuuuuuaguauaccgugcucccaaguccauauuaauuauaaguugaaauuaacuuugcaaaaagaccagaaaacuuuuauuuuccucaaguaaaaaugaguugaauaagaugaaguauaauuuuauaaaagacagugcuuuugauucacuguuaaaaguuuacgggacaaaauacucugaaauauugugauuuauacagcgcuuagaguaaagacaagccaugucgucgaacccauuccuuaaaagcucuuuaugccuaccccucugcuacccuagaaaacauuagcuuuauaaauucauaagugggacgaaaguaaaaagucauuaacuuuuuauucuaauaguaaaauacauuuauuguguaaauuuggaaauuacaaauaaaaugaaaauaaagacuaucugaaguaccgaaagguaacaacacacuguugugguuuuucuccaucacguuuaaauuuguguucucugaauacugaaguacauacauacccucauacccugcaaaugcuggugaaauggaauuuuuccucgacugcuuuuucauauuguuggacuguauuucacaacaucuuauuagcaaguuaguuugugcuauaagauuaugauacuuuauguuuggagaugaacauuuuccaauuuuucuuccucuucuuuccccauuuucuauuauguugcaguggacacucuuugaaauuuuguaguuaugcuuuaagggaacauuuuuuaaaagacuuucugggucagggguuaucagcuaccugggguuugaugccugcaacccugccuguuguggagugccgcggggugccgggcuccugggcgcagcuuuaccugaagggugcgggguggggacgcggcgccucggccccgggcugcgcgguucccgcccguugcuaaccggcgugucuuugucuuucuucccugggguucgcugcgcccgugcgggccgaagccuggcgaagccgucgccccgcagcgccgccauccugcguccgcccgcgggcgccgucaccacgcgccaggccgccuccagcugccgcgcca

SEQ ID NO: 2859 - RNA, 7006 nt, Mus musculus
uaaagauauuuacuuuauuuacauuucaaauguuguccccuuuccugguuuccccucugaaacccccuuucccucccccugcuccccaagccccccaacaccugcuucccuguccucgaauuccccuacacugaggcauagaaccuucacaggaccaagagccucuccucucauugaugacugacaagccauccucugcuauacaugcagcuggggccacgagucccuccauguguaugcuuugguugcugguuuaguccauggaaguucuggggguacugguuaguucauauuguuguuccuccuauggggcugcaaaccacuucagccccuuggguccuuucuccccgcucucugcuucuuaauucucccucugagaccauuuucacacugguguguaguuuugcaagcacacuauaagucugucuauagugacuucuccaccauuuccccucuaauaagcccauccuccagaaggguggggagaacacuacagcauuuguuacugacagggugacuggcucacuccucugaaucaucuucucuguauucacauucagccagaaaguucuuguuugcccauuguguuugucacaucagcagugccacugcugccugcugaauuaagcaacauucugccucuacucuuaauuuucaaccauaaucucccaacacuauggccaacucgcuacuagaacacacuacuaccauuuuaaaaauaacuuuucaccauauaagagaggauucaagcaaggccugagaugaaaaagagcacgguuaccuggggaaagucacaacuaccaucuacuuaaauacaacacaaaaaucaaauacauuaugaagccaagcauaacauuagaucauguaucccaaaaaauuacuauucuagaugggagaaacuggggaaggguacaaggaacuaaaauuuuaaaauaauagauaucuuaaauagaaaacguuguaaaauaaugcagaaugaaaugauauugcccuaauucagacagucagcauuaaggauaaauuaaggaagcaaaugcgaaagaauuagaagaaugaaaauuauucaauauauauaagauaaaauagaacaguugucuacaaaaguggcccaaaaggcacucuuugauccugggguuaacaaagugagguagcccugacgguacuuuugacauuagcaguuacuugcguggugacaggcacuaaguguuuugauaugcauuaccuccauuuuuuaaaauuaaaguaaguuuugucaaacucuaguuaaaaaaaaaaacaaucaaaaaccaaccaaacaaacaaacaugcccagugagauaaucuguaccuccauaaguaaaaaaaaaaaucaagaauuaaggaauguauucaauguguguggccuggucuaagagguagaaugccugaguaacagacagucauguuccuaugagaaaguuuuaucacuaagcugacucaaugauuaucaagacacucggcuuacacuaccaaacauaacacaaaacguuuugaccuacaaugcuguccugccaaccaggugugcugagugcaaagguggcacaaagccuaugagagugaccacuauaguaucugaugaaggcccacuccaugggauggagcccauacccaacacuguguaaccaagaaccuaagaagccauagcccaggaaccucugggaaaaugaaauucucuguacuaaaacaaacaaaacaaagcaaaacaauguagcaauaaaaugacuccuagugacauucugcuauacucacaucaguacuugcucagccauugucagaaaugcuuccuccugcggcaggugggagcaaauacagagacccacagacagauauuaaacagagugaaagaccuuggaacacucaacccuaaaugggaugacgcucaaauccccccaccccccucaaggcucagggcacugugcagagugaagaacuggaccggguaggagcuggaggggauggagacaccaagggaaagaggcccucuaagucaacaggaucaacacuaucuaagcucacagacuaaggcagcacacacagggccuacaucggucuaucagaugggagucguagagcugaaaggagaaguaggcacaugccuaauccagaagauaucuccaacugauaauuauuugcaaaugaaaauguagcucuugccaagggauucucacuggggaaaugaacuauuuuuaagggcaggcugccugcccaauagaaaacaagcucagaggcaucuuugaagguuccucgucucaaugucaugucagggcuuuuucuuuuauuuuacucuauucuuuuuccuccuuuuuuacccugcuggucuuuugcacauguauuauagcuuccaguuuuguguuuucaugggacucuugggugugcauauguaccugguuuuugcaccuuuucuugggcucuuuucuuuguuucuucuguccgauuccaauauaucuguuuuuauuuuaucuaauuuuauuauaucuuguuuuauuauuaucccuuauaaaaccuuuuguuuuccaaugaaagacagaaaggagguggauagauagaagaggaauuggggaggagcugggaggaguagagaagagaaaccauaaucagaauauauuauaugaacaaaagaauaucuuuuuucaauaaaaaaauauuuuuaaaaggaaacagaaaagaaaacuaauuguaauuugcucucccaaauuugccuaccaggggcaaauugugacuaugagaagccgcuguagcugcuacuucccaguguaaacugaagaaguggcucaguggcauucacacgccaguacuugugaggcuagauacaguccguguccccuagcacccagucacuuuagagaagcccaaaccagaucacucugaagacugaguuaggguccccagcagccauagcgggcugggaacaagaggcucucuggagcucacuagcuagcccgccagccagcucagccaaccagcccagccaaugaugaacuccaaacggaaggagaaacccucacaaaacacaaagugaagagcaauuugggaaaacaggcaguguuagccuccacccuccacauaugcacuuccacagaacauaaccacacagauacuugcuuauaccacacacacacagcuuaauauuuauagugggguugcuucucgcuggccuaagacuauuugcacauuaccauuuagauuuuuauaaaaaucugaaaggaaauuaauuuccugagaauuccugucauuuuguucuuaguuuuuuguucuguuguuauuuuguucuguucaggggaauugaacucagggccugacuuacauaaugcaagugcacuaccacuaagcuauauucccagccuucugccuuucuuuucuuuguuaacaaaaaagcaaauauucugauuucuacuuuugguaacuagcaguaaucgcugcuguauaaauuucucuaaauauuuucaacaucagcaugauucauuauaaaaucaauccauguccauggcuuguuucucucuagaagagauguaaauaguauacuauauuaaacagauuauuccauaugauacacuugaaauaagggauuauuuuagaaaucuguucauuuggcuuagcaaaccccaguugccuaaaugauacauaggcaggaaguucauggacuuucaaaacauaaaaauaccuggacucuauaauuuucugauauauuauugaagaggcuuuuuaaaaaauaccaaaacuaugaaugauauguugcaauuugcauuaggguaacauguaaauguaugauugcagauacauagaacagcccaaaugucuuaaaagcccacaacacugguaacugcccaccucuagagaaguccaaaaaagaaugggauguaguggagaaacaacuauuuuccacaacaccacuuuuugcagucugcuuuuucagacaugcacauuaccuaucaaaacaguccuuaugagacagccucguucuguuccuucagugauugacuacacguggccuggccaaucaguuuucuccauucuaaaacgaaguuacacuaaggcucuacaucuccaucuacacuucagcagaauacggcuuaauagguguacauacaaugccagcuggcagcagaaaacuauaagccuuccucugcggcagcuuacaccgugucauuauuuacacugccugcgggucccaugaaggcugguagaagagcacaguaaucaagaauuggaagaaaauccagguuuccaagccugacaguguuucucuucuuucuguucuguaucaaguacaauucugguuaagugcacauccaaacuaucgccuccaacaugcacaucccaggacaugaacaaauauuagacggacauacaaagaaggcagacuucuaugacaguuuaaaaguaaauccuaaaauuaaaaaaugcugaaaugaacccuuugauuuucauagcccaagaauuuccuaaaaccauuucuaaucuucuuuaaagguuagauaacaguaacagagaagcggccggaguaggaaaacacacagacagcgccaggaggaagagcaucugaagaaaccaaagcucagcugguuccuugcagggcaagguaaaugggaacagccuggcgacucauucagugacagccguauaugccauuguguuaaacucauugauaauaaguagccuuggucuccaagggcuagaucugauucacgaggacaggaaaauuaauauggaugcaauauuacaaagaauaaaagugaaaaugaguagaaaggcagauguucaaaccucauugggagaagaagucucuguaggcuagaaccagcaggaacagauuuacagaggacaggcucugaagucuguaugaccagcaaagggacagugacaccacggacaaagugaucaacaacaggaaucucuucaaauuagaagguggcaauguaagaagguaguuagauggugaguucagcuuaucauggcuugcuucuaaguuguaaguucauuagaaaugcucaaaauuauuuuuuucaacacugaguugcccaacuuucuuuagagaaugauacacagacugacuggcugaagcuaagagcacuugcugcucuuccagaggagcagcguuugggccccaguguugcacacacugagcagcuccaccaccugcaaccccagcuccagaggauccaaccccaugcagccucuguggauaggagcagcaugugugcauauaaguacauacaucuaaaugcaaauaaaugacuuuuuuaaaggaccugagugaguaggcucacuacaagaccaacauacaccuagacgcaaccuuucuguaggcaggguccuagggacgagaaaaauuauaguuacgcagaaccuuuggcaaguguucccaguguugucuugcagguaccucauauuauuuccugucacaaccucacacucagaaaucagcuccacccaaaaagcacaaaaccaggaagucaagaggugccaguuuuccauuaaaaguauacauugggccugaugaaugacacaaacugaguuuuuauuacgugaaaaaagaaagucaucuaaguaaaaauaagagaaaaaaaaaacuucuaucuuuguaaucuacugauuaaucuuuguaaucaacuuaaaaagguaaagaaagagacaauguauaaacaaguacgggcaaaauccaugauacauguugauggugcucacuguuagagggacagagaaugggugugcuaucacugagagcauacugauagaccuugcaaaacuuugccaaacaaaaucucuugaauguuggcauacaggcaagaaagaaccacauguaugaaaauuccauuaaacaagugagguccucaagucagagaacauauucugaaacucuacugguuuuuguuauucuucaaacacuuaaguacacuauuacacauauaaccaugcccuagugcuuugcgggagcauacauuggcauaugggaagacugcucggugggacaggaucaguguucacaaaauuaaaaauaaauguuuauaauacaguucuaugauaccacagucuguuuuguguugugugauggaaauaucgggccuuuguucuaauauuuagugauuuauucaaaguuaaaacacaaggggaaaaaaacuacuuccaaagaauuugaaugagaaauuauaagccccacuccauucguuuauagaucaugaaagaacaaaagaauagcuuuacucuaucuucuaauucaugucugucagcguucuauuguugagcuuaaguuuuaggguccugacuuguccauaaaacuuuacugaaacaucacacacagucuccuaggaauucuucccuuuaaaaucauauuuuuaaagacaguccccaaaaggguuguggacuuacacuuuguguacugaaugccugggcucaaugauaaguagugcugacuucugaaaagccaccuggagaaccauccuaaggacaccuugguguacaguaagcaagcaugcccaugucucagaaaaacacucaucucaacucgggugacuguucagacccaaacucaaagcaaguccuacugcuagguucuuccuucaaacagguaagacaaugaaaggacagugagguucagagcaauguauacaacaauguucuaacauguaagacuucaccagcccaaaagaugcagcucugaaaaaaaaaaaugacauacuuaaaucacuuguucggccuuuaauagcaucuuuucuccuuuauaaucuagcuauggauacugaauuaaucacauggauuauacccuacuuuuuaauaaagucuuuauguaugauguaugucauacaugaacaugaguguaugggaccaugugcccauuaugcacaugcaaguguccagaggaggacauccgggaucccccucaguuucuauuucagcuagccuggcuggcagcaucuggaaucaauauagcuaucgccacgauaaugggguuagagguacauccagcagcuccuagcuuugucugccuggg

SEQ ID NO: 2860 - RNA, 7006 nt, Mus musculus
cccaggcagacaaagcuaggagcugcuggauguaccucuaaccccauuaucguggcgauagcuauauugauuccagaugcugccagccaggcuagcugaaauagaaacugagggggaucccggauguccuccucuggacacuugcaugugcauaaugggcacauggucccauacacucauguucauguaugacauacaucauacauaaagacuuuauuaaaaaguaggguauaauccaugugauuaauucaguauccauagcuagauuauaaaggagaaaagaugcuauuaaaggccgaacaagugauuuaaguaugucauuuuuuuuuuucagagcugcaucuuuugggcuggugaagucuuacauguuagaacauuguuguauacauugcucugaaccucacuguccuuucauugucuuaccuguuugaaggaagaaccuagcaguaggacuugcuuugaguuugggucugaacagucacccgaguugagaugaguguuuuucugagacaugggcaugcuugcuuacuguacaccaagguguccuuaggaugguucuccagguggcuuuucagaagucagcacuacuuaucauugagcccaggcauucaguacacaaaguguaaguccacaacccuuuuggggacugucuuuaaaaauaugauuuuaaagggaagaauuccuaggagacugugugugauguuucaguaaaguuuuauggacaagucaggacccuaaaacuuaagcucaacaauagaacgcugacagacaugaauuagaagauagaguaaagcuauucuuuuguucuuucaugaucuauaaacgaauggaguggggcuuauaauuucucauucaaauucuuuggaaguaguuuuuuuccccuuguguuuuaacuuugaauaaaucacuaaauauuagaacaaaggcccgauauuuccaucacacaacacaaaacagacugugguaucauagaacuguauuauaaacauuuauuuuuaauuuugugaacacugauccugucccaccgagcagucuucccauaugccaauguaugcucccgcaaagcacuagggcaugguuauauguguaauaguguacuuaaguguuugaagaauaacaaaaaccaguagaguuucagaauauguucucugacuugaggaccucacuuguuuaauggaauuuucauacaugugguucuuucuugccuguaugccaacauucaagagauuuuguuuggcaaaguuuugcaaggucuaucaguaugcucucagugauagcacacccauucucugucccucuaacagugagcaccaucaacauguaucauggauuuugcccguacuuguuuauacauugucucuuucuuuaccuuuuuaaguugauuacaaagauuaaucaguagauuacaaagauagaaguuuuuuuuuucucuuauuuuuacuuagaugacuuucuuuuuucacguaauaaaaacucaguuugugucauucaucaggcccaauguauacuuuuaauggaaaacuggcaccucuugacuuccugguuuugugcuuuuuggguggagcugauuucugagugugagguugugacaggaaauaauaugagguaccugcaagacaacacugggaacacuugccaaagguucugcguaacuauaauuuuucucgucccuaggacccugccuacagaaagguugcgucuagguguauguuggucuuguagugagccuacucacucagguccuuuaaaaaagucauuuauuugcauuuagauguauguacuuauaugcacacaugcugcuccuauccacagaggcugcaugggguuggauccucuggagcugggguugcaggugguggagcugcucagugugugcaacacuggggcccaaacgcugcuccucuggaagagcagcaagugcucuuagcuucagccagucagucuguguaucauucucuaaagaaaguugggcaacucaguguugaaaaaaauaauuuugagcauuucuaaugaacuuacaacuuagaagcaagccaugauaagcugaacucaccaucuaacuaccuucuuacauugccaccuucuaauuugaagagauuccuguuguugaucacuuuguccguggugucacugucccuuugcuggucauacagacuucagagccuguccucuguaaaucuguuccugcugguucuagccuacagagacuucuucucccaaugagguuugaacaucugccuuucuacucauuuucacuuuuauucuuuguaauauugcauccauauuaauuuuccuguccucgugaaucagaucuagcccuuggagaccaaggcuacuuauuaucaaugaguuuaacacaauggcauauacggcugucacugaaugagucgccaggcuguucccauuuaccuugcccugcaaggaaccagcugagcuuugguuucuucagaugcucuuccuccuggcgcugucuguguguuuuccuacuccggccgcuucucuguuacuguuaucuaaccuuuaaagaagauuagaaaugguuuuaggaaauucuugggcuaugaaaaucaaaggguucauuucagcauuuuuuaauuuuaggauuuacuuuuaaacugucauagaagucugccuucuuuguauguccgucuaauauuuguucauguccugggaugugcauguuggaggcgauaguuuggaugugcacuuaaccagaauuguacuugauacagaacagaaagaagagaaacacugucaggcuuggaaaccuggauuuucuuccaauucuugauuacugugcucuucuaccagccuucaugggacccgcaggcaguguaaauaaugacacgguguaagcugccgcagaggaaggcuuauaguuuucugcugccagcuggcauuguauguacaccuauuaagccguauucugcugaaguguagauggagauguagagccuuaguguaacuucguuuuagaauggagaaaacugauuggccaggccacguguagucaaucacugaaggaacagaacgaggcugucucauaaggacuguuuugauagguaaugugcaugucugaaaaagcagacugcaaaaagugguguuguggaaaauaguuguuucuccacuacaucccauucuuuuuuggacuucucuagaggugggcaguuaccaguguugugggcuuuuaagacauuugggcuguucuauguaucugcaaucauacauuuacauguuacccuaaugcaaauugcaacauaucauucauaguuuugguauuuuuuaaaaagccucuucaauaauauaucagaaaauuauagaguccagguauuuuuauguuuugaaaguccaugaacuuccugccuauguaucauuuaggcaacugggguuugcuaagccaaaugaacagauuucuaaaauaaucccuuauuucaaguguaucauauggaauaaucuguuuaauauaguauacuauuuacaucucuucuagagagaaacaagccauggacauggauugauuuuauaaugaaucaugcugauguugaaaauauuuagagaaauuuauacagcagcgauuacugcuaguuaccaaaaguagaaaucagaauauuugcuuuuuuguuaacaaagaaaagaaaggcagaaggcugggaauauagcuuagugguagugcacuugcauuauguaagucaggcccugaguucaauuccccugaacagaacaaaauaacaacagaacaaaaaacuaagaacaaaaugacaggaauucucaggaaauuaauuuccuuucagauuuuuauaaaaaucuaaaugguaaugugcaaauagucuuaggccagcgagaagcaaccccacuauaaauauuaagcugugugugugugguauaagcaaguaucugugugguuauguucuguggaagugcauauguggaggguggaggcuaacacugccuguuuucccaaauugcucuucacuuuguguuuugugaggguuucuccuuccguuuggaguucaucauuggcugggcugguuggcugagcuggcuggcgggcuagcuagugagcuccagagagccucuuguucccagcccgcuauggcugcuggggacccuaacucagucuucagagugaucugguuugggcuucucuaaagugacugggugcuaggggacacggacuguaucuagccucacaaguacuggcgugugaaugccacugagccacuucuucaguuuacacugggaaguagcagcuacagcggcuucucauagucacaauuugccccugguaggcaaauuugggagagcaaauuacaauuaguuuucuuuucuguuuccuuuuaaaaauauuuuuuuauugaaaaaagauauucuuuuguucauauaauauauucugauuaugguuucucuucucuacuccucccagcuccuccccaauuccucuucuaucuauccaccuccuuucugucuuucauuggaaaacaaaagguuuuauaagggauaauaauaaaacaagauauaauaaaauuagauaaaauaaaaacagauauauuggaaucggacagaagaaacaaagaaaagagcccaagaaaaggugcaaaaaccagguacauaugcacacccaagagucccaugaaaacacaaaacuggaagcuauaauacaugugcaaaagaccagcaggguaaaaaaggaggaaaaagaauagaguaaaauaaaagaaaaagcccugacaugacauugagacgaggaaccuucaaagaugccucugagcuuguuuucuauugggcaggcagccugcccuuaaaaauaguucauuuccccagugagaaucccuuggcaagagcuacauuuucauuugcaaauaauuaucaguuggagauaucuucuggauuaggcaugugccuacuucuccuuucagcucuacgacucccaucugauagaccgauguaggcccugugugugcugccuuagucugugagcuuagauaguguugauccuguugacuuagagggccucuuucccuuggugucuccauccccuccagcuccuacccgguccaguucuucacucugcacagugcccugagccuugagggggguggggggauuugagcgucaucccauuuaggguugaguguuccaaggucuuucacucuguuuaauaucugucugugggucucuguauuugcucccaccugccgcaggaggaagcauuucugacaauggcugagcaaguacugaugugaguauagcagaaugucacuaggagucauuuuauugcuacauuguuuugcuuuguuuuguuuguuuuaguacagagaauuucauuuucccagagguuccugggcuauggcuucuuagguucuugguuacacaguguuggguaugggcuccaucccauggagugggccuucaucagauacuauaguggucacucucauaggcuuugugccaccuuugcacucagcacaccugguuggcaggacagcauuguaggucaaaacguuuuguguuauguuugguaguguaagccgagugucuugauaaucauugagucagcuuagugauaaaacuuucucauaggaacaugacugucuguuacucaggcauucuaccucuuagaccaggccacacacauugaauacauuccuuaauucuugauuuuuuuuuuuacuuauggagguacagauuaucucacugggcauguuuguuuguuugguugguuuuugauuguuuuuuuuuuuaacuagaguuugacaaaacuuacuuuaauuuuaaaaaauggagguaaugcauaucaaaacacuuagugccugucaccacgcaaguaacugcuaaugucaaaaguaccgucagggcuaccucacuuuguuaaccccaggaucaaagagugccuuuugggccacuuuuguagacaacuguucuauuuuaucuuauauauauugaauaauuuucauucuucuaauucuuucgcauuugcuuccuuaauuuauccuuaaugcugacugucugaauuagggcaauaucauuucauucugcauuauuuuacaacguuuucuauuuaagauaucuauuauuuuaaaauuuuaguuccuuguacccuuccccaguuucucccaucuagaauaguaauuuuuugggauacaugaucuaauguuaugcuuggcuucauaauguauuugauuuuuguguuguauuuaaguagaugguaguugugacuuuccccagguaaccgugcucuuuuucaucucaggccuugcuugaauccucucuuauauggugaaaaguuauuuuuaaaaugguaguaguguguucuaguagcgaguuggccauaguguugggagauuaugguugaaaauuaagaguagaggcagaauguugcuuaauucagcaggcagcaguggcacugcugaugugacaaacacaaugggcaaacaagaacuuucuggcugaaugugaauacagagaagaugauucagaggagugagccagucacccugucaguaacaaaugcuguaguguucuccccacccuucuggaggaugggcuuauuagaggggaaaugguggagaagucacuauagacagacuuauagugugcuugcaaaacuacacaccagugugaaaauggucucagagggagaauuaagaagcagagagcggggagaaaggacccaaggggcugaagugguuugcagccccauaggaggaacaacaauaugaacuaaccaguacccccagaacuuccauggacuaaaccagcaaccaaagcauacacauggagggacucguggccccagcugcauguauagcagaggauggcuugucagucaucaaugagaggagaggcucuugguccugugaagguucuaugccucaguguaggggaauucgaggacagggaagcagguguuggggggcuuggggagcagggggagggaaaggggguuucagaggggaaaccaggaaaggggacaacauuugaaauguaaauaaaguaaauaucuuua

SEQ ID NO: 2861 - RNA, 3935 nt, Mus musculus
gauuuaaauggcacagggcagaugggaacuuuauuauuauuacuaauuaaauuuagauggaaacuucugcaugggaagagaacuuuguuacacaccaguucuguugcuuuuguaagacaaccaacauauuugauaucaauucuccucuaaucagauguuaguagcuuaucuuuccuaguuauuuuuuucauugcucuuaaaaagauacacgggaguuuauuuuuucuuuuucuuuuuuuuuuuuuacauuaucucuaauacuuuuuauugacugucaucuggaucuuuuuuuuauuagauauuuucuuuauuuacuuuucaaauguucuucccuuuccuauuuuccucucugaaaauccccuaucccuuccccuccuugcccugcuccccaacccacccacuccugcuucuuggcccuggcauuccccuauacuggagcauagaaccuucacuagaucaagagccucuccucccauagaauguucauuguaaauuaagguuugguuuuauggcccucucucauaaccauucaucuguuucaaaaaucuuguuggcaucuguucugagacauaaauauuuuuggucaugugaaaaauacugacauggaacaaauacuaauugaagaauauuguuggauuuuuaaaaauaaaacaagccuuauagauaaguaguacuauuugaaggcauucucuuauauggacagaauagauauuuuaggagcacucuuccuggauugggaauguuugaauguuaggaagaaguaaagaaacagcacucaucagaagccaguccagugguagucagugaaggcaguacuccgaaucucagcugagguccugcuguuaaaauuacuggcugggagaguuuacucacaaaccugaccauucuugaucuuguuuuuuggucuuggcacuuuuguuguuccacuuugcaucucuguggguggggugggggggcacggggauugaaaucuuaaagaaauguggcugcuuuuguuacuuuuuuguaguggugcugagaauugaguccaugaaccuuaugaaugguagggcacugaauggcauuuuuagccccuucuauuuugauagggucucacuguguaccuuagaggggccugaaacuugcuauauaguccaggaugaacuuggacucaagauuguucugccccucaguguucugggugcugagauugcaggcuuaugccucucaugaugaucugguacucaaaugcucgugucuaguaucugaggcauauuucuggcaagugaaauaaucuuuaagugauagaaugauaugguuaaauuaucuaccucucagaaaaaccaaaaucccuauuuggaugcuugagcaauaauaacuagccuucugccuuuacuguuccauguggucugcaacauuuagaguaucucacaauguuguguauggaugagauauuacuauuuaagaauuaacuuuaaaagacuauaguuuuccuuauaauuaggguuuugaauauggaacauugaucucuuuuauuugagaauauacugaaaauaaauuagcugugagaaacagaaccauaucuuucaguuggacauucucaguuccgcaaacgguuuuaagaaauaguugagauucuuauuggugucuuggcaacccugaacucaaaaguaugugcuaauuuugacugguagcuuucauuuugaaugggacuagaaaaggaaggaauaccuguaagagaaaaaggaaugaugcacuagagaaaaagaaaugaagcaguaggcacaggaaauugaauuacagggugaggugaaguuugggaguuuagggaaagagcuuccuuuagcuuuuugcauagagguacuuagagaaauaggacuuucuggaggagaguaguuuucauuuuuuuuuuuuuuuuuugcuuacuaaauauauguaguuccauaguauucugcccacugggcaucuguggguuucauguugagaauaucugaucauuaucuuuuguguggacaggguucagggugugagacagccagugggucucuacuuuuucauaagagaccuucauauuuuccaguugucauuucuuugcuugaccacuuugacuaaucaacauuuauucaaugugauucugagaaaaucaguucauauaccacaaaaauccucacacaaacauuauauacacacagaugaaggagcuuuuaaaugagauaguuuuguuucuuaaaacuauucuggagcucuuguuaauacugaauuguuaauauugaauuuauaaugaagaguuacuuuuuugugugugcauauguguacacacagauguguguuguguaucuguuuguguaaaauacauaugcaggccagagguugacaccaggugucuuccauaauuguguucuacuuuuauguuucgagacaggucuuucacugaagcugguucuuacugcuuagcuagacugaagcuggcuuggaagaaacugccuguuuuucccaaaucuccaucccuguacuggaguugcauacacaggcuuccaugccuaacuuuuccuguagcugcuguggagcugaaucucagcccucauggcugcacaacaggcacucuacucauguccuaagaccuaaguugcuaaucuuuaagguuuaucauucuuuuugagcuucucucucuagacuagguaacuaggguucauuaacacaguaucuaagccacaggaacuauaaaauagaugggagaaucagaaggcuugaauugccagcuaccccccagcuugucuagugucuaaaaguggaugugugagugugugugcacucaaaaaacagcuguuaggaucuuucauucuucuuuuugguugcaagcauguaauuuuguuuggcuuguaucugguaaggggaggagguuuuucugaaaguuuuaugugaaaaacauaagggagacagaaguggccaggccuuguggaaauccagacaaguuggcuucacuagauuuucacuagguaggcgauaugauaucuaauggggaaaucgaggcaacucuagugauuggguauugcagucuuggcagcaagaaguacugugucucuucuccuagcucuucuaagacuaaaaagauuucucacucugucuucucaauauauuuguagguacuucucaccuuucuggcaccuuuuaucuguuuucuuucccuguguagcuuuggcucagucucuuaauggaaaauaugauuaguugaauuagguauauuugagcaaauuucucuuucaugcuggcuucauagguugcuggcuugucugcaguguggucuuugggcaggcuuucucugcugguccuaccaugcggucauuaugggaaagucaggagcauaaaacaugguccugagcccagcagaaggaaucgugauggaaauauuuaaaggauauugcuacaauuaggguuugaauauacaugaaaacauuagcauugaaggcggcagguguuugugacugcuacacuaaugcagcauuaaugguccuucucauucucugcgggggaguuuuggccaguguuuguaguucuucugaacugccugcugcauuaccaucucuggcugugcagagucauagaaauccuguuauuuucauggagaaagagcucuuguguuuccuauggcagcauuuaggucauucugucacaaguuguuacagacaucccauuacacuguauaguuucagcuagcaauuuaauucuaaaauucgauccuaaaauuuuaagguauuguucuugcuuuucugucuuauguuuuuggaauuugacuuacuaugauagcugauuucuguucgguuagucuugauguaccugacaccauucuguacuuuuggugauaagagucugcgaacuuagguugaagucuuggcucauuuauuuacagcuucgaaguguggccaaguuacguaucaacuucaaauuucuugucuaua

SEQ ID NO: 2862 - RNA, 12412 nt, Mus musculus
caggggaugugccaaccucccugacuccucgggguacaagguaugcaugugaaacauagucaaacaugcagcaggcaaaacacuccuacacauaaaaacaagaguuaaaaguugggguuuuuuaaauuuauuuuuuaaaaaaggagagagagaauauuuaagcucagcaaacacuagcucuggaaaagcaacugugccuguggaucuuucuguccuuccuagagccaccuagaaaugccagcaaccacaggauaucuucucagagggagcaagacaaagaaaugaaggaagucuauuauuagcuuauuagcuugauguccugagauaacuuuccaggguaccaugaauccugauuguagugaaaaagaagcacucauaacagauugcuucuagguaugaauaguaauuauggaagcaucaagccuacucacuaaacccuuuagaaagcuuuuccaucauggcugugcacacacgcucucacacacacaauuccaaccuaagaaauuuguuaucugucaggcaguuaaagcccugagguaucccucccuggagugaagcucauggauuuacauaauggaauauggauuugagcucagagaucaauauaaggaacuauauaucuagccuuuucauucaccauuuauuuucacacucuacuuguguccagauguauagacaccaccauuaagaaaacacagcucaagucacucagguuuaaugaccauuguuauuacuacaaagacaucacuucuguuccauugaagucugcucccgcagauaaucaggucaccuccucccacugaaaacaucguuaaucaaaguuuucugcaccccaaacccucacaaaacagaucucgauaauaaaaauagcaaaaagauauauauuaauggccaaacauugaucuuucagguccaaaggucuuuauaaccaggaagagcagacugaucaaagaaaagaauuggcaacucauagugcuuugacccaaauuuucugagagcuacuuuccuuaaagaacagaauuaaccaaaagaaaauaaagaauagaauuaaccucugccaggaucauagggcagaaaguauuucagcugaacucugcuuuuccugggaggguccuaacaguguucuggaaucugcagcaaauuaccuccuuuuuccugucccugcaaaagcaaacacagcugggaauacaucuuggcagaaauuccucguaucccugcaggucccggcuuacuguccaaaugcucugaaagaagcaaagaugucaucucuucuacaagcuccauguugaagggaagaccaugaagucaucacucccacucucugccugccuuaagcaggagagguuuguuuuuaaccccguccuggaccaaacaggaccacuuuggagaucgcuaagcucacauggcugcucgggacccucucugggaugggcacaaagggcucagcugguuccuggaagcaagguuccaaguuuugggaggaacucacuaguccucagcccuugggacaaaccgucacuguuuuuaacucccuggucucuuccuagcuugauguauguccccagagaauuaagacacaagugggccagaugcugacugugaaggaauacauacauaguuacuguauauguuccaaagucagaugaccuccccugggagucacauuuauuccuagcucugagccagaagcauuauacaauaucuuauuuauuaagacccucaccauuucccuaacucgcaccuccuacccccagccuuucucccuaaccugcuccacauacagaccacuacgagaugcugucucaauacuggcaguacccugagagcccaaggauaaaacugcauuaauggcacuuggcagauaaucccauucuacuuugaacugcucugaguucaacacagugaagaaauaaauaagaaugcaagagaagaggccguagaaauccgagccugcccuucccacaauaaaagaggcacggagauuucaggaguugguaagaaaacaaaaaguaucuaucaucucuugccggaaggccaccagcucccaccgcuugggagccgcauuagcacuuguuucucuucaggacugaagugcaagaucgugaggauggcggugagcgucugcuggcggcccaggcugucgggcagggucaggaagcgguagaugauguuuuugagauauuccagguuggcucccucccugcucuggucccucauauucuuuucgauguggcucuggagggcuccaaccuccucucgaugccgcucgcccuccuccagcagccuuuccugcagcugaugggcuucuaccuccagccuguguuucugcuuccucagagaugugaucuccaccuccuugcgggccaacugcucagcauaaagaaagaaggugggcucguuggcugcagcaagcugcagggccugggucaagcuaucugaggaggcugugucggcuggguccccaagaccuccaccacccacuccucccacggggcuucugcguccuggcaacccagaggacaaggccacagaacguaguugcuccagcuccaaguccuucuccgcgagcacagccagggcccggucccgcugcuuguguagcuccuccuccaguuucagugugcggucccugaaguccagcuggcugcgcuccaguuccugccgauggagcugcugcagccgggccaguuccugcuuccaguccucagccuccugcuggugcuggcuuuccagcuccucacaggacagccgcagggagauauacuuguccuucagcucugcgagcugcuccugugcugccuccagcuccuuccccaggcucccaucuuugguguucuugcuuuugagcacaacuugggcucgcaucuuauaccgcucaaacucuuccuucagcugcuucagcuccuguugguaguagagcgcgguagccuuuuccccgucagcagccucggaguuggccauuaucucagggucgcagagcuucuccacauccagggucaccuggcuuuuccuagcugcaaccuguaguagcuucuugagcuucuccaucuuguccuucaagacauugauauccagacuggauucgucgccauggaugucaagggaggaccggcuagaggcugcgagggccagugucuuguucuccagguccagcugcagaagucgcuccuucagcuucuggauggccagcuggucuuucugcuuggcuuucucguaggugcccagcaguucagauaccucagagaucuggcucuccagggcugcuacucucugcucuucuaccugagacugcuggcggagcugguccucugcaagggcugucugcaaagcaaagaacaggugacaaggcauccaggaaagucacaaaaccccuagagucaacugggugugggggaggagacagagaagugaacagggcuuggaauaacccagaacaagugggaacuggggauuuuuaacugaagugcccuuucuaccauaguuuuccauucuucauuaagcuugaauacaaaguauguuucuguuagccaaaucauuuaaagaaaccguguaacauucuuucccuuucccaacaugccuguaaauucaaacccaaccuagaucccucucucuacugaaagggaacacuauaaaacaguugaggcaaaccucaccugagcguauacacaaggcauuucuucuggggaaaauccccuuugcuuccuccagucaccuuaccuagaagcacacacuucucaggauacacacaagcuuucccuacacagcugucacuguaucaccucaagcagcacagcugguaagaugccaacacccaaggccuagauagagcuaucuggcuugaacccagaaauacucaggaacucuucauccuguuagaaggacaccacacaaagccacacuucacgggacucacugaugcaauuuuuucacuuggcaucaaauaucacuaugcauguugggaauguggaaccagaccaaagucccaguacucacacuaacaacucacgcuaucucaccaggcaucccuugacuaaaacaagacccugccuuaaguggggagaggggugcccuuaauccuagcacuugguauggaaaagcaggcaaaucccugugaguucaagggcagacuggguuacaugguaagacccugccucaugaaaacacacacagagaaacaaacacacacacacacacacacacacacacacauagggaugcauuacaguuaucuaaugaccagaagagaaaaauaauaauuuccuauguaagcuaaaaugacuauuugaaggauaugagaauaauuaccuuccucauuucuugcugcaauugggccuggaaauggcuuuuaagacgggcagccucuugcugaagcuccugcagccgggggucuggucgguucuucucaucucgaaugguuugcagcucaccuuucagcuccucuaccucucgggucagcugcuuggucugcaguucaaacccuucgaccugaucagcggcauaugcccgcccugccaaggcuucucuggucucuucuaagcgaaguuccagguccuggcgcuggguccucuccuccugcaagagcuucugaagcucgcgcagcaucaaggcauggucacucugcuccugggcacgaucgugcugcuguguaaugaggcgggcuuugguuucugcuaucugcucuugcagcaccuucaagucucccuccaggcgaccccgcucuuccucugccuuuuuauuggcauccucuaaguccugcuucaucuucuucuuauccgccagguaagacgccuccauacgggacuuuuccugagugacugucgccaaggagcuagucaaaguggccaacugagucuucagcugaugcacucuuuuguccaucucacuaccggcagauggcccauccccacugcuacuacuaacgccacucucugacccacuggccucuucagacuuugggggaagugguccacgggccgcucugucaucuucaaccccaaauucacccuugacacuuguaagacuggcugcgguauccaagcuaguggcaguuccggugcuguccucacugugaguggagcaccggucauccacagaaucaggaaacgugagaccuggaggcugcacaccugagaggccuacauccgccucgugggauaccgacaguaccuugaugcuggccuccagggcuucuuucuccuucagcaggcuuuuauaggcacgcaccacauccuugagucuugccugguacuggagaagcugcuuuuucugugucucgauggucuccaagagauccuucuuacuugggccgcccccgaaauucaucccaaacuucuccauggggguucuggcguggaccgcuccacgucaacguucuugcagcccugggcagagccacagggacagcuaaaagugaagcagagagaaccgucuggcugcaggcaauacacccgguccguccagcgguccgggcgggaugaggggccgcgguggccaggcaaaagcacugcaggagccaggccgaaggugggagccaguuccaaccuggaggcggagugacgcugaccuagcaggagcagucagccuaggcucuccaguacaggcccugagccugucccgcccuagccgcuccuguggccaccgcaaccuagacccgccucccuccgcccacgauaagcccaggguuuacacuaagccggguuccaucacgauuucccaacaacuggaacagcaccgcuuccgggucuccuggaagugacggcagcaaaacgccacagaccccgccccgccgugggcgugagauggguggggcuuccgcaccgugucugcugguggccuggagagggaguaacccguagguaagucuagagcaagcaccugagcagugguuuggagaugccuaacuuugcccucaagcuaccaccagugagcgacagggggcgacgucgcacugcauuugccccaaaaacauagaugaaagacgcaucaaacuauuuggggcaauguccaacauuuggggcaacaguuaggacucauacuaggaaaacgaggccgguaccugguuaacguaaagcauaauagcucccucccuuaguucugauuaguaaaaggggcauuauauagccauaaggcccaucuugcauaccagcauaugcuggggucagggcugugucacaagaguuacacuuacgggaacauagaguaaaauguacagagggguaacauguccaaugucacucagcuaggaaguuuaggaguccuaucucagucugccucucaacauacuacaugcuaugccagauagcacuacugaagaagcauggccuugucccaagaaacuccuaacagcaaggacacagagauucaaacagguagcuccugccuucacacuagugugucggggcauugcagaagugguauaaaggagaugaggcaccugccaggacagagacucuuaggggaaaugauuugaaguuugagagaugaguagacugccaagcucaaugcagaugugggaaaccagcauggaggaaaguggaaagguguauagggacgucaggcaucagugagccuaacuugcccaggaagcuuauggugugggagaaggguggcuacugaugaggcuggaacaaaggacccaacuuaaaggcauuuagauuuuaccuuaggugacaagacaugaaaagauuuucaucucaagagcacaccaucaagucuccuuuuucuuuuccaucaagacucuuguggggacuguaagacgacucagcaguaaaggcacuuuccacccaggcccaaugaucugaccugaguucuaucaccagggcccacacgguggaaagagagaacauauucccacagguuguccucugagagcuacaccuccacacaugaacacgaaauaaaaguggggagggagccaggcgugguggcgcacgccuuuaaucccagcacuugggaggcagaggcagguggauuucugaguucgaggcgagccgggucuacaaagugaauuccaggacaaccagggcuauacagagaaacccugucucgaaaaaaaaaaaaaaaaaaggguggggaggagcuagaaacaaaauaagauuccugugacauuaugaagauaccaagccugugagaggggugcggggagggaaagagaugaaauaagagugacaacggguuuuaagaaaauauuucuguaauaaaaaucuacucaagaugccaaggcagccgucacaucuccgugaguucgagacuaggcuggucuacauagcaaguuccagaccacccaaggcuacauaguggacauaguguuucaaaacaaaagacaaugagcuacuuugagaaucuuuuaaauguacuuuucgacucuaucaaagucuucucaggaaugcaaguuuaccacuuaagaguaaagcaaaguccugcggucaccggagacccagaacaaguccccuuccaagcccugguccccaggcaggcugccaggccucccuagacuucaguucuuccgcaaacgcgccuggggggcggggccggggcggacccggaggggcggggccacgugacgucgggcggacccggacgcgcggagguggcggcggcggcggcggcggcgccuccuccuucugcuguugcgccccauccccccgcggccggccgguuccagcccucgccccgcguccccugcccgcgcccccgccccgggccccgccaugggccucacgguguccgcgcucuuuucgcggaucuucgggaagaagcagaugcggauccuuaugggugaggcagaucgagcgcgcggcccgcuuggggcgccggccccgccgcagcccucccgcccccgcgucccucuagccccgcucaccugguacccugaccccgagacaccccaccgccaaagccucugggggccgcgcucccgugcaaaccaggaucugcagugucggcccugggccugaaacccggagcuggggccuggguggggugacgcuuccuccgccccagcccggcugcuaagaagggaggauuccgcccuuggaaacgacuuuucaaaggaacgcggccuuccucccagguccccuaccucccuagccccucucgccccucgggcacuugaggggcaggaguuggcacucgccacccagacugcccucaaggcccggaagguggagaagagcgcgcaccuggaggcccuccugcucuccgcccccaucaccaucagcuggccaggccucucccugucccugggcucuagggggcucccucgcucccgucuccauucuuugcccccccccccccccuucuccguugcaguuggcuuggaugcggcuggcaagacuaccauccuguacaaacugaaguugggggagauugucaccaccauccccacuauaggugaguccaggacaaggagcgggaagcaggaaugucgcuuugagccuugucggggucugcucccacuucugccuaggcccuuaucugucccugacccugacaccagauacagcuacuugagaaaugggucaccguaucucuaagcgccugauggugccugaggcguggaccaugagccuagcauaucuguugaccuccgguccucuggauucuauuccccuuggccuugguggucauugccuucuggauuuguguccuuugcagagaucggagugguuuuagugaguuccuuugaggaccuguuuuuuacccucuucacucaaaaaaaaaaaaaaaugguuuuuccugcaggcuucaauguggaaacaguggaauauaagaacaucuguuucacagugugggauguuggaggccaggauaagauucggccucuguggcggcacuacuuccagaacacucaggugcaguuggguugggaggugggggagacaaccccugggagagggcuugaguuagaccacgacugggcugucaccgcucucaucuuugcuaagcuuaagaauucacccucaccuuauucugggaagcagaguucuagggccaugcugucuucuguaguucucaacaacacagcuuuucccucgcucccucccucccucccucaguggucucugcagacuagaaguuuaccagauaagaaaggcuaauacaacucaagaugggagaagugagaccaggccaggugagggugggaccuagguaggagugaccccuucugcuuccuuucuuccuucccacccagggccucaucuuugugguagacagcaacgaccgggagcggguccaggagucugcugaugaacuccagaagaugguaaauaccgagcucugggaaccgagcccugggcuuuuggacagaguccuccggggggugguaggaaguccagaacacuaagggcaggagguuuucugucauggcacuagauaaguccuaucuuaucuacuuuagacaggacuuuuuaauuuaaauccuuuccauccaagucuacggaguugggagaaagagagggguugucuaugcuaaagagaaauagcaucucguguuacuuguucuuuuguuuucuguuggaauuuuugucaucuuugcuuagcacaaguucuuaaauuaggauaguucaguuuuuuuguagagguaaaguuuagggggcuggagcuuacuuagagccguguugacguucagcaaugaacuacacaguucacugucuuuuuccuacaaagacucuggagguuugaaaugggagcuccccagcagugcagucagccggggggccuugaaaccacaggucccacucucccuucuccccucagcugcaggaggaugagcuccgggaugcggugcugcugguguuugccaacaagcaggacaugcccaaugccaugcccgugagcgagcugacugacaagcugggccuucagcaccugcguagccgcacgguaaggcucacguccccucggcacugggccccgugcucuccugggcccgcuggacagagaagaaagagagggguugucuaugcuaaagagaaauagcaucuuguguuacuuguucuuuuguuuucuguuggaauuuuugucaucuuugcuuagcacaaggaagaguucucuucccugagacugaucuccuucucucugucccuacagugguacguccaggccaccugugccacccaaggcacaggccuguaugaugggcuggacuggcugucccacgagcugucaaagcgcuagccagccaggggcaggccccugcugcccggaagcucccgcgugcaucccgggaugaccagacucccggacuccucaggcagugcccuuccuccccacucuuccuccccacagacaggccucugcuccugcgccugccugcaugcucucucuugucguuggagccuggagccuugcucucugggcacagagggcucugcucuccugccugcugggaccuguggaugggcuuccuggccaaggcccccucuuccaggggaggagcagggaucuggauuuaauuugguuuugguuuugguuuuuugauuuuuuuuucuuuuuuuucuuucuuuuuuuuuguuuuggggguacccuuggggccagguuuuggggggaggaaagugagggcuccggguggugcuaugacguggaacuggauauugaguaauaaauuugcugugguuuguacccgguguugucuguugccuggaaguugggaagcugaguuacugugggcacagaaagacggugugggagaggcagaaagcagcugaauccaggagggcagugcacuugaacccuuuucuuccucagcuuccccuggagggcuucuagggggaggaaaugccauuucuuccucaguucugaggaugguuaaggcuauaaguaccuuucucauuccucaaaccagaguguuuccuaucucuuaccuagcuacuuagcaguucaucauagcuuugugcacauggacauucaaaagauagguuccccaagacacacgagaaaaaugaucgauccuggcagcccaacaacaugcguguuuaaaauuaccccgaugauuccaucuaugccagcaucugugagccauauuuacugagcacugguggaaccuuugcugggaaccacugggacucugucuacaugggaggauuccaucacugcugaagcaggaagggcaccuaaaggaccagggcucugggccauucuccaggcaagguugauuacaugucucccuguagaucccagcaaagcuuaagccaggccugucguccccauuucaaguaccucuuuuugucuucucagguuggucuagguucuaggcugagguuuuucuccuugagcuuugcaggaagugaucuggcagagccugggggaggggagggcuggcauccuuuguggcagaucuggcuuucugcccagccaguucaccuguaacauagcugggcuugguaaagcccaguucugggguuuccuccaccuaaaccauucuuucugagccuuuaaggguuuaaaaggggcuucauccuuaaugguuauguauccaguuuccuugccuucucaacaaaauaauuuccuaaacauuuugaccuugucuuccuaaggccccuaaagaccgauauauguaucauuuaaccuugacugacuugaaccuuuaaaaggagcugagccagagagagccaagcagaaugcccuuguuaggaaguaaauagguugauuccuaucuuguuaauaagaaagagagggacagaccuaaagucucagguugcagcacugauuuccaguuuaauccuaccucaauugcuuggaguuaggaagacaaaugcccaaagcuugggacccacuuccuuuggcccaugauugaugcuccuauugccagcgcccuuuccccacugugcugggacaaagguaaccuuuauagucacaaugcuucugggucacagagguguugcccccuaggccagaccucugccuggaaaguuuucucugggaacagcuucugguggguacuacgggccauauucccggccauauggccugugggaccuuaccacuggggggaagccugggccggacagagucaucacuuguggcaccagccgcauggcugagguggacuggauacacagacauccaaaggcggaggaccuaaggguugggcucaucagcugggcaggaaccuaccucaccuuugaagcauauaagaguucagucacagcuucugcaaagaguuugggcaggagacagguaacaaggcgaaccuggacuagaaccaauuuucugaaugguguggggugugugugcgugugcgugugcgugugcgugugcgugugugugugugcugcacuucucuccuaaucacuggcauagucucugcuguugccaggccaagguacuucuacucuaggcuuuugcucauggauccucauugugccaccuuccaaaacuguuucccuaagaugaagucaguguuggccug

SEQ ID NO: 2863 - RNA, 3046 nt, Mus musculus
cgcgcggagguggcggcggcggcggcggcggcgccuccuccuucugcuguugcgccccauccccccgcggccggccgguuccagcccucgccccgcguccccugcccgcgcccccgccccgggccccgccaugggccucacgguguccgcgcucuuuucgcggaucuucgggaagaagcagaugcggauccuuaugggugaggcagaucgagcgcgcggcccgcuuggggcgccggccccgccgcagcccucccgcccccgcgucccucuagccccgcucaccugguacccugaccccgagacaccccaccgccaaagccucugggggccgcgcucccgugcaaaccaggaucugcagugucggcccugggccugaaacccggagcuggggccuggguggggugacgcuuccuccgccccagcccggcugcuaagaagggaggauuccgcccuuggaaacgacuuuucaaaggaacgcggccuuccucccagguccccuaccucccuagccccucucgccccucgggcacuugaggggcaggaguuggcacucgccacccagacugcccucaaggcccggaagguggagaagagcgcgcaccuggaggcccuccugcucuccgcccccaucaccaucagcuggccaggccucucccugucccugggcucuagggggcucccucgcucccgucuccauucuuugcccccccccccccccuucuccguugcaguuggcuuggaugcggcuggcaagacuaccauccuguacaaacugaaguugggggagauugucaccaccauccccacuauaggugaguccaggacaaggagcgggaagcaggaaugucgcuuugagccuugucggggucugcucccacuucugccuaggcccuuaucugucccugacccugacaccagauacagcuacuugagaaaugggucaccguaucucuaagcgccugauggugccugaggcguggaccaugagccuagcauaucuguugaccuccgguccucuggauucuauuccccuuggccuugguggucauugccuucuggauuuguguccuuugcagagaucggagugguuuuagugaguuccuuugaggaccuguuuuuuacccucuucacucaaaaaaaaaaaaaaaugguuuuuccugcaggcuucaauguggaaacaguggaauauaagaacaucuguuucacagugugggauguuggaggccaggauaagauucggccucuguggcggcacuacuuccagaacacucaggugcaguuggguugggaggugggggagacaaccccugggagagggcuugaguuagaccacgacugggcugucaccgcucucaucuuugcuaagcuuaagaauucacccucaccuuauucugggaagcagaguucuagggccaugcugucuucuguaguucucaacaacacagcuuuucccucgcucccucccucccucccucaguggucucugcagacuagaaguuuaccagauaagaaaggcuaauacaacucaagaugggagaagugagaccaggccaggugagggugggaccuagguaggagugaccccuucugcuuccuuucuuccuucccacccagggccucaucuuugugguagacagcaacgaccgggagcggguccaggagucugcugaugaacuccagaagaugguaaauaccgagcucugggaaccgagcccugggcuuuuggacagaguccuccggggggugguaggaaguccagaacacuaagggcaggagguuuucugucauggcacuagauaaguccuaucuuaucuacuuuagacaggacuuuuuaauuuaaauccuuuccauccaagucuacggaguugggagaaagagagggguugucuaugcuaaagagaaauagcaucucguguuacuuguucuuuuguuuucuguuggaauuuuugucaucuuugcuuagcacaaguucuuaaauuaggauaguucaguuuuuuuguagagguaaaguuuagggggcuggagcuuacuuagagccguguugacguucagcaaugaacuacacaguucacugucuuuuuccuacaaagacucuggagguuugaaaugggagcuccccagcagugcagucagccggggggccuugaaaccacaggucccacucucccuucuccccucagcugcaggaggaugagcuccgggaugcggugcugcugguguuugccaacaagcaggacaugcccaaugccaugcccgugagcgagcugacugacaagcugggccuucagcaccugcguagccgcacgguaaggcucacguccccucggcacugggccccgugcucuccugggcccgcuggacagagaagaaagagagggguugucuaugcuaaagagaaauagcaucuuguguuacuuguucuuuuguuuucuguuggaauuuuugucaucuuugcuuagcacaaggaagaguucucuucccugagacugaucuccuucucucugucccuacagugguacguccaggccaccugugccacccaaggcacaggccuguaugaugggcuggacuggcugucccacgagcugucaaagcgcuagccagccaggggcaggccccugcugcccggaagcucccgcgugcaucccgggaugaccagacucccggacuccucaggcagugcccuuccuccccacucuuccuccccacagacaggccucugcuccugcgccugccugcaugcucucucuugucguuggagccuggagccuugcucucugggcacagagggcucugcucuccugccugcugggaccuguggaugggcuuccuggccaaggcccccucuuccaggggaggagcagggaucuggauuuaauuugguuuugguuuugguuuuuugauuuuuuuuucuuuuuuuucuuucuuuuuuuuuguuuuggggguacccuuggggccagguuuuggggggaggaaagugagggcuccggguggugcuaugacguggaacuggauauugaguaauaaauuugcugugguuuguacc

SEQ ID NO: 2864 - RNA, 460026 nt, Mus musculus
uauucuacaauuauaaaagacaagccaagagaacugcacguuuuauugacaagacggagccucuaaacagguauuuccaacuccuugaucugugagagaaaagguaugcucaucuugaaguuaauacagcuugcuauucuuuggugaaaccuuuguaaaugaguacuaaucauugacuucagguucuaggaauagagagaaaugcccagguuccauccuugcuugaccaucuuuaguuagagacccagaacaauauacuuuuauuguugucuggagauuugcuuauguuuuggucuuuagaaauauguauggcaugcggucuacagugauaaaacucaacagugcucacaagccaauaguuagagcaugaguaacauauacaauuguacaaggaacugaaugccagucaggaaaaugaaaugaaaauugacuuugccacuaaauaguaguacgacuagguucaagguugaccaauuacaaguuuuguaaccauuacucaaaucauauauaugauagaugaaguuuacacuauaagguuugcaaaguauuuauacuuccaaguuuaggacaaauuguauuuuuucuuuguuuggaauuuugagacaggaucuugcuauguaucccugacuaaccuagcauuugccaaguuggcuuugaauauguauaacccuccucugucucccaaguguugggauuuauaggugugugcuccuauacucuuuucuccuccuccuccucguccuccuccuccuucuccuucuguuuuuucgagacaggguuucucuguauaguccuggcuguccuggaacucacucuguaaacuagacuggccucgaacucagaaauccaccugccucugccucccaagugcugggauuaaaggccuaugucaccacugccuggccccccuuuucuucuuaaaaagaaaaaagacacuuuuauuaaaaacaaauucucccuuaguuuccuugagacaagaucucacucuguacuuuagacuaacuggaaacucacuaugaaacccaggcuggcuucucaugcaguccucuugccguagccucuucaaagaggcaagagaaagcauaucuagcuuuccuuuccuuuucuucuuucuuuaaaacaggauuugaguucuaacucuaaugauacaaaguaaaauuuuagacugauauguaacacacacacacacacacacacacacacacacacacacaggccaagaaugcuacugcuacauggaugcaauucaaggacuauggaggcuauguuaggaaaguucauaguuugagguuaccuugggauacuugagaccuuaucucacaaauuaauuuaagaaaaaaaaaggacaacuuauguuauuaugcacauuaacuaaguuuggggugcacgaggcauauacaaacacuuuaaagacuuagauaaaagauucugguagcaguacauaagugcuggcacaagccgggcaugguggcgcaugccuuuaaucccagcacuugggaugcagaggcaggcggauuucugaguucaaggccggccuggucuacaaagugaguuccaggacagccagagcuacacagagaaacccuaucucaaaaaaccaaaacaaaaaaaaaaaaaacaaaaaaaacccaaaccccccacccccccaaaaaaaaaaaacaaaaaaaaaaacaaaacaaaaaaaaaaccccaaaaaaccaaaaaacagaagugcuggcacugguugaggaggugauggugaggcaauccuaagaacuagaggaaagcuggcccugccacuuguuugcugugagguugucuggcuguggaggcgaugcuccugcaucccuuugcuccguaacucuugggagagccggguggagguggcgcaugucuuuaaucccaguacuugggaggcagaggcaggcggauuucugaguuggaggccagccuagucuacagaguaaaacagggcuacaggcuacacagagaaacccuuucucaaaaaacaaaaacaaaaacucuugggagagcuggcccuggggucgugagagcugguuaacuggccuggcuccuugccuacugcagcauccuugcaucuuguuuggccaacgaaguagaguuggcccauaugacagaagguaauggugaaccagcccugaggcugugagagcagcagcccuucacgggauacagcuuuugggagagugggcccccagucuugggcagcgagguggagcuggcucugcaggcaccggugcuggugagcaggcucugaggguaugagagcaggagugcugccccugccuccugcugacgguggcauuaaguggccuagccagagcagugcuagagagcuugcccuggugacucagauaagggagagcugguguguugaccagauuugcuaccauccaggcccagauccagggcucugagauggcccacccccaaaaucuauaucaucugggaaggguugggacucauaaaagggccaaucccacugaaaguugcagaaucuccaugacacagagcaacaacaggauagcugggaggaguccccaugaagauccaacaaugauggugucacagaagccucagaucuugaaccagacaaauggcuacuguaaugaacacuugcaagugaaguuuauguggacaaagggauauacugugggacacacuguucucucagcuuccaggacgagauguuuucuauacuugguuguuuguuugugugucuuuuauuuuggauggcugcaggggcaaaggguggauaugaggggacagggagaugagcaggccuggggugcaugauaugaaacucacaaagaaucaauaaaaaguuaacaaaagaaaaaaaagguucugguaacagacagcaagauuaaaacuuaaucaccuagcuugauagugugugauacaauaguuaccagucauguguauuaaauuaauuaaaguuaauauuaaaaacucccuuccuuaauugcacgugcaauacugcaaguucucauuagcuacagcuggcuggugccucccauguuggauagggcaggaagagaacauugcaucacugcagaaagaucuagacaauacugagcaagccuuucccuauaagucaauauacacuaaaacuacaaaagaggagcacaaguagcugaaaaguaguucggggccagguaugcucugcuaaggagcugaagucuggccugauguugagggacuggcaugauuagaaagugccuuaugguaagaacagcggacuaguggucuggaggaccgaaaugggagacagcugaacaguggacacagaaggcucuugcacagcaguguccacugcauucccccccccccccccaugggaagcuuguuagagaauuaaacaucuuugucuagguuauggauucuauagacuuggcagaggaugagguagguuugucuaccagagaagcagguagaggccuaagauaagauuauuuaugguagacaguugaguucauaucuugacucugucccuuaagauacugaccuagcacugcucacuagauuuuuuuucaaacuacauuuuuuauguauauguuauauauaucuguguguguaugcaagcaucacaugucacaguuugccugagaggucagaggauagcuugcaggacuugguuuucuuccuccaccaugugggucccagggacugaacucggguuaucuaccuugcaaugcaaucaacuuuaccuguuggagcccuuugagauuccuauucacuuaaaaauaaacagacagaaaacaaaacaucaaugcucuccuuugaagaaacagaucauauggacuuuguaggcuugucuuaaggacuaacauauucuucagggaaaaaguauuuaacaggcaguguauacugugcauguucaugcuccacguaauuugguuguuaggacugacuaguaggaucaaugguuguguagaaauagaaaauuaguacaagcaaaagagaauuaacuggcugaguaggggggaaaggacaguaacuaugaucagaaaaugagauguuuggaauuaguuucaacugcuucaacuauccuggagagaguggcuacacuguugcaaaggucaaauucacuaaagaugaggucuuagagcugagcuaccaguguacugggcaaccccucaaaauuguuuuauauauguguguguguguguguguaucuaucuauaaagauccguuuucucuuuugaauagggugaauucgugguacagacuuggcuuuggagcuauaggaagaugcugaccccaaaacuugacccugauuugagacaugcgugacuacucaaacuucuuaaaacaggcuauaguggaaguagugucuuuagcguagguccagguuuuauuauuaaauaauacauacaagaaccugugcucuaaaacggggcacuccaagaccauaaauucucccugaauauccacuugaauauggcuuuccugauccaccucgagcugagauuagcagugaguuaggacugucucccgcucagcccugggauggcaaaucccaagguuuuuccuaaccucaguuggagcaggagggaaggagccgaaaaacgaggcuauucucagugugcaggacgagucauccucuaagagaugcuuauugcuuccaucaacaaacaugagcggaacucacaagcacuaaaccccagugauacuccggaccaccgggagauucgcggccacauuccgggucaagacuaacaucagcagguuacccaauggcggcgacuuucaaaaguuuccucugcuuugcggaggugaaacgucagaacucugagagcaguaagguuccuuugggacggccccaggcccuugucguccaguuccgguguccagcuccguacacgugggcgcuuugccgcuugaggggcggggcaggagcagaaccuccgcuggagggcgaggcccgccccgccuucggggcucccauggcuccccgcgcaccacugccagaugcugacguguccuuuccuucccacuacaccucccgacaccaccuucucaagacuuccccggaagucccgccucaaaaccaucccgucaccgcaaaucagcucuuucagcgcuuccuggagcuccgcacccguuuugggaccaaagggcggagcuucauaaagagagugccuauuggcuugaguuccagcggguucuggacgcuaauuggcuagagggcgguggcgcucuggcacgcuugcgcggcgaguagaacguguggcggcggcggagaucgcgucuccucuuuugcucccagucccgcugguguucuagugugcgccuggcgcuucuguccagcccaccgacgguagccugucgccugccugcuccuugucgcugcaagcgccgacacccacccugacacuuccaguccggccggccgccccacucgcugccuuuccagcuccacacauggccuccuccgcgcagagcagcggcuccuccgggggacccgcgguccccaccgugcagcggggcaucgucaagauggugagagcgggacccuggacccggaccccucugcugcuuuggagcaggagccaggcauugacuuccuucucucccgucagccugcauggucucaguuugcuuuuccucugccccuuccucacucuccaccuacucuccgaaucuucaccaggcagaacccgagaacgaacuuaucuugacuuuugccucccgggcaaccuguccaugauucgcucgcugugauuuucgugggucgcggcuuucggagccccuaccuguuuaccagaagcaggucuauuaccgguucauuaacggagauaguucacggauaguuacucccaucccccucuuucuguccauuuugacauaugccgauuaguucgcaguuucucuagauccggacaucuuuuccuggaaccccgggagugcuuggcugucacgaagcuugucucuguccacugacucacuuauucacccaaaguuuucucaacucuuucccccuuuuaucucaaugucuaguuucuaggccuggaagcuccugauuuucguguauuuuuaaauuaaaaauuuagccuggcagggaucuuauacuaaguagcauuucuucacuucuuaaggacaaggagccuguuuuuaaagagaguaacuaacuugccuuaagggcacauggcgguuuggaguggagccaauaauaagaguccagguguucugauucccuguguaggguucuuauuauagauccugcucacuuaccuuugcuuucuuuauucggaauuuugaauuccaucaccuccacuuccacacuaauuuuguagcauaaguucuguucuauuucuuauauuguuucuccuuuuuuuccucccacaucuugaggucugacauuucucguuuguuaacagauuuuucuguuuaagauggcugugaucuuuucgauugcuuuucauauuguaacuccaacgacuuuucucuccagaguggaagacaguuuccccagagagccaguuuuugaaacuuuuuuuguuuuugcugucccuguugucuuucucaggauuaauauacucugcagggggauccggggagauggcucaguggauacaggugcuugcugcucaguccugaggaccccgguucgcaucuucacggcacacauuaaagcuggacguggcuguuccacugccuggaaccuuugugcugcacguggcgcugguggacccugggcuuuugcuguuccaccagccuagcuaaaaauaucaggcuucgggugcauugagagagagagaccuuuucucaagugggugaagagcaguagaggaaggcacugauauggaugcuuuccugugcuccagcaucuuuggcccucugcauggguguucaggcacagguucccuaucaggcacccacauaugugugcacacauggacacccuuuuuaauuauuuaaugugaucacacugucacucuuuucacacacaccagaagagggcauuggaucccauuacagaugguugugagccacccugugguugcugggauuugaacucaggaccucuggaagaacagucuguacucuuaaugcugagccaucuccccugcuccacaugcacacucuugaacaugaauauucugccgcuugugugugagguucuugagauauucaauauugcccuuuugccuuucuauuuauaucuagacagucagaauucauuagauucaaugaguagggaguuuccaggguccguguuuucucucugaaauuuugacucuugaaaggauuuuccugaacugcuuccucuuuccuugcccuuuucauugguaccagucuucucuucauuauaggaacagagugucacuuagcugucuggugugguguuacuggccugcaguaauuuuuuuuuuuuuuuuuaguuuucuugcuagggcuugacuuuuucuuaaaggucucuuuuguaggaaagaggcuauaggaagccuccaggguaucuggguucucugaggugacuuccuuuucacggauaacaauccccugaggagacuguauuaucagcggucacugucacauuuucaaguggguucucucuauauauuaucucaucuagaaagugaugucuaagcugagguuuugauaggcuaacuuacccagacagguaccuuuuuauuaguaagaagaaguagagcugaaacuugaacccagggcugccugccaccacacacaccaguguaaaccaugcugugaggccuccgagucuaugacuccgggguaugacuuucuggcauaaaggguggggccagugaugcaagaccacaaauuacaagugaagcugacuguaauuggguugagaaaagauuagaugcuguuccaugacuuguugguugcugcugucgugguugugugacuucauuuggugcuuaugguugcuaugugcuuagggguguuuuguuguauggucuuuaagagucagugauuugagcagucuguagcaggcauggacugccacaugaccugaccacauugcagggguugggugggugaguucccgcagcagauuugugccaggcuuaggagccuugucuggaaugaagaauugaccaauggcagacugcucccugaagcucuuccacuaagcaaaguuguauuuuccuggagaguagucauuuccagugguauuuaggagcugcuuugugagaaaucugcacaggaggguggagcuuguuuccaggaaagagagcaagaagcagguugauaaguuagaaagcgggugcugcuuucuuuugccauuuggaagggugaagaaauuggaacaccgaauaagcaaagaugugcuuuugaguggagcauucaucuuacuguggacuggguugaucugagggucagaaaugguugaagguggagacuuugcagugagaaggaauaguuuucucucucccucugacucuccuucucucucucucucugguguugugggacuauagucuaucucuucuggucucugagaucuaaguuuaaaagacucuuuuaaacuagcacuuaaaacagugacuguugagccaguggcugugugcgcugacuggauugggggagaguuuauucuggaguauccuuaaggaggaaguggacaauaagugacacaguguuuuagaccagucguguuaauaaaaaauucucagguugagggaaaaaugaacauagauuucuguguuuugaguuggaauaagaucagcaaagaugcagguggguaagauacagcuuggguaauuaaacaucucugucaaaucagaucuuuuucuggaaaccccugauacucucaacucugguuuccuuugacugcuucacuggaugucccuuuagccaugacagaacguugucuacuguuguuauagaggugacguucugucacccgauuugguggcugccuagaaaaggcuuuucucuggcuuuacugaccaaguuuccuuuauguauuggggauggcaccuucugugacuuuccauuuuucuaugaaauuugguauuuuggguaucuccugacaggcucacaugacagcuuggcuuucacaacuauagaugaggcacauucuucagccuucugugccuguugccagcagacacgggcgugguuuaccuuauugugcuuuugauguggaaggccuaaagguugaauugucccacacuuacucccucuuaagaggaaagaacccucugucagucuucaugguuuuauacaucaacucuguuucucaguguugacuaagacaaagggacaccuaaaaggcagagugaccauaguuuaauauagacauaggagucaugcugcugauuuguuguaaggaauaaauuuccucccugguagcuuugugggacuuucuuugaaguguaagcuguaggagauucguccuauaauucaguuuguuauauguagguauauuuuagcccucugagcuaagaggguguuccuuuugagauuugagugaggacagaguagucuguuuauguuguuggcuugcuuguuuuuuuuuuuuuuuuuaaauacaagagucuaauguguaggcugucuucaaacuccuuuuaccucagacuaccaaucuuccugccuccaccuuccuagcgcugggauuacaagccugugcuacacagccagcuuuugauuuucuucuuucugugugugcuuaauuuuauguagagacaaacaaaauguuuaaguagccuaaacuacuuaaaauaccauucaaaaguguaagguaggccagucucuuagaggggccaugggcacagaagcagaauaagaucgacuuccauggagagaaguugugcaugguagcuuucaaucaagacgaguaaaggaacacgaaguuauucuugugucuugaacacuugcugaaaucuuugagugaaaacaaagcauccaucugguuccaguuuugcugacaguagugcugccauguaacuaaagaaauagaauaagaaauaaucauauuuccuuuuuuuuuuuuuuuuuuugagacagaucucauugugaagcacuauagugaccaagcuggccucaaacuuguggcauuccugcuuuagccuccugagagcugggaaugugggugugugugccccugugcugggcuuugugauaguucuucuucuguugaacugcuauuuauugcacaucuacugcucaucaagcucugucuggucacugggugccuaucccgugcgugucucauggaggagucaguaaagaagggaauaaguaagcaugggaagagaggagagugaauucacauagugggccagaacagagugguggggagcaagagaggauugauuccuuaaauaguguguuuaggacagaauucucucaguuggcguuugcacugagauguggacaucauagagccaaccagagggaaguguuuccaguagggggaacgacaagugcagagcccgugggguuuccacugaucauuguucuccaguguuuugacaguaguucuucagugucuuuaaguucaguacccacacagaugguguggauuuaacaugaguuacugcauaacgcguguuuaaggaugauaaaaggaacagucaguagggguagucauugcucucugguauccuggugagaucaguaacuugauaggcuacugaauaaauguauggaaugaguggcuggcagaaaauaucuuugucuuaguuauguguuuguuucuuuuaggaccaagagucaggcuuuucugacgucuuaugauuuaguccuguauuuccaagucuuccugugguggguauauggauggaaauaaaagccaacgcagacucaauuaagacuuaaacggugucuguaacugucgguguauguauucuaagcagguucagcaagaguuuaguagugucugucacugcuguuuuguuagcguugguuuuucgugguguugaaugcugcuaaggguugcuuucaugacucuuuaaccuaguaagcuuuagcuguuaaugucagcaaagaacacaguagcaugccucagcucaaacuaauggugggggccagguggugguggugguggugugggugguggugugggcugggguggagcuggcuggagcauggcugggcucauuaggcuggcuagguuugggcuuuggaggccagugccaagugcuugugauaacuggacaaaugacucaaugaaguugauaugcuagcuuacaugaagugugauaugaagcuauuuuaguuuacacuugaacauucaaaagagaaaauugucuugaauuuuaaaaauugcauaggggguucuguguguucugguguaaacucguuucauggcccaggcuagcuagcaaggugauuuuuuucuucuuggaaacaagucauauagcaugacccagguugaccucaaacuugugucucucuuccucagccugcugagugcuagaaucccagggcuggacccugugggcugcaguguuuuacuaagguccuccugaguggaugaggcuuuucaguauugcuggaaauggguacauacccgcuuucuguugcugcugcuuccucucuugggagauugacauaugcuuuuuguuuuuacagcagaaacugaugcugaaucacagucugugagcguuggaugcagauggagaguugugggauuucacugacugucagggagccuuaauaugauaguuaauguguuucucacuuaguuuuagugauucaaaaaugaacaguagcuucaguuggcuuuuauguuuuaaauuaggcaguuaggcaacuuguagggaacuuaaugaaguuuugguuucauuuucaggugccauuuaaaaaguguguguguguguguguguguguguguguguguguguguuugggggggcgguggcgggagagagaggggagcucauaggccugggagccgggagaccaaagcuucggccugcaugcguuccuuuugguuuuucuucugaaugaugcucuugcguaagacuuuagacucaacuuaccuccagagugacucauuguuuuacacaucuucuagucccauaaagcugugauuacacgagaggcaguuguauuuucuucagucacacugaaacagagcugagaaacagaauaccuuauggcaggcuugacucugaauugugcuucucccacaacaagcaugcuuucuguugucugcuuuuuuauaacaacaacaacuuucuuuggagguggauuaguugaaauacagcauuuuaguauggaagauuaaagagugugaauuagacuagacuguaugauuagaauguaguauggcuagagauuggguagagggacggagggacugggcugcucaguaaucaggauaacaggugggaaugguugcuucugcgugggcuauauccauucagucccccgucuauuucugaaugccuucccuuuuccuggagcaguaggccuugauuugugaagguaaggagaagugagagcuugagcaguacuucgugagaagagucugcuuuugucuaauucuuaacugagggacucuuuugccuggaggucagcucuuauuuuuguagacauuuuccacuuucauuguauguaugggaaguaucuuuaucuguuuuuuuucuuauccuugggauugacucugaagucacauguuggcuaggaaugccugccuugagguacauuuccaacccacuuucagccgucuacuccuaguacuuccugucaugguuucuuuucaguuucaguguucuuacuguguauauguuuauuuacuuauucucacuacguucuccagucugucuaguccuaaucucuuggauuauggguaggugccaccuugcuggauuucaguuuuugauuuuaaauagaaaaauuuagagaaaguaaauccugguuuucuaaccaggucauuguggggagaccaccugggagagccauugaauuaacaucuaggagaguccugagaaucugugcuuacaaaagccagccagccauuccugggugauucugagaggcucaguuugggauaggacuggaacuggcauuugggacccacugauuugcuuaacuucugagguuguuaugccaagauugggguugagcgugccuggauuuuaugagggaagauagagaauucucuuuugguauucauuuugauggcucccaggacccugucagaucugauuccugggucaccacugacagcugagaaauuguuuuauaugccugauuuaggccauaugcuccuuuuaacacucaucugccacuuuuccuuguauuugcauagauuccugagaucuuccuaucacuuggcaccgguacccuggcacauuauugcuacagaauuccuuagugucauuuacccauaugacaacuuugaguuccucacuuucuguucuuggaaccuggaaguucccucuccuuuuuuuuuuuuuuuccuuucuuucuguuuuuuucucccuaccccccuuucagaggguaucuuuuaucccaggcuguacugaggauaaucauuaacuuugggucuuguuuccucuaaccacucaugguuuaugcagugcuuggggucaaauccccacauucaugcaugcuggacaagcacucugccaucaagccauagucccagcucccucccucccucccucccucccucccucccucccucccucccucccuuccucccucccuuccuucuugauugagacaggguuuuuuuuauuuuuuuuuuaagauuuauuuauuuauuauauguaaguacacuguagcugucuucagacacuccagaagagggcgucagaucuuguuacagaugguugugagccaccaugugguugcugggauuugaacuccggaccuucggaagaacagucgggugcucuuacccacugagccaucucaccagccugagacagggguuuuuuguguauucccuggcuauucaggaacuuguucuguagacaaggcuaaccuugaacucaagagacccaucuaccucugcuuuaaugcuggacucaaagguguggccaucacaccugccuuauucuugagcgccucucuuugucucaacuguagagggcagggccaacaccugggauuuaguaacuacuuugucauuugcuuggauguuuuaauauuucaguaccuauagaucaaguggaccuuuuggaguuuugcuguuacccgcuuuaucugcagagaacuuugugacaaggaaaaguuaugacuuccaaacuuacagugaccagcagagaggucagaucuaucuuguucuuacugguaggcacacagggccucugcuuuuuccguuucuuggcuaauaagguggaaguauaugauuauugugacauaagagauaacugucuauauuucuccacaugauccuccuaaaauccuuguaauuucgggccugugagauggucuuguugccaugcuugaugaugugaguucaacccccaagucccagauggugacaggaagagcugacuucugcaaguuguccugugacuacugcacuuucaccuuacacacacacacacacacacaagucccacauggugacagaacugacuucugcaaguugugcugccacuacuacacuuuuacuuuagugugugugcacaugugcacacuuagaauaugagagaaaacauuugcuguuugucuuugggucugccuuguuuugcuuaacauaauuucuaguuccauccacuuuccuccagaugucaugauuuuauuuuuauuuuuuuauggcugaauuaaauuccacuguguauauaauucauuuuccuuagccauucaucugugaauguauagguaaacugguuccauuucuuagaauagugcagcaauaaaugugaauguacaaauguuugugugguguguugacuuagagucauuugggcauguaaucaagagugguguaucugggucguacggugcuuugaagaacugauguacaagauggcuccacucguggcccaccagguguggguaaggauucuuuccccauauccuggcuaucuuuuuuuuccuuaaguuuucuuuuugaaaacgauuuauuuuaucuuuaugugaugugugugggucugugcaugugugugcuggggcccuggaggucagaagagggugucagauauccuuggaaauagaguuacuggcucucugaugugagugcuggagcaggaauaagcaaacacucuuaacuacugagccaucucuccagaaucccuuacccacuuuugauacagggucucauguggccuaggcugguuuugaacuagcuauguagcugagucucaugcuggguuuuguugcaccuuuaaggcaagaaaaguauguucaaucauuagaaaucuaugcugugcacauuagaauggucugguaccuggcuucagaacuaguuaaagacacuguaguuuccaucucagucuaccuaggcuuccagguaagucugccaggcuuccuugucuuggcaugguuauuaguaauggucuguuggccugauaugagugauggggguggaugggagcaacagucagcacagggagaccgagugcaggaaagugaguggugguguagcucccagagagcagcaugaacaagagaggcgggcuccgagugcccugggaugacuugauagaaggaggguuguaugggcucaacagcccggcuuugugugauucuggccaaagcuuugcuugagagguuuugcugccugucucaugcaguuacugcuaacuggcaagaaguaaggaaggugguuuguaguggaaagaggaacuugugaauuuaaauguccaugguuuucuuagaaguaaaauggguugggaaaagucacauguuaguuuugguugguuugaaaauaucuuuccagagaagaugguguaagggacagaugucuugacagagguaaaguacggaagauaaagggcaggugagcuggcgaagcacagugggaacacucagaggacgcaugcaaagcugagguauuuaucuaaagaccaaggguggcuggaaguuuguuauaagaaaaaggaaagaggaagaggcuucaaagcuuuuugcuuccagugaugucagccaaguguucaaccucaugaauucugucccaggagguucauuguccuauagccuuaauaccagcaacauuuuuauuugggcaaccauccaaggcauaaucauugugccaaguaaaauuuaucuauuuacccauuaggggauuguccuaggcuuuaaugagaaaaauagugugugcuauuccucuauguauauugcaagguagaggccagaaccugggucuuggggucccacugggaucuguuauucugugugcaguaauuacuugcauuauugcucuuggcaggugaggccuuuuacagcccagaggccaggaggcugcuucuguuacuuaaaagcuaaguuaccuuguuaaacuccucucuggugagagcuuuagaaucucucuagaccucccaugagcucucucuaggguacagguucagcacagguuaaggcugcccugccuuuguauaauuagucauaggcauucuagcucugaguaguggaauaaaaauuuuaauugaauucuuaggaguucuuuuaaaaaguugaguagcagcaugucugugggagaagccaggaaugggguuaaauggcaagggguuuguacuuuuauuccuuucugacacucugccuuggacuuaagaguaagaagaauucugggaugacaugcuaauucuucauugaaaagacugucaggucuaugguagguuugugguuuacacuuuauuuugaaaucuaaaguugacgaucagcauuucaaauagggaauguuuucaaauaaccucaagauuaagcuuuuguagauaaguuuuguacaaguugauguauuucuucuuuuauuguauuaugaacccugcacauaaagcaaaaauaagcaucugguguuuuuuuguuuuucgagauaggguuuuucuuuauagcccuggcuguccuggaacucacuuuguagaccaggcuggccucggacuccgaaauccgccugccucugccuccuaagugcugggauuaaaggcgugcucagcaucugguguucuugagaugauucauugaauauuauguucaguaaucuaauguccuuuagugcacauagcuuuacagaaacaagaacaguaaaugcauggacuuugauuucucuaucauauucggugucccuggucuguucacuuggcuguauguggugcacagguccucuacccccauucagucacacugauuguuggcuguucuguaccguauuuugcacaggggcaggacgagggcagugcugugacugagaaauuaagagaugccugacauggcuaauagcacaguagcuuuucccucucugcccuggacugggaauggcuacugcacuugguuuuggauguggccccuggaacugugggguggaaggcgaguuaaagaacaggguuggacauagggacuuagggacucaguuagcugaggaguccuggaauggauuuucuaccuuuccucaccaccauugauuugaccugaagacaaaguuucuuugcccaacaggaguacuuuuuuuguggcuuugcaaagaugaccauaaucugaugagguugcugaacacagagguucugaggguagcauguccugagagagcauggaaacccuauggcaucccaccugcuuacacugucauauccaucuccucacuuguauguguccacuguaguagcaucccuaacaagccaguaaauguuucuaucuuuuauuuuuguagacagaaucucuuacugaaguuguuucugcuagaauggugaucuagagagcccuggaaucuagauuugcagagguguaauuucuggcguuuuauuuuuuguuuauauuuaguuauuuauuuuauauggauguaugucuuuccugcguguguuuuguguacugcauucaugccuagugcccucagaagugagaagagagcauccaauuccuuaagacuggaauuauagaugguugugagcugccauguggauccuagaauuuaacacagguauguguaauggaagagcagccagugauccuaaccacugaccuaucaucucuccacaccuggcuuucuacauugguguugggaucugaacucuggucccccugcuugcacaguagacagucuacuaacauuuuugguuuuuuuuuuuuuuuuuuugagacaugguuucuuuguagcccuggcugucccagaacucacucuguagaccaggcuggcuucaaauucagagauccuccugccucugccucccaaauucugggauuaaaggcaugugccccccggcuucuaguaacauuuuaaagguagaaucucgaaaucaaccaaguggaaacaaaaagaacuauucaaagaaucaaccaaaccuggagcugguucuuugagaaaaucaacaagauagauaaacccuuagccagaguaacuagagggcacagagacaguauccuaauuaacaaaaucaaaaaugaaaaaggagacauaacaaccgaaccugaggaaauccaaaacaucaucagauccuacuacaaaaggcuauacucaacaaaacuagaaaaccuggaugaaauggacgacuuccuagacagauaccagguaccaaaguuaaaucaggaucagauuaacgaucuaaacagucccauuuccccuaaagaaauagaagcagucaucaauagucucccaaccaaaaaaagcccaggguuuacugcagaguucuaucagaccuucaaagaagaccuaauugcaacucuucucaaacuauuccacaaaaaagaaacagaagguacccuacccaauucauucuaugaagccacaauuacccugauaccuaaaccacacaaagaucccgcaaagaaagagaacuucagaccaauuucucuuaugaauaucgaugcaaaaaugcucaauaaaauccuugcacacugaauccaagaacacaccaaaacgaucaucauagccaaguaggcuucauccuagggaugcagggaugguuuaauauacagaaauccaucaacauaauccacuauauaaacaaagacaaaaaccacaugaucaucuccuuaaaugccgagaaagcauuugacaaaauccaacaccucuucaugauaaaaguuuuggaaagaucaggaauuuaaggcccauaccuaaacauaauaaaaccauucuacagcaaaccaguagccaacaucaaacuaaauggagagaaacucgaagcaaucccacuaaaaucagggacuagacaaggaugcccacuuucucccuaacuauucaauauaguacuugaaguucuagccggagcaauucgacaacaaaaggauaucaaggggauacaaauuggaaaggaagaaguaaaaauaucacuauuugcagaugauaugauaguauauauaagugaccccaaaaauuccaccagagaacuccuaaacagcugauaaacagcuucagugcaauugcuggauauaaaauuaacucaaauaaaucaguggccuuucucuacacaaaaaauaaagaggcugagaaauaaauuagggaaacaacaccauuuacaauagucacaaauaauguaaaauaccuuggugugacucuaacuaaggaaaugaaagaugugcaugauaagaacuucaagucucugaagaaagaaauugaagaucucagaagauggaaagaucucccaugcucauggauaggcagaauuaauauaguaaaaaugucuauccugccaaaagcaaucuacagauucaauguaauccccaucaaaauuccaacucaauucuucacugagauagaaagggcaauuugcaaauucaucuggaaaaauaaaaaaaaaacuaggauagcaaaaacuauucucaacaauaaaagaaccucuguuggaaucaccaugccugacauuaaucuguacuacagagcaauugugauuaaaaacugcaugguacugguacaaugacagacagaucaauggaauagaauugaagacacagaaaugaauccacacagcuaugaucacuugaucuuugacaagggaguuaaaaccauccagugggaaaaagacagcauuuucaacaaauggugcuggcacaacuggcuguuauguagaagaaugcaaauugauccauucuuaccuccuuguacaaagcucaagccuaaauggaucaaagaccuccacauaagaccagagacacugaaauuaauagaggagaaaguagggaaaagccucgaagauaugggcacaggggaaaaauuccuaaacagaacagcaauggcuugcucuguaagaucaagaauugacaaaugugaccucauaaaauugcaaagcuucuguaagucaaaagacacugucaauaagacaaaaaggccaccaacagauugggaaaggauuuuuaccaaucuaaaucugauaggggacuaauauucaauauauacaaagagcuccagaagcuggacuccagaaaaucaaauaaccccauuaaaaaaugggguucagagcuaaacaaagaauucucaccugaggaauaccgaauggcugagaagcacuugaaaaaauguucaacauccuuaaucauuagggaaaugcaaaucaaaacaacccugagauuccaucucacaccagucagaauggcuaaaauaaaaaauucaggugacagcagaugcuggcgaggauguggagaaagaggaauacuccuccauuguuggugggauuguaagcuuguacaagcacucuggaagucaaucuggagguucuucagaaaauuggacauaauacuaccggaaaauccagcaauaccucucccgggcauauauccagaagaugucccaacugguaauaagaacauaugcuccacuauguucauagcagccuuauuuauaauagccagcagcuggaaagaacccagaugucccucaacagaggaauggguacagaaaaugugguacauuuacacaauggagcacuacucagcuauuaaaaacaaugggucaugaaauucuuggacaaguggguguaucuggaggauaucauccuuagugagguaacacaaucacaaaagaagucauuagauaugcacucacugauaagugaacauuagcccgguaacauagaacacccaagauacaaauuuccaaaacacaagaaaaucaagaagagggaagaccaauggguggauacuucauuccuccuuagaauagggaacaaaauacccaugaaaggaguuacagagagaaaguuucgagcuaagacgaaaggauggacuauccagagacuacccuaccuggggauccaucccaugaccugccaccaaacccagacacuauugcauaugucagaaagauuuugcugaagggacucuguuauagcugucuccuaugaggcuaugccaguaccuggcaaauacagaaguggaugcucacagucaucuauaagaugaaacacacggcccccaauggagaagcuagagaaagcacccaaggaucugaaggggucugcagcccuagggguggaacaacgauaugaacuaaucaguaccccacagagcucgugucucuagcugcauauguagcagaagauggccuagucggccaucacugggaagagaggcccuuugguuuugcaaacuuuauaugccccaguacaggggaaugccagggccaagaagcgggaguggguggguaggggagcaggguggagggaggguagagggaacuuucgggauagcauuugaaauguauauagagaaaauaucuaauaaaaaauaaauaaaauuaaaaaaauaaugguagaaucucauguagccccgucuagccaaggaagacuuuggacuccauccucccaaguguguaaagccacacucgcugaucaggcccuggggcucacuaacugagugauguuuccagccacuuaauucauuuaugaaucauuuauucguagaauuuagucgucagcagcagucccuuagguuaguugaaaguugcaguccuuauuugucuuucgugggaucuggccauaacccgagacaaugauaaggcucuauucuaaguaaccugggaggggggcagcaagauugcucagugguuuaagaucucuggaguucuuccaguggguucaauuucagguacgcacaaguaucuguaacucuaguccaggugugacacaaucuguccucuaagggcaucaagcaugcauaugguacacagacauacaugcaggcaaaacacucguauacauaaaauaagaauaaaucuuaaaaacaaaaacaaaacccuaaagagucuguauuguguuccauuaugagcaauaggcuaaauuuugcguuuaagucuaaggguggaaaggugggguugggcugugaguuuaugagcgacugauccuguuucauuggugguggccuaagcuugcuuguuccuuuuccucagagugucccccauccauuguguucugugcccauucacuuagguuucucagugaguugcaaagugaaaauaaacauuuacacuuuuugcugucaguuuagacauuuagauacacuuuuaucaccauaguauuugaauauaagcuuuggguuguagaucugauucuugucuacuaauuaagaacaaauacagaaaucauggggaauauaauuagaguagagaugauagcguuuguucagauaccaauucccuucagacacgggaagugacugaagaaagugggaagacaauugaauauugaacaguuaauuaggagauucuucaaaguggucagggauauagauuugagugguuucuguugaaaauagagucgacuugacagcucacaggaaauaaaucaaucgagugguuagaaaugaguuagccaagacauucuugaaggagguaacaagggaaaucuggcauccgauaagagcaccgaaggaagcagcuggagagagcagugccaagaauaacaugaacuuccugggggagagugacugaugcagagcaaaggugcaguuguuggaggcagagagagcuggguaagggggauccccugcggauggaggauccaaaagaggacagcuacaucccuucauguuggcugagggaguggggggcuuuagagaaccuugugcuucauguuacucgauggagaagccggagaagcaaguauaagcucuacuucccucauaggguuuguuagcccccggcaaacaaaguuaugaacuguuuaaguacacucaugucuuaaugguuuuuguucuugcuuucuugaguccaguauggaauauaauauuaacaauuaaaaaaaaaaagcuuaguauauuugaucuuacucugugcucugagccuaccauggugaauaagguugauacgguccuuugcacucacagaacuggcagcccagaagaacaguuacaggcugaguccauguugucuugagggccaugggugaggaguguagagcuucacacuugggaaggcaucucugagaaaacagagcucuguuugcuagagaauuaccagggcagggcguuaggguggaaauuagccucaaacuucauuauucaugccagucaccuggagauccuguuaaaaugcagcuucugauucauuaggucuggugcagcgugaggaucugcauuucugaugaauauggagauaucacuggucuguaaucuccugcagagacuuucugagcaucaucaccuugaucauuuauuuuuuagcaucuauuuaaagaugauagggucauuuuuccgucccuucauucuauggucauggucauugcaguuagaaccaaaagauuagcgcuggcaauauguggcugguuuugugaugaagauucuucguuucucuccacuguguuuguauuuuagcuaucacuuguuucaugggugcggauguuuugcuugcaggcauguuuguguaccauauacaugccuggugcccuuaaaggcaagaagagaacauucaguuucuugggacuggaauuauaggugguugugagcggccaaguggaugcuggucugaugcuaaugaaaacacuuuuuucccuuuuuccuuuagauagcacacauuugcagacaacaccuaaggugcuggaacaggaauagaaaaccuuaggaaaaaaagaaaauacaguuuuguaguaaauuaacagcaaauuucucucugcaucucuccaaauguuuagauuagcgcucaucugccccagucccucaagugauguuacaggugucucuacuguaucuggcucaguccuuguauuaguuacuuuuauuauugcugugguaaaauaccaugugauaaaauaccaugaucagugaaauuuauacaagaguuuacguuucuaguucuacaggggcuagagucgcuuaugaccaggaagcugcaggcaugacagcaggaguagcaagcugggagcucccaucuugaaugaggugcacaagcaggaaacagguucaaggucuuuaaacucucaaagccugccccagugccacacuuaauccaucaaggccacaccuccuaaaacuauccaaacugccucaccaacugggaccaaacauucaaaugccugagacugugugacuuuugucauucaaaccaucacaggccuuguaccuuuuugcaucaagauugcaaauuuuuacuuaaacuaaaaaucuagagagcauucuuguuuuugacaaaaagcucuuaauuacuguaacucuaaauugaugaaguuuuuccuaaaacuugugauacuaauugugaggucugacagucaaaauaugcagccucauucuuuuuuucuuuuuuuuuucuucuuucuuuuuuacuuauuuauuauauguaaguacacugaagcugucuucagacucuccagaagagggcaucagcucuaguugugagccaucucacauauaguugugguugcugggauuugaacucaggaccuucagaagagcagccagugcucuuaacugaugagccaucucaccgcagccucauucuuuugcauuuuauguauuuaaaagaauacccaguagaugacuggccuaugaagaaaaggcgaucuuccuagaacucaggucuucccuggggucauaauauugagcacuguaucagggaaggcuugaauuuucugaccucuuuauuuccuuuggaagacccuggagcaguuaaagagaugggacguggaacagcucugucguuuguaccucuugacuugaaggaagcugugugucuggagcucgagaggagcagugggcgaggggucagcuguuacacagccaccgugagcucuaguucauucaaaucccagcaaccacaugguggcucacaaccaucuguaacgagaacugacucccucuucuggagugucugaagacagcuacaguguacuuacauauaauaaauaaauaaauaaaucuuaaaaaaaaaaaaaaaaacauguccuggauuaggaaacauggguaauuuaaacuccuuagcaagggguguuccuugaaggcaaucagaguggcugagaauucuucuucuaguuccuuggucugggaaauauacaugaaauguacaugaaauguacuaucuucuaucagacagaguuagugaaauguguaaagauaccauuaagcaagagcaacugugggcucaacauuuuccaaccaccaguaucuaugacuggauaccauucuuccucgaaacuguucuguuuauauuguuuagucuccaaagaaugcacaacgauacucugagcacucagagggaggcacaaaaaccuguguguuuuuuuuuuuucaguuaaaggccuuguaggaccuccacgggauaugcuugcucagugcauagaaaguggcauuguacccuccuauagaaauaaaacauuuugcuuugcaaacaaaaaaaaaaaaaaaaaaaauaaggauacaugccgcuuuuggaauguuugccauguugugguuaugucuugcuagggaggucaguauuauaacguucaccccugaugacuuuucucccacaguagccugcauaggaccguugguguuaggaaaguuagccaucagggaggaaggucuuagguucagguccaggucaggguucaagucuucagcuugauuucucucuguccuacagccaaaguauauccaagagcaugaucuggggauucuggcgccccuuuagcucauagggaguuagccaaugcuggcacuaacauuugcauuuugugcccugucuucugggagaaacacuguccaucaacacaggguaccugcuuucaagucaaguguguaugugggcacuuuucacugguccagcaaaauauaauacauccuuaguuuugauuaaccuacuucuuaauuuuuuucucuuuauuuacauuuuuuagacacagucucaucagggucccaggcuggccuguaauucccuauguagccaaggaggaccuuuaacuuccauaccuccugagugcuaggauugcaggugccacagacagagugaaccccgcuugcaaaggcagcacauucccaguucuuauaugcuuaguucuuagauauuuguuuuuguuuuuaaagacuggguuucacuaugaagaaucucuauguagacuaggcuggccuugaacucacagagauccaccugccucugccucccaggugcugggaauaaaggugugugccacucugcccaguuuaacacuuuaaaugugauuuuuaacuuuguauuuuggaauauuuuccagcuguugagaaugguuggaagaauagugcauucaacuccugugucuucauuaccuagagagucugacugacuuauucucuuuguaauaauugcaaacaagcauuauucauaguauuuauguucugugaaguugcaaacacagagcuccugcauacugaacaauuucugugaaagacauuauaaaguuaggucccuuuggggucugugaacccauacucaaguuuuuacaaucuuauucagcauguacuuuuuguuaaaaacaucuuuuaaaaauauuuuuuuacuuuuaguuaauguguauguguggugguaggauuugcacauaagugcagcugucugugcaggucagaagaaggcauuaggucaucaggagcuggaguuacaggcuauugugagccaccucaugugggugcugcaaaccaagcaggucucuuaaauacagagccaucucucuggcccuaaaggcaucuuauauaaugucuacuguucauugcuuaauauugaacugauagcuagccacauuauacuuuauauuauauacuauauuuauuuauauuauguauuauauacuuaauauugaacuuauagcuagccacauuauacuuuauauuauauacuauauuuauuuauauuauauauuauauacuuaauauugaacuuauagccagccacauuauacuuuguguccaauugaagcuuguuuaacauaugcaguuuucucuguaagguauuuauuucacaaugguuuucuugcacuuagaaauacuaaacaguauaguaagaauauacuucagggguauuuuaaacaacgaaaucaacaaagagcgcaaauagauaaaaaaucauggcacuaaguagaccaugaagaaacacuugcugucagggcucaaacaagaaaaggccaggcauuguuuuugaggaccugcugugacugcuggaaccaggagcucaguuuugcuaauccgugucccugugaguaaacacacacgugcugacagcuauugauuugugaguuacagacaaguuauaaaauggcgaaguucacaauuaccgauuucucuauaauuguagugagugucuucucuauugugcuggggauugaacccagggcuucauguguguuagguaagcacccuacaacacguuaauacuuacaguuguuaacucuaaaaaucaggauacuuuuucccaugacuguagaauaacuauugaaaccagaaauuaacauagauacaaaaccaauucuaucacauauuccuuagauuuugcuguuugccuuaauagugcccguuuguggguacaugacuuaauccaagauuauaucuugacauguucuuugaauuagggauaauucucuauuuuuucccuuuggcaacccugacaguuacuaagaggguuuuguuuuuguuuauuguuuuuuguuuguuucuuuguuuuauuagaaguccucucagcauagguuuaucucacuuccuuaagguuaaauucaguuuaucuuugagcagaauaucacaaaaugcaucguaucagagucacacaguugcuaaugcugauaaucugguuccuugguuacagugguaucagucaggugucucuaauauauuuuagccaauaagaucuuuaugcaauagcuaguaaguguuuuauuuaauaauaaacaugcaguuaguacuucgguaagauauuuugagauuauacgaauaccuguucuuuaucucauucguccaccaugcuuugcaccccuuugauuuuuacaauuuuaauuacuuuuuaaaagaacguauuuuucugugcauguuuaagugcucuuccaugugccacucacucuauguggaggucggaggacagcuugagguagucgguuuucuucugccacucagggcaucaggcuugguggugagcaccuuccccugauuagccaccucaccagcccaucuuuaacaccuuccccugauuagccaccucaccagcccaucuuuaacaccuuccccugauuagccaccucaccagcccaucuuuaaggguucugacuugggucaguuauugcacugauuguucccaaauaacaauuuucuaguuuuaccauugauccuacacucaccaguugucacuccaaaacuuccuuccacaauuguuaauucauuuguucaauggauucagucuacuauuacuuugacuuugucuuuuuaaagauuaauuucugucugucugucuugugcauugguguuuugccuacauauaugugucugaagguguuggauuauccagaauuggaguucaaaacaguugugagcugccaugugggugcuggggaauugaaccccagguccuuuggaagagcagccggugcucuaaacugcugaggcaucucuccauuugauuuuuaaguugucccaauuuuggcccauaauaauauccuuaagcaggcuacuuuaucauuuugauauacuuuaucauuuugauauacuuuaucauuuugauauagauaucuaucuaucuauuuauuuauuuauuuauguuuuuuuuugagacaggguuucucuguguacccuuggcuguucuggaacucuguagaccaggcuggccuugaacucagaaacccgccugucucugccucccaggugcugggauuaaaggugugcgugccaccacugcccggcaaaaauauuugaccacuuuugagaaaagcuuucuaacacagccacauauuccuggcugagacggacuguucccagacccaaaccuagaaccaccaguuccucaagaagcuccugcccuuuucaggagagagaaaucuuuagaaggcggcgucuguacaucaggucgccaugcccucaugugggaaguacaugugugaccugcaugccuuccuuuuguuucucaucccaacucuaacuucccucuccaccaucgagagagagaccuggcuuugcucuucugccuuuguuugcucaguccccaugugaccaauugcuugcugucaaccuuugguuccucagcuuucagugaccugucagccagcacugggugagcaaucagccccgccuguccaccccaggucuagccagccagugaggacucagcacacacauucccacuguccccccuccucuguuuugccuucuuucuuuuuuuggggggucggugggauggugguuugguauuucgagacaggguuucucuguguagcccuggcuguccuggaacucacucuguagaccaggcuggccucgaacucagacauccaccugccucugccuccagagugcugggauuaaaggcgugcgccaccacgccuggcaccuuauuucuugaugcagagucuuguccauacaaaguaugagcagugcccucccaucagugagguuuuuguuuuuguuuuuguuuuuguuuuuuuaacccuuugcuaguauuggugguuuggcaguggaaaugguugcccuuuaaacugcucagaauccgggcagaaaacugguauuuuuugggguagaaagaaagcuuugcuucuaggcuuuccuuuccuuugaaauauuuccaacauucuuuauaaaguuuuuggaagguuucaacugggcuaauuuuuuuuccuccaaauugugccuuugguguuuguguguaacuuaaauaaaguuaaauaaauccuucuguucucugcuuuauuuccuguuaacaacaaaacaaaacaaccaaccaaacauucauuuuuuuuccucuaaaaugaacauguuucuucaccagaggucuuuuaauucuuccagauaguuuguguuugauuucuuuuuuccuaucaugauauuaaauguuagaguuaugagcacugccagacuauguucuggcucuucagaauuaaauuuuaguguaugugguuccugugggcauacacugccgauuuuauauugucauuguucagcaacgcaacaucuuucucuucaucuuuacugcauacucugguaugaugcucuuagcuuucuuuguauuuuguuucucuaacacuuagggaaauucuuuuuucuucauggucagaggguugaagaguccuguaguacuuuucuguaccuuuaaguaaggcugaguaccugaccccaagcauuugauagaauagggaaaauucuaucuguaaugguauccuuaagaucuagagcuuguagugacaauuuuauggaacuuugguuucuuuaaaaaaacauggaaauacgaauauguuuuuguuuuaauuccagguguggggauauggggcuguuugagacgguccugcagccccugacugaucugccaugugcuauagcagaggcaugguuuuugucagcuguagauagccucugugagugagugugugacgcuuggaauucugggaacuuuucagaggguauauaaaugcuagcaccccaagugguaggguguauaguuguugaucauucagggggauagguugugguuuguuaauagucaugcucaaaggauaaacaaaaggaaagauauuagauucagggaucacugucucuccccacuauccuuucucuauuuagugauaaagagugugaaaucagaggguaaagggugggaaaaagaaacccacaguagcaaagaccagccacaagcaaagaggaaagaagaaggaaagaaguuagauucaaggaucucucuccccccucuccucuccuaccuagucgugggguugaaacuggggguagggauggggaggggauaaaaugugggaaaaagaacucacaagcuacaagaguucauuuuuuuuguguuuauuuuugagacuguauuuuaauuucaacauuuuccccuuccguauauacucugucuugcucuccuucaaacccauggccucauuuuucaucaacuguuauuucauguauuuguguauacauauauauuucuaaauguaacuugccacauuucuauaauguuacguacauguauguuuuugggaaugccuggcgcugaugaccaguugaugugcucuuacccaguugguuguaguucuuugugcaggguugaggccucccgagcuuuucucugugcaguugucguguuuguugguguucuccuugcucaccucacuguggggaggucauguuggugagaauagcuucccauguuacuagacauaaccuucacagaagacucccugacccuccugcucuucagucuuucuacuccucccccaguguucccugagcccuugcugugggaguguuuuguagauggaaccaugcgacugggcuucaucuacuuuucuucuuccuuugggaggccacauaaccauuguccugagauuuuguugguguuugacaacuggaauggauuucuuuauugugcaugggucuacuccauacuuguuuuuccuccugaguucaucugucuuuuuguugaucuuaaucuccuugaauccguggcaguaaguagagcccaguggcagaugguaaagauuugacuccugcauguuguguagacagcccugcaugaguuccuuccuugcuggggaagcuuccuuuugcaggggcuuaccaguccuucuuuccuuccacacgucgcugguguuggcucaugguucucacauaugcaguauuugggguuuauuagaaaguaugcugggugccaucaucucucucugcuucaucucuuccucaucuguaaaacagaauaugauagagaagagcaauuuaugauccuuugccauuuccugagcuacaugacagguguaggccgucuguggauuguuguuauugccaguccauaauuaauagcagauaucauuaauacugcagauugggcaaggauaagaacagauuuguuuuuguuguugauuauagaucaaaguuagaaggcuagauuugauacuggcuuuuacacaauuuuauuuuauggauggugguguguguguuuaguaaauguugcuuugauuuggaacagcccacucauggggacuuacuugauguuucuaaugauuuguucugugacaccaacucugcuggccauaucuuccugugguuuuuaggcugcagucacuauagcugucugucuccagagccuuuagcuguaaaauaaaaggacugcucuccuuuucgggcuucucuucagugauccugagauuuacaagcugagacccugugucggggugacuggggagugagcauauccuuagucagagaaacagcagcaccgugaagcccugaguuuuuaagcccugaguuguuauuuuuggauggugggcccuuuaauuuaggcuuggcucuuguuuuuagcagaagaaaugagaggagacaaaauccggaagauuuggguacauugaaaauuucccaacuuaguuucucuguaguuguuucuguauucuguuucauaggauguuucuggauauuacacaguuuugagauauacacauuaaaacuauugcacacucuguucucccucccucuccuccucucccauucccuuccugccuucacuucacuuacaguguuaggguuugaauuuagggccuagcagcugaacuauauccccagccuugauuuauggucuugcuaagugguuauugaaacagugcuugcuuccaguugugacuuaguuccugccugccugccuuuguggguuugguguccuagcuaagacgugaucaugaauggaauguuagguagaguuaccuguauguuuuauucccuguuuuaaguuugacuucucuuuucaugucugaugcuuuuugaauuccucuuguugauagucugagguagagaucaggugucuuccuucugugugugacuguucaggugcacuuuuuguugaaaguucuacucucucugcauugaguuaucuagguaucuuuguucaaaacccauugguugaauguguggaugugguggaggcccugauuuauuucuccucaguugccugaccuccuuuauauugguccuucuguugucauuuuugcccuugucacaugccuuuuauaucuuaaguggcagaaaugcccauuaagcugguccucuccacagagccaguaagaugccuuuuuugggccaagaugauuuugcuuuugaguugggaaaaauacuggucaguauuuauacuugaguuuucuguaugaucacacugauaugacuggugagaguauacuuuuguguguaguuuuccaucuugugauggcaguggucuggauguucaagaguuaaguguaccaaauuaucagagucuggugaagauuuaaugucauacucuguugcugggcaacauuuuagugacucuguacagucuuucacuguagguaaauuucccaguaaaccuguaaguggauuugaacaguuugaauccccguuuuucuuuucagugcuuuaguucagccccuguggcuggcugacuugugccuugaagccagauccuuugaaucccaccacaucucucugcaaccuguaugggcagagcugagaaaugucaaauccaugaccucagucaaacugacucauuaugacagcuggcuucacagucuuccugcuguagcagguaguccugagaccauucuucuaaaaucugucauuuuauuauuuuaauuggauaaagugguaaccauaugacuuguuuucuaugcccuauaaauuagcaauuaaggauaauuacuguauucaugaaaguuuguaacaugaaucagucaguggagcuuugguaguucaauuacccaugacaguuucuucacagucuuuauucuuuugaaauuaaaaauaugauaaaugcucuguuucccugcauauguuguuuacuguuugucuccucauugagcaucagcuccccaggagcggaaacuuuugucucuuuuacuccccugaaauaugcagcuugucuagaacagggucccacacaucguugguauuuaaucaguauugaugaaaagcgaaucagucaaucaaucaaccaaucaaugauuuaacuuugaaaaacccaacgccaauguuuauuauaaaacuggcuugaugccgaaugaaguagcagucugcuuuauaagaccuuccuuguuuuuuuccauguuuuacauagauguuuuaagcauauccaccuuggcuuuauuggguagaaaaccuuuaauaaggaaagcccuuuagaauauuuuuacugaagaacuucaguaaaaacuguugacaaggcagguggagggaauuaucaguucuuggaaacugaguuguagauaacugcaaaggaggguauagugucuuuugaaugaauucagauccuguaaauaggagggaaacuagucuuuuuaucagagagguuucacucuucuacaguguccugaagacauuguuuuucuaccucuccuucagugucacuagcaaaugcuggagagaccauuucagaagcuguauccaugcuagucuuuucugacuggaggaauaggaagaaagcagugccugccacagugagucggccuuuaggagguuggauggugaccaugucuucaauuaguauacuuaguaauaaagaauacagagagcaucuuaaggggauugacaagacuggagaaguagauagguggcucaguagugaagugugugcuguacaagcaugaggcucgcguuugaucccugguacccauauaaaagagccagagcuggggggguggagacaggcagauggauucuuacagcucuugguuagggaauccagugcaaucaaugagcuccagguucugugagagauccugcuucaaaaaauaaaguggagagugauagagaaagaaagaagcucauguugaccucuggccucuacacaaugauggcucagugguuaaacgugcuuccugcucuugcagaggacucaagaucaauuccuagugguuuauaauugcaaucucagcucuagcggauucauugcugcuuucuugcuuuugugggugccaguacacaagcaugcauucaugcacauauucauauacagacacaaagacacaugaauuaaaaguaaagucuaaaaagcgagaaaggguaaaaugaagagcauaucuugaaacaggauugaaaagacaauuuuaugcuuguguauucugauguggccacaguggagugauuuaggccauggucuaugugcuuaagguauaggagacaucaauuggagggcuaauuaaaaaaauaacagaauaagguggguggugguggagguacaugcccgccuuaaucccagcacuugggaggcagaggcagacagaucucuugaguuugaggccaggcuggucuacagagugagauccaggacaaccagggcuacacagacacccccuccccucaaauaaaaaagaaaaaaguaaucaguaucuguguauuguuuagaauucucauaaaaagguaguagaguggcuagaucaauuguaauaucauaaagugaaauaccauagucaugaaaaugaauuguauuucacaccagcaugggugcauuguacuaaaaagaauuaguuaaaagaaaccagacauuguauagaagacucaacuaguagagcucaaaaauagacaauaugaaguucuguugcuuaaagacacugaauagaaugcaagugugcagaagagcaagggagugacucucagucagaguggugguagccaauagaagacuggguagaaaggacacggaggcagucuuaggguuucuauugcugugaagagacacugugaccacagcaguguuuauaaaggaaaauauaauuggacccagcuuacaguucagaguuuuaguccauuaucauggagggaagcauggugcgcaggcagacauggugcuggagaaggagcugagaggucuacauuggaucagcaggcaucaggaagagugacacugggcuugagcuuuugaaugaaaccucaaagcccacccccugugacacucuucuuccaacaaggccacaccuaauagugcugcucccuaugggccuauagcuggcauugccauuccaacugccacuuuagggaccuguacuucuggcagugugcuagccauuggauaguggcagugugcuagcuauuggccucacaguuauuuuacucuuauuuucagacuccugauacuuuuucacaauugaaagcauuaguugagauggagaaugcuauuagguguguggaaacauacucccuuuauccuuuagagugaccgucccacacaaggaucuagugugagugguggucuccagugacagaacccugcagccuaucacacuaaccuuucaguggcuguuguuuguuguuugaguugagaacccuucagagugagugagccuaccucucugugagaguggccucacaaagcagaggcaaugugaguagcuugcauuuuuacagcaugccucuuuaccucuuucuucucaaaaucuuuccuuuuauggcccuucacauauugagacauuaauaccucugaacuucagagcccuuuucacaguuguaacuagguucuguucugacugcuuugccaggacuggagagaaggggucuuaaguguuuaggacuuaaguguuuaggcuuuuagaggacaguggcuguggauuucucauuugaugguuguacacgcuuugguggccccugccccuaacccugauuauguagaaguuccuuucuuuaacuuucccuuucuuuaaauguucauaguuugccucauuccagaaugggaaauguggagauauuaacuuguuaagaauugaaaagaagaguguuggugcaugcugggauaaaauuacaaagauuauuaaccucugugucuuaugucuuuuuuucuauuuuuuguuuaauuccuacuuauauuuuagaguccauuauuuuugaaucuggcccaaggcucuuuguagguauuucucuuauaaaacucaaguuaauucuaaccaauucaucauuauacagguauuugagggccucggaauuacaaaguacuguucuagauguuggggauucauuagcauaugaguuaccuuauagagauacuauuuccaggccacuaauucuuuuucucucuuucucucucucuuuuuaauuacccguguguguagguccucucugggugcgccauaauuguccgagggcagccccggggugguccuccuccugagaggcagaucaaccucagcaacauucgagcuggaaaucuugcccgucgggcagcugccacacaaccagaugggaaggacaccccggaugagguaagugauucuccagggcuuucuauggcuguggaccuaguugacagccugcucuccuuguugaugaagaaauuuuaaugugcuccccccccccccuucauggugagucaugaugauugggucuaucuuggguagcuuauuacaugucauuauacauacacugccugugugaguuucuuuucaguuuucuuugaauaacucacaagaagaaagaauuuacucaacucagaacucaaggucacagcccaccauggugaggaaguaaaggcaggaggaacuuuaaagcaucugaucacaucagagugaccaggcggcagaaugugguggaugcuuguauucaggucacuuccugcuccuacauacuguaggcuauuggcccagggaauggugccuuguacagugggggagucccuauuucagugaaucaaaucaaaucagccccucacagacaugcccagaagcuuaguucaaaguugacucuccaucucaugauuggccauucuucagagucaacucucugaaucaacucuugaaaagaaucauauaguuguuaacugcagucacaaucucagggcucucccuaguccuucuguguaggcgucacucacucuuggggucuugaggaauagcuuugaagucacaucaguguaauguuuucauaagcaauagccuucugucaaugcuggugcuagccuuuuguuagagaugccuguauccccuaagcuagcugaauugaugaaacuaaaguuuuauguaaauaggagguggguuuuguuuuguuuuccuuuuggugugcuacugggacuugaaugcagggucucacacaugccaggcaagcaagcacucuacuaccgagcacuagcuagcucucuccucuccacuccugaaccccugucauuuuuuagugauaagggcucauguagcccaagcuucauacuuguauagcagggaugggcugacuuucaauuucugauccuccugccucugccuccugaguuuuggaauuauaggaauguugccaucaagccugcuuuauaugguacugugauuaaacccaggguuucaugugugguagacaaacacuccacgacccagcucuaaacaugacaguuuuuuuuuaaaaacaugaguuuuuauuacucuuuuuauuugacuuuuguguguaugugugugcacgcacgcauguguugugugugugcuuguguacucuguaugcauugguucaugugugaaguuaagaggacagucugggagucaauucucuccuaccauguggacucaugagucaggcuuaguggcacgcaccuuuagcagcuaagcuuucuccuuagcucuaaacaguuuccuagcucugaaucagugucaggcagcuuguagcuuguccuuguguuacucucugagaggcuaugucugagccucucucaucaccuccucucuaccuccuacaccccagcuuuuaauaccugcuguguggcuucgcaacaugggaguuuccacugccuguguccaucccaguuagugugcuuuaggcuucuuggucucuacacuuggaauguuggugcuugauucuucuuuagcugugugugcaucgcuggucagaaacaggauuucugggcuccuaauuauuaguuuucugcuccaguuugguaucuuuggguggauuaguaauuggcuggucucugcuuuucccuuucaaggaaacgaagaaaaagcaagagcuuaccagcuuuuauuuaaggaaagcauuuaguucuuuucaucuuuaauaguauuuuuuuuaaauaaggcaauagugaaacagcauuauagauaaugaagauggagaaaaaucacccauaauuauucuaucagcaguaguugguuagauuuuagagauaaugacuaaauaaauuaaaaucaguucuuucucauugguccuccaucacuaacuacaaguguugagacuaauguagagucuauaucuaccucuggauugcucaaugaggauuaaauaaggaaacauggagugcuuagcacuuuacaaaguacuuaauaaauguuugguaaucacuacucuguuagaucaaguacugaagauuaaaccuauuucagcauucuucaaacauugaguacgcaucaaauggguaaaccaccauucgaagaauuucuuuuccuuuggcugugugccguggaacaacuugauugcuccugagaaguaaugagcugccucuuuuagaggucaucaagcucuuccccucagagugaagaagcaguguagccucuaagaaagaagacuguguuuugcuuuccuuucuguggaugagcaucuguggcuguugugcuucucugagcuguugucacugugucuauccagugacucgugaggcgggaaugauaguaugugaggugccuggcacuccuuguguauaaguuugcaguuuugugcuuuacuuucucuggagcaguuugguggcaucaggcuccaucuauuacuucuuaaguguuccuugagauggagucaguuucucucagagcccugguaacucuucugcagugcuggccgcauugagaccauaugcuccgauuucuccuuuucucucauacuuccuccaggagguuccgaucccuauucuccucccucuggacaggucccauucuguaacuguagcuggcucagaacucccuauguagacccgguuggccucacugccucugcuggaguucugggauuaaaggugggugccaucauaccccuagauauuuuuggaacauaauuuacauacucuugcucauuguuauucucagacacuuuagugguucuuauuauuaugacaaacugaaugccugaaccuagaccauaaguccauugugcugugacuucuauucucuuccuaauuauaaaggaaacuuauuuuacuacuuuaauuaucguuugaggcuuucauauacaaauacucuuaacaucucauuuuuaccccacacccccaacuccucaaauuccuagucuuuuauucuuuaguuauuauugucucucucucucacacacacacccuacuuauaaauauagccugcugaauugauuuaaugcugcuccuauauguauacguguuuagggcagacuguuugguauuggaucaucuaucacagggcuugaagcaccugugaggucaugggcccacugcugauacagcacugagucuuucucacaggccacuagauucuccucugccuuugcucucagcucauuuugcuuuccccaucaggagugcugccccaccagugugaucuagugaccacccacuggacacaaccccugacaucuccuucccuagucccaucuuugugucauuagaguauucacagcaguuuauuucaguuguuuguucuacuggauuguuuguaaacucuucaaaaggggcaccauuucucuuaucucuguguccuugugucugcucagcacccgacucaaagcagguauacaguggauauccacuugagcagaugagagaggaagcccaguggcucuuuggggauuggugcauugcacauugaggcaucagcuuuucagguuuuccuuugagaacuuuguccacuuuuuuuuuuuuuuuuuuuuuuuuugucaagaaagaagaaucuagaagagucaagaaaaaccaagaaugucauuauucauuugcuuuucuuugugucauggccccaaauaucauucauaugauugauuauucuuuuccuucccuccuggugucuucuuucagugcuagucagcuuucuccuaaguccuguggaaaugaaagcagggccccuguguguccccagccgucacugcccugugugccaggcuaauccccagcguugccuagcuacuccaggcagccuagauacuacauugauggacagacacuguguugguuauagauuuauuucccacagagugauugagccuguugugugugaaguucugugcuggcuucaggagaaacucagaaaugaaugucacaggccuucucugacuguggcuuuugaggguugaguugguagggagcagugguggagcagguauccagggcuggguaccaaagucucuagcuguccaggagcauuguucugggaucaaucuugucucaguaguuuuaggagucugaucuaaaaaagacuggaauuaaaaauccuauuuuaugauuucagacauuaugacugaaagcaggcuguuccccaucugcuauuggguacucuaaagagaagagguuguucaaaucucaacuacucaagggcacuuguuucuuauauggaacucuggaauguccuaugacuguucuuccuccuagccuguugugacauuugaccagugcucggagcaaguuuccuuguauuugccucuuaugguuccagcagcuguacugggacaggccaucuuccuggcuauccuguguggauggacacaggccuuacuuucccagaguguucucuugcccuuguaaggagugacagacagucagacucuagccuguguagcucuugaguuuucucucucuuuguuguuguuagcuuguucgguaacaaaucacucaguuuugaauagaacaaaacuuauagaaggccugauuuuggaaaagaagauuguagucgcuuguggguccccccccccccccccccauaagaucagguauauuucauuucaagaucuccaguguaauuuucuuuugccugaccagcuagugacagaucagcuguaaaacgugggaaagagugugugcuccuugagcaaaccuuaaaagcuuuuagagagcuucuuuguggugcauagaaccuggaggacuucuuaaggguuagagcuagagucccuugugagcugaccuucaugaguguugucaccugugaugagugagcuucccuguggagcacgugcugagcucuuggguauuaagggguacuguguuaccggggucugcacaguaaagugcugcuuaguaguguguugugaccacagcuguagcucuguaaauuuuuaggaaguuuuuccacuguaguuguuaaaauacaggaggcucaguacuguugguucaugaccauuuuccuuugugaaguuuacaauuggaaucauauaucagauuccacuuugaggaagugaggugaugcuaagaaugaaaggugauaugcugagcucuguugcugucaugugucucuuugcuuguuggcgcuuugaggagagaagagcaggauggauggucaagaggaggcugguuuggguuucuugccugagccaaguucuucuaagagcugcccaccauuggguuuaaauaacagcccuuuugugacuugcaucuuccauuggcugcuaguuucuagaaaguuauauggauuuuuuucaaaauuucgauaaguuuauugaaugaccuagugaaaaaaguguccuggauagaaaaggugauucgagcuuucuuuuucaggccacuaacugacagacugcauuuuauuauguguauccugaauugugacucaaagggaugacagcaggcagagcgugaagauuggaauuguaaagggauaaacucccuuuuguacaucaacguuuagucugugggaugcuguugugccccuugggucccuucccguuucugaccuaaggaaagugggacucuuaggggccccgagugucagaugaggaggagaaugcuccuuuucacuguauaggugugccuaaccuuuugacauugugacacaaugucaucuacaaaguaaacacuugagaacaaugcaguugggaaaaagucacauacacaugaaaaacaucugagucuuaagagucuacuguucuacauugggcagcauuuauagccauggucagcuacauaaaggguguggguuggacagaccugaaccauccuagcugugaugagguggacaagaccaucccucugugcauaucucugugcauuaucuuguucaugcggaagcucuauuuccuauuaugagaugugugcugccaccccuuccccuccuuugccccccugcuugugucuuuccugaaugaguggacaggaugccaucauggcauucauaaggugucacugcugucuccccacgguuuuaaauaguugacauuuucccaaguuuauuaguaguaguaauaguacuuuguguguguguguguguguguguguguguguguguguguguauguauguguguguuuuaagaguaugcaugcgccgggcguggugugucccagcacuugggaggcagaggcaggcggauuucugaguucgaggccagccugguuuacagagugaguuccaggacagccagggcuacagagaaacccugucucgaaaaaccacacacaaaaaacaaacaaacaaacaaacagagcaugcaugcagaggccugaggacugcuuucaggcaccuguccucucuuugcaagauggaguuggggauuagaaucagguugucagguuuaugcagcaagagcuuuuaccugcuaagccauauuacuggccaaauuccagguuucagaucagaguagagguagaagaggaaacauuuuggggacuguucuguaaacuuuauugcuguccuugaaacggugauggaaaugacauaacuaaagcuccugccagggcaaagauucacucucagauagucccagcacuaaaagcuuguccccgcgccagcucugccuugaacuggcauuagggaaaauaagggccuuguaaacuggaaggagacgagcagaugcuguagaagcuauuuaugaugcuccgcugcuaggugguuccuggacgcacuucccauugcauggacuggaaugaucuauggaaaguaguccgagcacuggcuggcacgugcuaagugcuauaaaaacguuggcaaauauuguacaaaaguaagccauaacugagcaagaguguggaggagagugcuacugcugcugucugggaagcgccaaggccuggguuagggccugugcuacuuaauccaacugcuaaaccuuuuuuaggaggcccugagugugcaguuuguuguguuguuguuauuguuguguucuuuucaugucuuuggucuagcgagauugagguaggugucuaaaugucuuuauugaagacaugaaguugcuuugaugcuggcuagggucuggaguaggcaguuuuucaguaacacuugcucuguuuugucuuucagcccugggcauuuccugcccgagaguuccuucgcaagaagcugauugggaaagaagucuguuucacgauagaaaacaagacuccccagggacgagaguaugggaugaucuaccuaggaaaaggugagcagcaagaggaauggacuuguuaguuaaucuaaggauccguuuuuauugaggcggaaggccaguaugggccuccauguccauagcucuaggacaguugguaugggaacuguugcuguguucgugcauaccucuagcagcccugguccuuguucaccacugugcuuucuuggcuugcuguagggccuaugguuuacugcagcauccuucuucccauggaggccacucaccagcuccuuguuguggggucagagugcuaauugaauuccuauagauuucauauauuucuuucugcauucuucuaucuauggcuuuuuucuucuuucuagggacucuuuagcaaaagaucuguuuggggacggauguuauuuuuaaaaucugucucaugguuuaaaauaaaauagaaugaaaacugguguuggaauuggauagaugagguuagaauucugacuuuccuauucuguaucuuuuuaccuuuugccuauauaggcccuaguuucuucauuuguaagcuuuuuguuguuauuguuguuuucgagacaggguuucucuguguagccuuggcuguccuggaacucacuuuguagacuaggcuggccucugccucccaagugcugggauuaaaggcgugugccaccaccgcccggucauuuguaagcuuuugagagauagcuuuaagacuuguaaagcagggggcuggagagaugauucagcgguuaagagcacuggcugcuuccucuuccagagguccugaguaucccagcaaccacaugguggcuuacagccaucuguaaugggaucugaugcccucuucuggugugucugaagacaccuacaguguacucauauaaaugaaauaaauaaaucuuucuuaaaaaacuaacaugguauaucaucauuaacuuugugugagcacacucaugagugugcgcacauaaacacuuauuguuuaguuaggccaugauucguaggcuauuagaaguuguggucuucuuuggauuggauucagaguguguaaaucuugagaauagcguuuugagugggcaguaggacaaugaaagaguucguuuucuaguuaagagcuaggcauccguggauaguuuuagagcagauuuugcucuuuauuaagcuuucugugguuaguuaauuagaagucuuccuaauaccauaacaacuuagguuaucuauuugaguagucauuguugacucuaggccagaauuuaaaaaaugacaucccauuaaggcugagcuauacaaguucuagaaaagugaauugagaaugagaguggagccaucuugcccaguucccuugcacauauggaggguaggagaguagaacuugugguuagcccacaacuuacuauagaaagauaagaaagucucuugacuuuguagcacuggaacuugcuauauagaugaggcugucuuggaacucagagccucugccuucugagugcugggauuucagguguaugccacuaaggcugcuccucugacuuuuuuuuuuuuucccacaccccgcuccucugacuuuugaagauaauuaucuaccagguccagaauguuaucaaguugugacucucuuauucauaauuugauaaauaugugugauugagauccuaggcuuauagauagauauguuuaccuuucuuugcuuucugucuaucacauuuuguugcuuccuuugaagguucaguuuaagagaauguuauuuuucuccuuucaugagaaauauucuauguuaguuuuccugaagaaaguagaucaaggaagggaaaguuugcuuugauuugacaguguaaggauauacauuccaucauagcuggggaagacuuggcagcagggccaugaagugccuggccacguuucaucucuggucaugaagaagagaagagugaaugcuggcacucagcuuaauuucuucuuuuccuuuuuauguagacagggacuccuccaccugacagagccacccacagccucgguagacauucucuucucacaccucucuggaaacgccuucaaaacuacaccuggaguuguggcuccugggugauuccacaucugguugaaucaccaauugccgaugaauauuaacuaccacucccuuugagaacucacuuccuaaacgguucagcauuucagggugcucuguaacacuuugugagaguuuuguugauagugggccugggcuucuuuucucucuucugacuuuuuugcaucucaguacucaacuuuuccucauuguagcaucuuuuggcuugacuuuccaccuuagaagucuuauuuuuugagggaaccauuauaguauuuacuaauauuaaugaaaucuauguuugaauucaacaggaaccucagggcaaaggaccaggggcuuagcugcagaacaugagagcccuuuauauaaaccuugcccuaaacauuucuugggagagaaagaaguaugcaguuugccuuuguugagaauugagucuucggguggccaggcauuagaggugugugcauguguguguauguaugcacaugggcuuguuagugcuugaggaaguaaggauggaguuaaugugccagguaaacucuuccagaauaaaacucuaugcuaauguuaccuaucaaccagagcauuccauuauagucuaucugggagcuugcucucugccauaguaaagguuuuuaugcagugauaacugcaaagaugucuuccuuuaucguuuuagcugacaaagauugaagagccauacugagacuaaaagucuuuucaguagaauggcugugcaauuaaugucucggguacucaggaggagccuuaaucagguuaaguucuauguuuaucauccuuuucuugcuuguucuguuggcugcucuguggaaaaaaccuagacacugcccucuuagucagucuuaaacugggugucuucuuagucuuaagucuugguguccuuuggagucuagaaugugccauggagaggaauuggacuuucuggugucugugugauggcugcgcugagugcguuuauccgcaucuuccuaacuccugccuugcacuguguuggugauuugcauuacuucauucucacaagaaccaguggggcaagugcaggcccugcuuuugaggggaagacaggauucugagagaacuuuuccaagcaguaauagggucucaucacucugcggagcuaccugccaugcaugucagucucccguaguucccaagauugcuuuuggcauagaaaucucuagaaaauuaaaaacagaguccugggaagaaagaguauccuggagacuagauguuuugggaguuuccugagaaucucagugcuacaucucugccacagcuuccccauccugaaaagcgaggaugaaaaugguccuuccucugugcuguugcuggcagaggcagguuuggcuccugugguucauuuccuuccucagauacuaaugugguuaauuuucucccucagauacuaauggggaaaacauugcagagucgcuaguugcagaaggcuuggccacccggagagaaggcaugagagccaacaaguaagcaugcaacuucucuuggggcaccaagagguugggagcccaauaagcuauuuuguuucauguuauuuccguucucucuuacaaaaugcauagcuucaguucaggcgcuuuaguuucuuccaagauguugcucauggauuguuuugagucaggagaucacuuaacauuucucaaugguauuugacuuauguauaccccuuuaaaaacagaccuggagaccaggcagccauuuauuuauuuauuuauucauuuauucauuuauuuguuuauauucauucaugaauuauuggguuuuaggccauagguaugcaauuccagacuauuuccaagccagccaacccaaauauuuauugagccucaacuguguaucacucgcuauuccauucagagaauuuagcaguaaguagacuuaggcugggcuagcauuuuagugggagacagacaacgaaaaggugugaugcugauaagaucugacgucgugucagguguaaggaaaacggcagugaaaaaaggagaaggaaagauucugcuuugaaucuguuuaauugacagagcuacaauuucuuggauuugaagauuaguaaaaccuuucuuuucuaagccugugcucuugaaucuguagauauuucauuaauagauaaaauauauuugucuagccaaugguagugugaacuuguuagaagacauauauguuaggcuucuaguacauaaucauguucaaguuuacuaguauucucaauagggugaauugcagcugacuuuaauuaacacuuuagacucugaaaagugauauucuccaucaguaauuuggaggcuauaagcaugcuguuuaaaccauuaaguccuugguauguuguaacugcaguagcugaagaaaagcuuugaauaaauauuugcaucacguguacacuugaugagaaugagccaaaggcucaguuguacuuuuugccuucuuucuguccucugaggcucuggggccaggucacucacuguuuaccugcgguccugucugauuguaaggagacuuuuguuggacucuguaauuguuguugugugccugugggaauugguugaauuaagacauuuguuuuaggugguguuuuuggaagcacgccacaguucuaacuuaaggacaauuacuggcaugauuacuguugcaguguuuuuuuuauuuauuuauuuuuugaauucaguuugcaaguggaauaaaaaacaaaacaaaaccaaaacccuuuaaccauuuugucuugcuucuacuggaacaaguaccaaucccacuagaccuaaagcugccucuuguagugguuuuguuugcuccuacuuaugccacccccagagucucaguaaucuuacuuaacugugaaguggacaucucugaguuuuuuaguuauguuuugggugaagagaagaaagagaggacaagaaacuuccagcuuggaaaauguuaggugaggcuugcuuagacagaaauuccuagagaccaggauaagaaauucaguguauggauggcgguggauggucucaggaauccugcagagaacaaccuuguaguucccugcuuccuaccuuuagcucagaugggaggguguguggucauuucuguacuaagucuuucccccuuaagaaguaauuguugcuuuuaucuuuuccuuuugggugguucuacuauugguuuccauaguagaggaagaggcuucuguagcugucgcugucuucagacacaucauaagacgaggaggaggcuuuauuuucaaacugccuguugucuagcuggccuuguuccgugucuaaacaauuuugagccacuauuaucugacagcacuguguccugcagcugcccccaucccucuuguggauggagaaggccuuaagggugguucuuagucaccuucccugcacugucccugcugagcagggccugccuucuggaaucugggaugcuuaaaugcauuuguacccccuggaguggcuccccuuggagccguuaacuuguucuauucuacucucuggcagaaguacugcauguucuguagagccucucauuaaaugcucuuagaauuucaucuguccuuugaaggaacaaauuuggaauuuguaaauuuguaccucuggugauuuuuucugguuaaauaaaugccuuggucucuuuuaggggagaagauacugaagaaaccaacuggcaaggagcuccauagcucuguuugugaaccacuaaccacaauuuguuugccuuucaugucccagcccagagcagaaccggcuuucagaaugcgaggaacaagcaaaggcaucgaagaaagggauguggagugagggcaacgguucacacaccauccgggaccucaaguacaccauugagaacccaaggcacuuuguggacucacaccaccagaagccagucaauggugaggauggcaggaaaaggcugacagacucagucagggugauuucuuucuguuugcucucuuugauucucgggguuuauaagauccagugagucuuucuuuugcuuacuuaguauccaaagggaauccguaaggguuaaagaacauggugacguuuuagaaggggcuuugaauugguucacaaagcuuacuacagcuguguguugcugaggcuagcccuguacuccugcucaucauaaacuguuaguguuuggcacacuguguacuuuuuguucucucaaggcugcuuagacuaaugcugaaaacugaagggagaaacacauuucacacacauauaaacauaugacauauuuauaugcuaugcaguuuugcuccuugggucucuuacugacuacagauuuagaagaaucuaagcaaggccagugaggguuauugggucuuuggugagcauucuagguuuuggagaguagaggugcaggaggucucaggagguucagaagugagaagcagguuugaccuguguucuccuggacucaccaugugagcuuugcucuuuagccagugcguuucuguuucugugagggaggcuucucaggcuuuugggcaggagauggguuagaugcaguagguugggcauuguguaauccuggaccaacuuucucuaauggucaaaaaauguuuguucuaucauucagcuaucauugagcauguucgagacggcagugugguccgggcccugcuccuuccaggucaccaccuugucaccgucaugcucucagggauuaagguuagaccacacacucagcugcacaguggguuugggguuuguggaguguuuguugaugggcagauuucuuuacuuggggaauauauauauuuuguucuaggagucauuggcuagacuauuucauauuuauuuugguuuaagcuucauagugagacaguucuauuagauuuaaaguaaucaaggccuguuugguuuggggcaccaaagagaccuuaagacaugaagcuaggaauaaagagaaggaggucugaguggcucugaagcuuuguagauaugaauugaguucauguccaccuauccauguguguucuaaagaaucagggguggaaagcaagguauugccgaauugucuguugguaaagggaccauuuuaaaggaaaguaaacugcuccgcgugcuguguuucauuugucuuuaacacagagcuugauugcucugguguuuuaaagauggucagaagagcagcuuuucgaacucugaguucaggcuguggcccucaugccccuuggaagccugauguggguggggucacuggcucucaccucaucacuccucacuguccuuacuguccuuuagugcccaaccuuccgucgggaaacagaugggagugaaacgccggagcccuucgcugcagaagccaaguuuuucaccgagucucgacugcuucagagagauguucagaucauucuggagagcugccacaaucagaaccuucuggguaccauccuccacccggugagugggcuggaccccugggcugaugguccgccuugugcucuguucaacauuguuucaaaucuuggcagguuucuucuuuuuucuuuuuguauuguauuauccauugccuugagagccuuuccuguguagauaccauuagucauguaucuaauuugugauugugcacaaaucagugcauaaguaaguucaucucaaguguuccaggcuuuauaaagggaagucuuggagucuggaaguugccauugccaguugaaggcuggggaguaggacuggggaguuucauauguaggucuagaauucagcucuccuggaguacugacacaucaaucagaaggagacugacacguggaaaaauuauuucccauauucuuaucuuuaacaguucccuccuaauucuggagcuuggguuugggguuuuuauuuuuaauuuuuuuuauguuguuaaaguugugacuguugggaauuucacucuguuguguaccuugauagaugugauauucuugcacagguaaugaccuugcuuugugagaacuaaguggauuuucaccacuguaauggagauguaauacacgguuaaccugccguuacuuuuccagcuagaugacugccacgauggccgcugcagaaggugggcaggcucgguuugcagggugccaaggucaugucuguuucuucuggagugcugacucucuggccaugccugccagaugguucugugucaaagaagaauaugaauuguuauucaucaggcaaaauguggcuugugcagucugcucaucagcuuucugccgauggaaaggagaaaaagugcugguucuuagagggagagaggagcaagguguaaucucuucuaaagauuaacauccucccuugccccgaaaagaacuauugaaaugucguucccuucugugccucuaacauuuauucugcuucuguuaaguaguguugcuaugcuggguguuguugggacaugaggcaaggcugccgagaggagucagaguggcauccugagucuuaggugugauuucuuagagaaacuacauuuuccuauuuuagaaaaauugaaguaccagcuagacgguggcugcauuugcaaugucagaaauagaaaacugauuucuuggugcaacagugugugauuugugucugucuucucuugugccucgucucuuagaaugguaacaucacugaacuccuccugaaggaagguuuugcccgcuguguggacuggucaauugcaguuuacacccggggugcagaaaagcugagggcagcugagagguaaggccugccagggcaccuugcuaaacauuucagggaaagaagcuggccaucgucucucacucgucugucuuauugccuauuuuauuucaguaagggaauugggaaaggauagcaugggcuguccuguggagugacucacauauuaaaauuuaggucuauguuaguuuaauggcuggaaauaaaggcuuaguguguguaugugagugugcccaugccaugauguguggaaggcaaagaacaacuuguguugaguuuguacuuucuuucuaccacaggggauugagcucagguccuucacugugguggcaaggacuuuuaccugcugagccuuugccagaccaucugacauuuuuccuuacuugauuuacuuuuuaaauguuucuuagucacuuuucuccaaguuucccuaucaaguguucuagcuuuaggaguuugaaguaaaugauggaaugaauugcucaucagcugcucccaaacaggcaagcuuagaacuaugaaggagagguagaaccugugggcucuauacagggaccaggccauuacaggcugauggcccuaauguguuugaaaguguauuugaauuuuaaguucugcauuucugaggugaugacaaccuuccagaagucagaaacgagcaucuuaaagauuaguagcuuguucagguauagcuagauguugagcucauuuguggugguguggauggaagaaaauaaagcagguaacaagcguaauugaaggggaccaaugccauguaagccuggaucuccaacuccaggagagugggagcgagcagaagaggaaauuaguccugacagugggcuguccuucagcuuccuggcauggaaccuuagcucagaaucuuacaaguacaguggcuauguuaauuuguuuuuugccauucauguguacaggugagaaaaaaaaaaaaaaagaaugauucuuguacuuguuagguguuuucucaggacuuuuauuuacaucuucugugccuauaagcagacauuuguaaguuuuccuggaaacauauuuuaaucugggacacuggauaggauauaucugacaagucuauauuguuugauaaaaagccagagggauugcuuaauuuuucagaaguuauauauagugccacaauuaaauuggaaagauauaagucuuguagaugaagcacuucaaauacuuauuauucugugaugcucaauuucuugcuugguucagaaacuucuauuuucuacucauuacuguucuaaguuauuuugguugauaauuuucuugauaauuuuuaaguuccagcuugucuuugaagaaagugaguacaauuagaauaauguauaugguuucuaacaguuguaggagauuagagauuguuuuuuaaagagagucacuguaaaacaggcuuagaccagagaaugcaaaucaucucucacuguaugaucgcucgucugccguuuuguguugcauaucugagcuacuugcauuguggguacaauuacgugcuuucuguggaaaugcuuucuguauuuuccagcuccuggcuccuucuuugucuuuuucuguauuaguguugccuagaaggccgguugcaguacagcucucggaaaacaucgcugucucccuuugcacaugcauccacuuagucaugaacaguuuaagagagcuguucauugauuuuuuucuucuucuuccucuuccucuccuuuuuuuuaaucauuacacauaaucuccuacucuuggucugacuuagaaaauaaucuacuuugcuuaguauuuuaaaaugaauuucugacaucauggauuuugaacuuuuauuaaugaauaaggucuauuuuuuccaaguacacuuuagauacccuauauugauauuuucugaguugaaucugauagcugauaaccccuuuuacaauccaaauggcaaccaggcaggcuugugauucuugaagaauguuuuucauguauaucuuauaguacucacucagaagauacacauacgccagaguuaaucauuuagguggccuugugcuuucugagcucagacauucacauaccaggaucucaguuggccauucagaaguguacuauguacauuuuuuuuucuuuguuucguuuuguuuuuugagacaggauuuuucuguguagucuaggcuauccuugagcucacagacauccgcccgccuccgccucccaagugcugggauuaaaggugugcaccgccacugugcugcuucuuucuguucuguauacuuuacauuuauagucagacuauggucuucucugggucuuuccacaggguaggguaggauuuccugcuuaaccugcucccaugcuggcgcuggcuucaagcacaauggccugguccuugaaugauuucgcauccuuguuuuguugccagguuugccaaggagcgcaggcugagaauauggagagacuaugugccucccacugcuaauuuggaccaaaaggacaagcaguucguugccaaggugagucauucucagcauguuaauaugcagaguggacauugccagaccagugaugauacaaggaucugaacaauuagagaugcuguagcuccugaccguuacagagaagacuccaccgugugcgugugugugugugugugugugugugugugugugugugcgugcgugugugugugugugugugugugugugugugugugugcgugugugugugugugugcgcguguaugugugugugugcgugugugugugugugugugugugugugugugugcgugcgugcgugugugcgugugcgugcgugugugcgugugugugugugugugugugugugugugcgugugugugugugugugugugugugugugugugugugugugugugugugugugugugugugugugugugugugugugcgugugugugugugugugugugcgugugcgugugcgugugugugugugugugcgugugugcgugugugugugcgugugugcgugugugugugugugugugugugugugugcgugugcgugugugugugcguguguguguguguguuucucaauuagccuagcuucauuauaaguucuuggauuaauguugagagcauugcuagaucaaaauagcucucauaccugagauaucuuuuauuugcuuugcuuugcaccuggcaauagggauucccuguguccucagcuuucuuuuuaguuucucuggaacucuugugguuucacuguuuucacugccuugaauucuuuacugacugauguguguuggguggauugcuugcuuccuaggaacuagaguuguucaguagauuaagugguuauaucacuagugcugagcaaaauauuuccuuuuuaagguuucagaggguagaguucuaugcauuccuaaauuguaugaaguuuucagugugauuuugcuuuugcuaagaggcacugaagauuuugucuauuuaggcaaaaugugguuaaagaaccguauuuguggaugaacauugggugucuccaucaguuaaccaugaauugagguuggaaagucacuagguggcacugucagcuugagaaauccccaaacuaucuuauaaauguaaaauuuuuauaaagacucuugaggcauuggcugauggauuuucuucucacucccucuacccucucuccccuucccgccgggcccccccccccccgccuccucuuauggaaauguugaaaguaauagguuucagagcucaacuggccucuccuccccuccuuagcagguaucuaaguagcuguuaggggauggcaaucaucacucucuuuaguggacaugaacagcauugucuauggggacagaguugccaguguauccuccauauucugagguagaauacaguggcucuuugcuuccuuuuucugaggucuaugcuguugugcacuuggacaugggcugcuuugccaucuugaagcucauuuaguuuugcuuacauguccuguaaguaagaauguaccuacacaaaggguggccauccacucagcagggagacggaucuucaguuugauaacauuccuaagaggcugugagacuagcgauguaggugagauuuagaaauguuucccuggcccgcucucuuucuaguagauccuacugauuggggaacuaacgaguugcuaguaaagaaagaauucuaaagaaguaaaugucugagccuugcaaccuugccugccugucugucugucugucugucuaagacagggccucacuguuuuucauguuagccaccaaauagccaucaucuugccucugccucacucccucuucccucucuccccuccccuccccucccuuuccauguugaaaguaauagguuucagagcucaacuggccucuccccuccuuagcagguaucuaaguagcuguaauacugggauuacaggcacauguucauuuuaaauaugcuguguugccuacuugaaaagggaggaauggcuacugcaacauuucuuccacuuuuaaaauccaggauuucuuguugucuggguuuuguuuuguuuuguuuuuuuaaacacaguaagugucuugauacucaccacaauuaaguuuuacugauuacauugccaaagugagguuuaugaaggaugaugcuuucuuuagaauguuaauguaaauguaggucauuuaaaaaaaagaauuacuuauuuucugucugagaacacugcugcugucuucagacacaccagaagagggcaucagaucccauuacagaugguugugagcuacugucugcuuggaauugaacucaggaccuguggaagggcagucacugcucuuaacugcugagccaucucuccagccccaaauuuaggucauuuaauggaagcuccauuuagaaaaauauuuguggauagaaaaacgaucuuuauguuuucuugacuuuaaaacauuuugaguaucacuuuuuauaugaagcaguaguagagcacagaggcgguaagcaaacacuccuugaagacuugugacgggcucggcuucuacaugaggcuguucacaccgcccaucgcagcacuggccaaccacagccccugggucaaauaugcuacuacccccaguaguacaugccuuguggauuuuauaaagaaaaagacuauuguguggcauguaaaaguuaggugaaauucaacucuacuguccugaguaaaugcugucuggccguguauacuuguuuaaguguugucugaggcuuuuuuuuuuuuuuuuuuuucuucuuugaggcuagggucucuguaugaaguucuaguugacuuagaacucucuaugaaaacuaggccuugaacucacaaaccuccaccugccuguacccuccaaaucuaggauuaaagacauguacugccaugcuagugacucuucaugucccaguaucagguuguucaugggguauguaauuguuacugaacuguuuaguagccugaaaagcuuaaaauauuuauuuaugaauggaauauuuauuaucugguucuuuacauuguugugaccaaguaucucacaggaacaauuuaagagaggagugguuuguuuuauuuuuggauauggcgucacggcuggauaggcaugucaccagcaauagcucuguccauggaguuaguaggauguggcaaaacucugcacagggcuggaucacgaagcugaguucagaucagauuugaaccccugguggguauugaaccaccaaugaauauuggugguucaaaucugggccuuuaaggcucaucacuagugaccuacaucugccaaauaaaugacacauugcagggguucuuuacucuuccaaaucaauaccaucaucugggaagcaagacuccagacaacagacuguagggaacaucacacacucaaacugugccagucagagagcauuggugugacaucaggagauugagaugaauagaauccagguaaguucuuucaugaagaacaagagacuccaaaaggaaacaguauucagucacauguucaucaucucgccguagauggcagccacauuguucauuugacaugaaguccaugguagugaucgugaacugccuguaccucucaaaugcuuccauuacagacaugugacaccaggcuuguccaugucaagagcuuugagcaguuggcucuuuuguaccucugaauacaagauuuauuuguuauuuucucuuuuuuuuuaauaaugcuuuuacuucauuccauaagagaaaacauuuaaauuucucauucaaacacaaauauucacaugggcauacacauggucuuccccauuuuuccaauaugauuaugacuuuguuuaaauuaauagucaguauuugccuuguaaagcaaauucuuuauuaagagcuauauugcacagcaaagcuaauuuuuauuuccuauacuuuguguguucucugaaguuaauauuguuuuuaaacauuuacaugcaaauauauuacacacauuauuaauucaacucucaguucucugccuguauguuuuugucucaaaacauccauucaguuugcuccucuuaccuucgguaauucugucuugaaaccugggcagugccaaccuggacuaacugauuguuuuuucucacaguaugaauuuuaccuucagauuucuuugacauuaucauaggugguuucuuugucuugcuuuagauuaggacuaugcuuucugcacccuguggauuuuccuugauucacuccaucauuuucguggcauacuuguuccuuucuucaugacagcagacuaguugagguaaucuuugaagccauuccauuuauccuugguuagucauccagucuacugugcccgaagccauuuuccaggaguccugauauaggauugcugagaggucauuuagguuucuuaguuuaguuucccuaauuuccuaaauuuccuaggauuuuguugucauuuaguccccccaccccuuuuggugaucugaaugacugauauuuuuucauccauguaugagucuuuuucuuucuagaaagaauuauggaaauccuuuaaugauguaauguugugcuccagucuuagcucuccagguucacgucuccccuaaacggcuuugucaccuuucauuuauuuucucuguucuuccuuucccagaacugcucacauuuggaagcuguacuugguggcuaauguuugcaucuuuccuucuuauuuucuuugucuuaaaaaaaccuguuuuguuguuuuugagaugaagguuguauuguauagccugugcuuaucuugaauuuaagauucuccuuccucagccuccaaagugcugggaugauaggcaugcaugcucccucccuccuuauucauccuuccauuucuaagaauuucacuuguucaaaugcaucucuucuauugcuauuuaaaaccaaacuuguaaaacucguuucaggucauguaguucucugaagaauuaccuuucagucuacaguuuuccuuuguguuccuugugucccucuguugguuauuuugguccaccauuuuucauauucgaggcuccucaaguauuugauagacuuugguugucuuucauuuaagaauaagguuuuaaaauacuaaguuacaagcauugagacugugcggauuuugggcauaugucuugaagucuagcagcuguuucaaagauuugaaggcaguccugguuuucagcuccuugguuguuacuuaagaugccagauuugguaguuccggagucuuucuggacagcuaggggagagggaauggggcuuccgcacucucuaucagaucaccuguucguuuccucacuucugccacaggauuugguuuuuagugagccuguggagugagcuagucauccauuuacacacuggcuuucaggaucuuauggcuggcagaccuggucucagauuaucuuuauauucuugagcuuauguaaguagaugaauagguggguuaaacacauccuuuaauuuuuguuguuguuguuuguuuaauaauuguuuagagaaggaaccaaaaaaaaaagcauuuggaucaacuuccuugauugguaccuaauauuucacugugaagcuauaccauaauuuauuuaacuagucuccagaagguugcuauucauguaagcugguaauuuuucccauacuuagaaaguguacugagugucuguaaaugcuaguuauuuccucagagguaguuggaauauuuuugcaaauaggucuucagaacuauuaacugauagaaguaggcuuauuuucugauuugugcccaaagaaggauuggccaccauuuucugaaaggaacacauaauaaauauuuguuaggcuuuacaccucacuguuuuuuguaaccccaaacccagcuguagcucaauaguaauuuuuaaauaauugaaaauguuaggagguggggguguagcucauugguagaauguuugccaaguaugugugugggccuaaauucaauccuuaguuccauuaucacucccccugcaaccccuucaacacacacaaaaaugguguguuaaugcccaggaaguucucaaggcagucuaacaaaggucuuuauggccuagggcccucacacccacaguuuaaagucccacagaccuccccaaucaauuccaaauaggggcuauuccacaguuacugugcaguacaggagcuaauucuacaggacaucacuaaaaucgucugaaauccuugaaaagguaacuccugaccucuucagcggggacuucugcgucuccuaguugaauucugaaaagcuguagaugggucuuuguuaagagggucacuaugagaaaucugaaaacucagcuaaggauuuucuuauacaucuggccuguugaaaaauugguuuucaucaucugcuuaagcaguuuuaucccugaaagaaagaaaugcaaaggaggccucuucuugucucuccagguuagcagagaagcauguucccuucacagcgauuagcugagccugccugcgacuuuugugccuguuguggccugccaguucccugccugccuucccuguggcguuuuagcugaucugugcaguuuguagccauaugguccccugagcacguggcuuggcuucccuguccuuacugcuggaucugugggcauugcagauuucacagaccugaauagcauuguugggggcagggggaaagcgcuugucaucaagagaugucuucucacugcccugcuuguuagagaccuucucugcuugauagcauaaacaacacucaacauuguguuuugaaaagauguaaaauuacgcaaacuccuuccuucaagcucauucuuugagacuuugcuugagagcucacauaguuggcuggcauugagagccaaagccaacauuggagagcagguuguaagguaacuagggcugcagcauggaucugcuggagugcagguauuuagucagaauggaccugacuuugccccggccacuuuuuucuuugauucuaguucaugaauucuuccgcaucauggcuauagacguuugauaggagguuucugagaucccgcccccuaguuuacuuccuugaaggaucuauccugauagguuuaccauggcaugccauugcagggugcuguacuguccccugugcuugucaucuuuguguagccugcuuuagggaaaugucucuguaaguccuuugccugcucuucaguuuuuaaaaauuguuuguagugcuggguguugaacucaggguuuuuucccguuuuuaauugcacugcuugauuuuguuguuaaauuauaggaauuuugcaaauauucugagcauuaagucuuugucagauacaugauuuagaaaugccaucuuacauuuugugggcugccuuuuacuauuaguuguacuuuggugcacaaucuaauuuacuauuuucauuauuauguuugucuuugguuuuuauaaccaauagaucauuaccaagugcaaaacagugauguuuuugcccugugauuucuguuaagauauuuaacguuucauauuuaagucaccgauccaguuuaagucagucuuuagugugguaucaaggcuccagcucgaucauucaugccuucagcuuuccguauugucuguuguagacugccuuuccucaccuacugaauucccauccuguccacagccaucugaccacaaaugcaaagcuucauuuuuguccuuuuuucacucgucugaauugcaagucuuuaugacaguucuauauggcuucuauuauuguagcuuuguaguaacuuuugagauaaagaaacaugugcuauccaguuuuguuauuuuugccuauuugguggcccuuugagcuccaaagugaaaauuuuuuuaacauguuuuucuauuucugcaaggccagaucaaaccgaugucaaacaaccuaucaggccacuuugggugcucauuuaaguaguacauauaguaagccaugaacaauaccaauuggcuuguuagcuuacuuuguuucuuaauacuaugguaaaaauacccugacaaaacuuaaacaguaaaugaauacuucugguguucauuggcucuucuagcuuaggcuaccaaauccacauucuagucacaauauauuuccuaagaaccacacagguuugugacagcaacaccucacaccugcuacugauuucucuccuagcuuuucuuuccucuuuuagcaaaacugacuaaaagcaacucacaggaaguuucuuuagcuuauagcucaucauggcagggaaguuguaguagaggagcccaaggaacuaguuuuauuguaucuauagucagagcaagguaacauugaaugugugcaugccagugcccagggccugccuacucuccucuucauucugcccaggcccaggcugugacugggugcugaugaaggugcugaugcuggugcuagugauggugguguugaugauagugguucugguuugugaucuucccaccucaguuaaccaacuuaagaaaaugccucacaggcaugcucaaggacuaaucucgggguugguucuagauuuugucaaguuuacaacaguauuaauauguaucacacauagccugugcacacagauuaccuguaaaucugugaaacugcauaugaaaagaaaguaaaaguaguuacauuugggauuuugauagaauuguaucaaauugacaaauugacaaaaucaaaccaaccaacaauaauaauauuguuauuaaccagcaaaaauaauaucgacauuggcaauauuagaucuuacccauaaucauggauaugguuccauuuaucuuuugucuaaugguucuuaucuguaugcaugguaaaugugugcaagugucugugcaggccaauaguuagguaaaauggcuagcuacaaaguuccugaaauccucuuguuccugccucucaguacugggauucugggcaugccugucacacucaccuuuuuucauggguguugugaggguagagcgaucucagcugagguccucaugcuugcccagggagcccuuugccuacuaagccacuucucaagcucccucaguguuuuuuuuuuaguuuguacuguauacauuuuuacuuccuugguuauuccuaagcaguuugcuguuugugaugcuugcuauuggggauaaaauuuagauguuauuguuaguauauagaaauuacugauuuuugucuuccacuacuuuauuaauucaugaguugauuuaauaauauuugaggaaucuuggaguuuucuucauauaugucuuaugaacaguuuaauuuuauucuccuaaaauuuguaugccuuuuauuuguuuuucugcuuaauuucuagauuuauguugaaugcaaguagcuuuuugauaaagcuuuaggacuggccaauauauuuuuauauagucauucagagacggcaaaauacaaacaagugaaaaauuugucacucaccugaccuuugucaaagaaggaacuacaugaugauaaggaaguuguagggaugguuuggccagaacauuagccuccaccgcacugcagauaggcuaagacuuguuuggaagauuucauuaacaguccaguuugcaaaugaauuagaagagauuuaggaauauucuuaggaugguuccagaacaguuaaugcugagaguccauugcuacccuaauguccuuugguauuuugugugaguguggugcauuuguuauaauugaugaaccaauauagauaaugcugguauuaaaugaagucaucauuuuauuuagauuucucuuaauaucuuuuuuucuuucucauuaauauuaaauuugcuuauuuuacuuccuuacagcaucuuagacucuccguguuuuccuugugcccuugauuguuuugaggaguugugagguaguuuguaaggugucacccacccauagaaauuugucugaugugcagcguccucuuaguuauuucugauauauuugguuauaccaggauauugcuaugauuauuaacuuuuauuaaaagcaagcuugcauuuguacuuuuaugauggaagacagagacuaagcauaguacaugauccuagguacaggagaaagaucagauaucagagaucaguaaggugaagggcauggauuucauuucugaugggcggucucaucaaagggcaguccccgguuguccuguagaagcccuguuugguuugaugggcucucugucucuuucuauaccaagauugauauagaguuguuguuggguguguaugcagugcugacauauuggaggguguuuguaccucagaaggugguuguaagcaugcaucaacugaugcaugcugcaggacucuaugaagccaaauagaacagcuccuggauucacagugagcauugaaggggccugugcagauugucacuauggcaggggaccaaagaaaggaucaguauuucuuuuuuccugacacagcucaguaguucucucgacagugguggccuuuagcuuauaucuuaccaucaugaaaacauuuuuuccuuugcaacuagacuucaagugaugcagaaggaauuggauuuaguguguguaaucuugaguccagauggugacuuguuccuuauagauuucugcuccugagccuugggugaucucuuggugugucuguaugaggauggcgugguuagagaucuguagcuuauacuucaguucuccugaugaaaagcucccugagaaauauagccauucaaggguggucuauucagggguggugaugagcaggcucugggugggauccacucugcauuuuacuuacugcacagugugugucgauacccaguaguuuauugcuucuuccaugucuuuguacgcaauugcuguuugcugggcaguaauggcaccauuuacagaggaguagaccucccccccccauacacacacaggcgcacacuuccuuucuucccuccugcccucccucugaaagcugagccuugcaucccuuggcagcaucugagugcgcagcucugaagaggagguugcuaaucagggauaugccaagcagagaaucugcugcuguggccuaaaauuuaagcuucaagaauccauuuacugcugucgcuaacauguucuaaggggugaugagcaccagccuugucagaggggacgcuuagauccucccauucugggaagggggaggugugacacugggauacuuucccuggcguccuugcucucugagcaugcucaccagcaagcacugucaaaauuuuuuuucgugccuugcuguaaggaaguucuguauguuuuuuuggcaacugacaauuuaauaagaguuaauuugaguuugagaguaaguacagaucuguccaagaguaagauuuuugaaauauugugagaugugugcauuugagaugacugaagauugucuuauuuuccuuuggguauccuuuugaaagaauuauugacuggcuaggaacuguuuugcugguauugcuuagagggauuuuuucuucucuuuguuugcaguuagaauaguagacuagcacacuuagucuugaguaagacacgucaugaagcccacaacccucagauugagacauagucauggggccuuuucuguuugggccuguuguccacuguugauagcuuugggaagguauuuuauugauaugaguucuuggcauuaauaugucuaguaucuauauuuuugguuguauguucuagacaguaaguaccuuggagguuuuuuugucuugauuuugauaaauguagaaagcucuuggauuuggagggucuugguaccuuuugauacuacccaguucugauaaccagcccuaacccuaguuugaccucauauuauauauuuuuauuaccugugaucuucaaguuuuucuguccaggaacucagguuugacacugacuuuugcucuguucagaguuacaggguaaucuuaaauguacaguagaaaaauaacaacuccuaauuuucuuuggucugcuuagauccuucauuaucuguggccuuuucucucugcugcuuccauuauucacaguggucaaacccagaccuuuccgucugccagccacagccuuccaugcacgcacagcuggguucuaacuggcaucuguuuccuucuuucucuuugguuuacuaagcuacggccacuuucuguggugcauauuuucuaacuugguucugcuguuugcucauucuuaagauugucccucagagcauucuuuauucuuuuugguaugugauuugcugguucuuuguaaagguggagaauagauguuuuugaugggucuacaaauaaaugaguguauucuuugcugaagaauuuugggccuucuacgaaauaggccuccuuuaagacauuucccaguguucaucuaucaugggaacagacagucuaggugcuuuuguuucaugcauaaaagagagaaauuucgucagucuucccucccuuguggcagcugacccuguaguucagccauucagagauuccugaugggggccugaucgaagcauagaugagugauuuucacucugcagauggaaugaacggugaccaaauuuuguagucagcuacuuccuuguaaugcuugcaaagaaggaagaaaaggaaaaaucccaaacagcuuugaagcaacaggguuuggauguaauugggugaauuguugacugcuggcuguauuaugguuucuggucauagccgugguggggcccugucccagugugaauggcauuuuacccugugcgcacugguggggugcucuaaccuccacagaggcauaucugugcuucuguccuucaaaugcauauccuuguaucccagccugggagggaaucuuuucagcugagcguggggugaaaugguaaugauuuuugguuuccacacccagacagguccauaguagcauucuaaaaagauagcuuguagaguagcugagguaauauuuuagcaauuuacuauuucugccugugagauuaauggcuaagcagcuucuucccugagcugagcugacaguuccuuuuguucuucacguaccuuugauuuuucugcuuucuauugaggcaucuugucuuagucaggguuucuauuccugcacaaacaucaugaccaagaaacaaguuggggaggaaaggguuuauucggcuuacacuuccauacugcuguucaucaccaaggaagccaggacuggaacucaagcaggucaggaagcaggagcugaugcagaggccauggagggauauucuuuacuggcuugccuccccuggcuugcucaaccugcucucuuauagaacccaagacuaccagcccagagauggucccacccacaaggagccuuucccccuuuauuacuaauugagaaaaugccuuagaguuggaucucauggacgcauuuccucaacugaagcuccuuucucugugauaaccccagcugugucaaguugacacaaaacuagccaguacacaucucauugggguucuuucucauguagugagagugguacccuuuucuuguccaacccaugucucuuucacuacagccauugaguugggauuuugauuuguaguuuuaaacuuguaucaagaaaagucucaguagagacuggcuuuaguguguugguuuuuaauguuauuauucauauuuaagcaggguuuuuacugucuagcccuggauaucucauuuuggaacuuaaccuacacccuccaccagccuuaagcucagugguccucuugucacugccucuugagggcuuagacuguaggcgugcaccauugcuccuggcucagguuucuagucuuuuaaccugcuaguuaaccacaagagauaaagacugaucgaucaucuugugaaugaagcagcuuuuguuuuacugagagaucaucauaugguuugggacuugaguauuauuggauauuuucucugccauuguugguaggaaaacaguauugggucuauuaagauggcuaccuaucucacuuucaugucugauugugaugggccuggcucuuugcuggauggugaggacuauggaagccaguucaaacauuguccccuucuuccuuauaggucaugcagguuuugaaugcugaugccauuguugugaagcugaauucuggagacuacaagaccauccaccugucaagcauccgaccaccaagguuggagggagacaacauacaggugagaacaggaaguguacuggugggguuucuacuacugugauuuaaaacaccaugacugaggcagcuuggggacggcaggguuucuuugcugugugcuuuagagggacaggagucuauuggugggaaaccauggcagcaaguacaguggcggugggaacugagugcugcucagagcucacauuuugaacugcacacacaguguuuguaggggaaguaugaacacagacauaugccauaaggcuuugaaauguuagaguccacacccagugacaugcuuuuagcguggcuucuccuagaccuccccaaaacagcaccccaacugaggaccagguguucaacuacaugaaccugugagggucauucuuacuguaagcacucaggaagcaucugcacuuaguuaagucugaugucagucuguaaaaggacaagucuuugacagucuccaaguauuaugccuuuuuacuugcagccaaaaccuuaguuagcucugcucugguccacugcaaauagugacacuuggcauuccucccuagggagcuggagagcaguuaggggugggauaugggagaugauaggcgaauuuuacuuuaagaucuuauauuucugagagaauaagauggagaaauucuguauuuuacuuauguaguaacagggucuguuuuugauggucauuuugguuugguaguuccuucugguuuugcucuagguaaaaugaaucuuugucaauguucucuagggucaccuacucaucuuuuaucacugcuaaugauaauguuuuguacuauuugcugagucuuuggacuaagcaagugcaugugauuucuauauaauuacgcuuuauaugaaauugcaggaagaguuggucuucagugugcuucagguaguucauggcuagaguuugugcugauuugacuugaggugguagggacaagaguugagauugaguauuuuuuuggguuugguuguagcuugcuuuuaagaccaucauucuugguccucuuauuuccuucugauaacuuaagugauuauguugacugguuauagaauuaggcccuuggugagagcucgugccacaagggcaguuuuuauaaauuaaauaucauuguugaaguuaguguugugaauuaucuacuuucuaauuuaccucauuugugguuuucaagaugugaaauuugcccuuccaauguuuugugcacacacauguuauagugcauuuacaagcugagguucaaacccuguuccuauuugugagggaguuaauagacagcccaugagaggaaaaucaaaauaucauaauuaucuuuugaaucagaucaugcuuaaacacacacaggaugggugauuucaaugucuggccaaucaguucauuugcucucuuuucuuuguagaggaggcaauuuaaugcagcaaacaguauugugguaagguugaaauuuuaaaugcaugaaagcuuagaaaugccaaaaugagguugucucaguaacuguggcugugccucauugcacagaguaaauacacaucuccaauuugaucaggauugggaguaguccacgauucugcaucugugcucuacaguuggaauuaagguucccacagcaaccacaacuuugaaauucuugaauguuaauuuuuaugucugcaucauuagcuaaagcacuauguuaaugcagacaauguggcuggauuuuaagccauuuuuaggggcuggggcguguugagcuuagguagaguaacagguuuccuggagagugagcuaaccuacugaggacucuuucccaggugccuuuagaucuccuuagcuguugaaagauacuuuucucuuagcuuaguggcuaaugggcaguuguugauuuuauuuguuuguuguuuuucuagcucagguuggauucugauaauacuauuucuuguuuucuaucaaaaugaauuuuuucuucuucuacccaacccccuuccuuuucucuucacuucugagaucuuacuccauuuuaagaaaguucuaaguaaggcguagcuauaauagucagcaacauauggcuuuugagagaaaugaagacugauugucauuauuuguucauuaaauucuucugggagaauguaggaagggaucccguuagagaucagugauagagcacacugcacacacacacaugcacacacacacacacacacaugcacacacaugcacacgcacacaccagccccagcguggagguggaggguacucuguaggacucaggcaugcuugcucuucugguacuuuucuaagaaacugauacacggggauucaaggaugagaaguaagcacauaaggggaaggccagaccagcccugucauggaaggcacacaaaccaguuauauuuguugccuuaaauuuuagcuagcuauauuuaaacuaaaauauauuagcucauauauauauauaugcaugcauauacguguauauauauguguacauauguauguauauauauauauauuuguuaaaacauguauagaauauuccaucaacauuuaaugaauacuaaaacauuaaugaaauagacuguccuccuccccuacuaagaccacguuuuacacuuauacccaucacaguucuuucuagcaucguugaagguuuuaguggcugauaggcagcuguugauuuuuguuguuuuuuauggacagcacaucuggagaagcugaggugaguggguuagucaccaucaguauuuacuugcuuucugauacaguucugggaugugaaaccuucucaugaacuuugaagcauaguagaagcacaugaauaauuucacugcuacaaaaaguuucaaguuuaggaagaaugcauagucugagaguuucuuugaggaaaugacauuuaaaacauugaugacaaucgggugaguuugggggaaccagagaauguacagcccccgaggacagugugugaguggcaugccaccugaaugacaggaaauuacaggcagggccaggacauguauguguccugugaacauuuccggacaugaaaugagggccuugaugaugaauaguagagcagguagcuaggugcgaggguacgaaaacaagagcccuugguugguaagcaagggucagaggucaagaguuuaugcuauguuuuaaguuuugucuugacgaauuuuaagccgaggagaaagauguguuuagaguuaugaacuauuaugucagugauuugacuuacaagauaugaaaguaauuuacauuuguacaaaacuaaucuauuaggaguaauuguggauuuucuuuugauaagccuuaauugaccaaguaccuggggagacugugacaaacgagagcuguagcugugccuccagcagucccucuggguccuggaggguucagaggauuuuccuuccuccuuagaagaauucccacgagcucuuacgaagagcaugagauucucuucaacauuuauucuaaaguuuacaaagauuuacaguauggguauaggaagaaaacuugucucuaguucccaauggugcuguaauuuauauagauguugaagcuugggcagcagacauaacuaagaagcccaaauugaguauucaagguagaagcaggcauagugguauacaccuuaaauuccagccucuuguaggcagagguagguggaucucugugcauucgaggccagacuggucuauauacagaguuccuggacaguuagcaugucagggcuacauagagaggaaaaaaaauaguucucuuuuguuguuguuguuguuguuguuguuguuuguuuuuuaacuuaaaaauauucaaaguagagcucuuacugagguuuaguaccugugcuaguucauuugguauguuaguacaaaucagaaagggauguccuuuccccuagagccucagcucagucagggcuuggcacacagaggggaagcugaauuucagcuccucuucugucucugucccuuuggcucgaugcccuuguguaagaugcagcuugcacaagaauauauuccugcccuaguuagaccaagaucugguaggcucuccaaggaaaagaugguguauuguugggagauggggaguagcccuguagucucagaaaccccgaaugcuaggaugguuuggggaugaagguaugugguagguggauuguaccaggccuccaggcaugcacuugggaaauuaccuuuuguguaaguaaccagguacuuucucgagggucaauggcuuggaaauggagaaagguauaauccaauugcuuaugguaugagcacucuuaagcaaaagagccaugugggagagaaugcagaugcagaagcuggaggauagauaacagaggagacuugagugagcagugugaugggcaggcagauggccuuagcaauuccugccauacggccggcugaccugagcuccagaugaggacccagugauguuacuuuuagaaaaguauguggcacauucgcuucacuguuucucuuccuccuucccuagaaauuuuaguagucuaucauuaguuaagcacaucuucuggacaacaucuagaaauagcauggcaguggggugugggugugggggcucuggggugggguggagucagggugguguaauaggaaaaauuggaugggggggguaccauuucuuaaauuuuacagggaaacaagguuuugcccagggcuaacuguacuuucucccuucugcucugguuauuuucuaauugagcuagacgaagcauuuaaaacaccagagcaacuguuuuuucuccuagggcuuuccuggauugccuggcagauccuguguugugauaggagugugguucgugguggcuggugggaugggaggauuaaaugcaugaguguguguaguuaguagucccucaagcauucgggugggugugacugcagguguuggucuugcuucuggaugguucagggugaaucuaguguccgcucuuaggagcuaugcacuccuucaggcugaaagccuguuuacaacuuacaugugaugcucuugugaaccugcacaggcauugggguuucucuaaaggcagagcuugcuuuauccaguuguuugccauaaagaaguaagucuuagagaaaggcucuggcuuuucugagcugcugccuugaaggagauaguacauugugcaaucuuagggcuuccuagggagcucuuggcuuugaucugaaacuggaaagccuagugcuccauagcccagagcuuccauaggcuuuguguuacacuuggaguguuaaugacaaaggaaacagcccccaggcauccagugcaggggcugacuuauuuccuccugaagucugcucuuggagugcuauuguaguuguuggcacagagagauggagcugaaauuuaccuaaaaaacagguagaguguuugcucagccccggguguuucguggauuacguuugcuuuugguugcagagccucuucucuggcucuguugugcagugugucuggcucucccuuuucucccuuggacucugucucuggcuugguacucaggaaaaguggaaguccaaggguagaagcugguccuguacugcuauugcugucuguucauuuccauucccuguccuugagcuucuucacucugaacucaccauaaagauucuuucacaucacggccuguaaacauucaggccugggcagugaagggucuuucuaagcuuguguccuugcugcuuuuacuuugggugucucucccaggucugugcccccugggauucuuggacaggcacuuuggcagagaggaacugcagguaaguacauuacuaaggaugcccuggaaaucucaaaagcuuuuuuucagaggcaaggcugauucagguucugauaacuccaucuguuguguaggacccuggugugcuuugccauuuagacacaguuacaagugguucucagcccauucccucuaguuuugacuuuugaaagaaagaugagugguccuucuggauccucagucagaccauguggccacuaagaugcauaccaagagaaagcugugagguuagagucccuaagcaaaguacgggcaaaccaauaaacccgguaacugugaucucaggcuuguaacuggaaacauaaggcaaacagcaaauuagagagggacuccagcuuggcauuaaggaccuuggagacaagcaaaagcucuuugaaauggauauagcauuccacccguuuccaauggagagauuuggggacugcggcagugugaucaaaagacauggaacgugucagagugcuggcagaggcuuucuguacccgguuccaaauuguuugaucugggcauuuuugagaugaacacuugaaacuuccuuuauugaaggcugaaaaaaauuucuauuaggaaaugggcauaacucaccuauuuaagauuccaaaaugugcaugugcuguuuuugagauuacuauccaggugccaucacuuaaaucacugcugugaucugcuucucagcugagaggucacuggccagcaaggcuggcuccuugugaugaggucaagacacugaguaucuagacagagcaguuuccuaaaauggacacgccacugaucuuggucgggauauuuuaaacuggaaaagacagcaugugccugucuuguugcauuugauuucuuucuucucugucuuacaaauuauauuuccuuccauuccuugagccagagauccccuugccucuuucuuucaaaucauauuugugggauuuuaacaaccuccuggugggacuuggugguuaaucccccgaaccuugugcauuuaccuuuuccagcccaucucucuuuucucuguuccuuuaaucaucacuaucacacaguuguaacauuuucaacuuaucuaaaucuugcucaugcuguguguucauguuucuuuccacuucucagucucguugagcuguagugauucucuguuguuucuggaguuggcggcaccaucauuuacuguucucugaccucucucugugcccucugucuugcucagguucuuaagaauccuguuaggucagagacuucuuucuguacacacaggcccuuccuucucuccagcaugauaccuguugaugugcaugccugcuuuucucugugaagucuaagcaccgcugagggcaggaaugccauuucucaucuuuaucuccccuuuccgaaucuuguagagaguacuaugaccauaguagacaauuaucaaauguuuaaaucaugucugcugaggcaugagaaguaauuucauagauugcuuuugagugggcaucauuuugccuacucgaaacccucuguuaaucucuggaugccucugcuagcucuguucagcuggggcuccuguccuggguucauaagucccaggagggcgucuuugcuucccugguuucucccuucccucuuaauugcauugcuugguuuugcuggauaguuuacaccuggauuagauguuggcagcuacaucauuuccccacucuguuuuagccuaacuucugccauugcuuaaccagcccugccucuuucuguaugguuuccccuuaauguacauucuuuuagcacaguguagcuugaguucaauccacccagcgggguuauuuucaggauuuuacgugucuuugaagaucagucccuauuugacucugucuuuuaacaccucuguucuuacucaggguuuuccaaaugucuucucucggguauguugauucaucgacgucuuuagguggacuuuuuacucagggcuguuuuuuucccucuucuguugucgaccuugcugguugucagauuauuucuuugcuggaacuaauuuuaaaaucaauuagagagcuuuucccgucaucuuucucucuuuauuuaugaggugcugauugcagaacuaccuacacuguguuuagauaaauuacuuuuuuuuaaaaaauguaacauuuauauucaaggcaaguuuagugcagccauccaaugcuuugcaguuuugcaggccagagcuguaggcuucauuccuuggugggcuaauuagcuuugggcugggagaauuuuuguucuguuuagaaaccaaacauuuaaguuccucauguauucuagacucugugguucugaggaauuguuuuuauuaacaagauguuuauaauuuuaggcgugugcgugugugugugugagugugcgugugcgugugagagaguguuggccagcagguggaugguggauggaaugauggaugguggugcuuugcccccacuguucucaguaaaggcuuuucagcgcugacuagaaagggaagcugaaggacacagaugcuugcucuuuccccagcaacugacaggccuauugguuaggcauauuuuuggugucacuuuucauuuuagccuuucuuugaauauuugcagucauuuuauagggcguucacauuuuauaguucuaauccacccacuauuaugcuguguagcuggauuggcuuacagaaucuuauuuauguccaccuugguggagggcugcuuugcaaccagaccucuguucagcuuagccgugaagacauuguagaaacucgguguucuuuacucugucauuucucugcuuggcaucagucuguccuuguuuuguuguguggcccucgguaaggcugagcagcagcagcagcagcgugugauguagggcaucugauaggcuugcuggccccacacugguccucaguuucugcuucugucaacgcagagucuggaaaaucuauacauuagaugguuauaauuucuaguuucugcucgcuugcuugcuuucuuuuuucugucucuaugcaguuugauuuucugggucaaguagauuccucauuucuucaagucuauugcaggcuaaccauguaguugguacucaguuuuauaaggugcuugaauucucaguagcuccugcucauagucuuuggcugcagauuggcagaguacauugacccuuaacugugauucugccauuaguccaccagaagaccaggaggcccagacucuuuccuuggguggcugccuuuuguaaggugggcugcaauuaggagaaagccuccuccuuauucauaugaaguuugcuuagcaucugcuucuccagcuggauggcuaguuuuagaugacuggugugcaggagcuguagguggaacuuuguaagggauugcuggugugugcaggguucccuugucagccuucugcuccuccaggcuuggucuugaggcccaggcccuaugaguuggggugcagguguauugaguacccucauuggagcuucuuuaccuuuuacugcagcggaugggagagagcucacuguguuuacauggcagaucgacagacagugucaugugcuaguuugacgguagggauauccagauuauuagcccaguuagcagggagacuucacaucauucaacucaccuuauuguauccacuugugauuucuuauaaaaagggaggaaguucugguagcacuuugcuggucccuuccagcguguguuaaaccuccaacucagcguuuucccaggaaaauguccgaguuccuuccugccgccugagcuacuuggagccuuucugucagagcacaacuguggcuugccuggaagauugcucugagccccaccuccucccucuaaaagcuuuucgccucacuccgccugcuuugccuacuccaguccuccucugaggaagaguagcugacuccuucagcucaggcaggcuuaucugcaggggagcuuaguuaguucugggcugccuggaucuagaaauagcagagcuguggaagaugacugcuccucuggguaaagaacagcagguagaggaaggcaguuccucuuguaaggagaguucucaauccaagaagauagaaaugagccugauacuguugaaggaaacugacaaauguaaaacucagugcaguaaaacccugcagccuuucguuucuuaccacaucaccuagcaagaaauguguucugagggcuggagcgguaguguuucguccuguccugccugucuguguuauagaucugcucgcauguacucagggaagcaggugcucucuggcagagucccguuguuucuguucucuuuccucaucucgcucuuaguagaugucccugcaggugugaucauggcugugcuugcuuuugcauuuuauuuggaucccucccccauccuagguucuuccaucuccacucgaugaucucucucccaggaauggauucuccuacaggaaauaagaggugaccccuuguauuucaaaugaagagucucuccuagugaacagucuaggcagcuugguugguggcucgcuccugcgccugucauguuagccucacaggagcuccuuguguaccuugugucgcuuguaaagccuugcuguggcuuuccaugcaacacgaacccgucgugaauucuuagcguuguuaaauugucucucauuuagcugccuugcugugguucauccagaaagagcagcuucuugaacaugaauucacuaccucagaaaggggcaacaacaaaaccgccuucuacuuugcuugagcaacaacaacauuuaaacuguuucuguaaugccgugguguacucuacaaacuacauuugugcaguuuaagcaagacucguguccugcuucuagaauuuaaaucaguugaugcuuucauuggcauauuuucuugcugauauuuauagauacauauuuaaggagacuugucaaggcuuuuaaauagugagguagacugguccucauuuuaacuuuuuuuuguuguuguuguuguuguugugggguuuuuuuuuuuuuuuuuuuuuuuuuuuuuuuuuuuuuuuuuuuuuuuuuuugauacagggucugguucuagcugcccuagaacuugcuauguagauucaccucccucugcauucuaaaugucuggauaaaaggcaugugcuaccacgcccugcucacauuaacuguuuuaauguccuccuuuaaacuugguacuucguacuaguaguaggagauuuaaaaaauauagcugcuagaaaagguaagcuuugccucauugauguugugggaggucgcaagccuucagcagguuccucuucucuuuauagauaggcuuacuuucuuugcucuuuuuuuuuuuuucuuuuuccuuuccugaccucucagauccugggaugauagucuauaccuggcucauuccccucugauuaccaucuuacaucauucuuucuucccaauugcauggucuucauuacuaaaguuucucuuucuccuuuucucccucuucaacaaguccaucucggcucuguuguuugcuuguugugggcuggucugucuacuuuggggaucuuaagcuucugugguaaggagagcuaacugcuuucacaugcaaucuggcacagaggccauaacauucuaagcacaguguuuauauauguguguguguguaaggggaacacauggauuuuauagcucaauguucccauccaugcauucaaauaguugugcacuggaaacauuuuggggaaaaccauacaucuauauucaauaagaacugauuuuucuuauccaaauagucaaaucuaggacuucacaaaaacuugccauuauuucuuaaacaaaugagcauucaaauaaccuagccccuucauuccauuuucccugcuucccuccuuuccuucccccucaccucacugcacacaggggugugugugugugugugugugugugagagagagagagagagagaccggggggggggguguugauugauuauuaguuugucauggagagcuaaucuuuggauacugagggauuuuuuagagucuugguggcccugaauucauguucugaacuuggagauuagggucucugguguuucuguuucuggcuguucuuugaccuugccaugucuccuuuaccucuguuccccuucccugcuaggaaauugaugcccauauguacacuucuaagggauccccuggugcagaguucuacaagggcaaaucauuugauuguuaacguuagauucacugcaaauauggcaacccaacauuauugcuucucauuugcugcaaaugagcugcaagccuucugggcuuacacaggacugcucugaggacaaagauuaaguggaucucugcuggugccauauauuuugauugaacaguagagcugcggugcguuuucagggucugccaccgaccgccucugcccuugucucccuuccacagcucugugcccuguugguucucacacuagcccccuucccccgcugagcuuuuucuuuugaaaagaggccagcucaguuucucguaaggugucaguuuugaacuccuuguguuaaaaucuuuguguuaaaacuggggcucagaaugcucauuuuugucaacugcuagccuugagcuugagagucccugcucuagauuguuacucuagcaguugaagagugggcgcuuaccaaagcugucucccaggaguuugguuucugacaaugucuuuuuuuuuuccuggauuucgaaguaguuuccauaugagcacugcuauauccccaaggucacagagccaagagggggcaggaggguuugcugucucucuggauuuuauagcucacuauuggaguugaugguuaggugggacuaguauuuuuucagggucaguuuuacuucagggaaagagaagaaaagguuuauggggggcugccuugacgacugggauuugcaucucaugugauucugucagcugaacugguaagaccuggaagaaggaacaaguuaaagaaugugcuuggcucuggauugcucuuaugcagauggaagaaagugcaggugcuucguggcacauauggagaagucaguuuucaggccacaguccagcaaacccucacguaucuucuggaucauacuaguguacagaagugugucguguggacuuaguguucugggggccauugucuuaacacaggguaagcacagcuaguuccuucguaagguuuacuagaggcaugcucagguuuguccaggacucagcuccaugcucuagcuagagguggggaaaugcugacagccacucacugacucacaugaaguaaacgcuaaagaugcagucuaaagucuuguagguguguuuauuuaugaugugaaauccagcugucagaaagacuagcauauuugggugggccaaggacauucucuuuuuuguuuguuuguuuuucuuuuaaagacuuauuuauuacauuuauaugaguacacuguaguugucuucaggcauaccagaaaagggcaucagaucucauuacauugugagcccauguggaugcugggaauugaaucuaggaccucuggaagagcacucagugcucuuaaccacugagccaucucuccagcccuacauucucuuucuuaaggagaaaauuuuuguggaaucuuuuaaaaaaauuaaugaggccuuaagauacugaggaagcuuguuguaauccuaaccuaucucagucagggauugagacccuggacuugaauccacagccaucugguuagacuaaugaguauuggguggaucccauaaaugcuggagucccuuucuuauuagucagucagcccaguuuuaacugccuuccugugugucaugugagcauggauuuggauuugguggguuaguggcccucucuuccucagugcugaguggaucuuuuuauagucaguguguuuccauuuuguugaaguagaaacugguuauauuuguuaauauuguacauaguuucuuuuuuucaaaauguguuuacacaaucagaguauuuccuaucaccagcuuuugaagauaccauaguuuacauaaaacgaaaguuaauuugaauauucaaguguuuaacuuuggaccgaaggggaacccaguuacuccucccuuuuuuuaaaaugguacugggaauugaacccaagaccccaggcaugcuaagcaagugccaggacucggggcccuagcuacucuguuuaauccucuugucuucaugugagguguguuugguacuaguagugaggcccacccugcgcaucucacuuuugaauagucucaguuuuauuagucauuuguggagagcuuucuguucucugggaguaccugcuucugggcaagucccugucucaucuucacuuaguaguguuacagguuuaaccagguugagauaggccuacaccucugcuuucaucuucacaccauucucugcuucacagauuugucccugauuaugaauguaaaauacucauuuauaaauuugggaaaaaauuuaaagaagcaaauauaaauuacuuaaaucuuauagcccagaggaaauaucaccacuguuaauaucucauggccuuucacugaugucucuguucauguuuuguaacagaacauguccccuggccuuuuaaauaauuuucuaaaacagaauuuuuaaugguuauguaguuuuuaauaauauggauguaccauaauuuauuuaaccaguugccaccuauuuuuggagauauaaauuaucuccaauauuuaugauuauaucuuuacacuuaaaauaaaaaugugccuugaaguagaaagccugagcaucagguucauucagaucagaggcggccccggcaggcugugcuggagcaacuguacaacauugccaugcagauagaugcucccagaggagcugauauuuagucccgcuggcaggauacucucuaaucaccuaauuccuuaucgguuuguauuauuuagaagcaggcuggaauccaggccccuuggguuuuguugugagccacaccccuucccccaauagcuagacuugcugcuuuugaaguaaugguaguggagacuggucuaccuacuucuggguuccgcugcuuucuucugcugccacugcugggagacacagugauauuggcaugggagugcucaugugcauccuugcagcauugcugugucucagcccacuuguguucacacaauuacacugcagauuauuaaauugcauccuauugugauaaaaccgucaccccuacauacagguaugugaagcaauuauauuuaauuaacauauaauggcacuuguggccagcaaaguaauuacaaccacagccgcuaguuuaaaugaccaugucucaccuuugucuuuaggaggauuuuccuucuuggggaugggaaugaaacacauuguggcuccccacagcccuucagugucucggagggacuugaacacuguccacagagucuuguuugagcucaagaaguggugggggauguauaggcagugcugucugacauuguugaaggcuccaugacuccaaguauuuaaaguauauaacaguauuuaaagcauaaagucagcugugaguaagaacaggcuccgguuuggcuuucuuuguacucggugacagauuuugcugcuuggaugcuugggagcacggugagcaccugagacuaauccgcccagaagccuugcgaauaccgugugcuuaaccaccuguguccauaauuagaaggcacucccagaccuucuaugacauucacacauuaaaauuugccuuuuugucucagauuauuuuauuugccucuucucaaagggucaggauuuucuguggguggcugucuuuguuaggauuuuacuucuuugaacagacaccaugaccaaggcaacucuauuaaaggacaacauuuaaucugggcugguuuacagguucagagguucaguccauuauugucaagcugggaaccuggcaaugucuaggcaggcaugguacaggagaagcugagaguucuuguucagaaggcaaacaggagagacugucucuaggcagcugggaagaggguccaaagcccauccccagugacacacuuccucuaacaaggccacaccuccuaauagugucacucccugggcaagcagauucagcugagcacaguggucuccuccuguccuaggaaggacuagcacugugcuuauccaagugccuccuucgagugucucuccuaggcucagcucugucuggacuacggccagccaugucagggcaaggccuguuauaucuauucaguaguuuguuuuuccauuuugggucugguuuuugauuuuuguuuuaucuuuuuucccucagagaugaagaucaugucauugaacauaaaaauagcagggaaagaugaagauggugggauaaggacugagucagcagacacugcuuuacuguaggaaggucccuccaccccccagaugccugcuucucauaggcuuucuugccuccugucucgcuggcucugcucagaaagcuguaggagcugggagagggcuuuggaaggacggcgcugcaggaggcaggaguggagguacuuuacuuugugcauagguguagcuuggagcaauauugcuuuucucuggcucuauucuaaugagaagaacaggaccuugugcuguuaauguguuagcaauuucaggaagagaagcuuagggcuggagauccauucagugguauuuugacauuugugugguucuuucucuguaguucugaagaagaaauuaguaucuuggucaccuggaaaaguaauuuuagcucauagacucccugccacacuugaguaacuuuuggaaguauaauauuuuaccuaaugcccauuaaauguuaggcacuuuuucuauauucccuuuacugcccuuuuaccgauuagggaaauauuuaugugaacccagaaggcugauuuauuuauuuuauugucuuuuuuaauaacuugcuucucccuggugcugggugguuucugagccccagacagacgccaugauuucuucugugauaaucaucuggccucccauggccuguauccucaagggccugcuuggcacuuauuuggcuuuaagaaagccucuggauauauggaaauaaaucuaaccuaaaugccccacccaggagcagugugacuccuggggagugacgacuggcaggcacagccauuaaagaguugcagaaaugaaagcacuccuguggaacuggaccuuguccuuuugcacugggggccucuuucuuguguguuuuuagagugucucaccugaguuaauuugcuggccaagaugcuucaggcacacugaaguacccgccucugucugggcacaaaaucagguaguugcugaugagauggacucuugaaaaaucacucuggaaguagagaccagaucauuuggccuaagucuuuaagacgugguggcagaagacugggaaguucaggcuuggagagcuaggauauaggcacagugguggucucccuuuuuauuugcuagcacaaaacagccacaccuccuccugguggaugcgaggaagcacacaucucagaccuggcuccaagguuuggagaaaaacugguuucuguaaucucuugugcugagaaaaacuggcuucuuguuucucauaaaugugugcacaccucuguguguguauguauguggcagugggggcucuuucccuucuucaucaggcauuuguuggauggauaaaagaaagccacuuucuuuaguaaauaguuuggguaguuuuuaagcauguacuuucugcaccagcaaggaauaaaaagcacacaaaauuugcaauaaaacacuaaugagaaacaaagccgugaacucaucaguaucucaacaccacuaaauuaggcugugauacacaguagcucaucugcaaaucagggaacggaacugauuauugucugcuccgggcccugccaggguagcacauggcacaguccgcagagugagcaguguucauucuggaugcuucgaugugcagguucugcuguacagcauaaccaccuauaagcacccugucccaggucuccugacucaggguucccaggggcaggucauagguagcuuuuccuuuugguuuucuuccuccccauuuuccucagugcucagagggagguuucugguguguagcaauggcugaaacccauacccuuuguaugcuuuggaguauuucuaucaucauucagacccagugggaauaguccuggguggggccagugguugagaaugaugguauccuuuuucuuuaauuagauauuuucuuuauuuacauuucaaaugcuaucccaaaaguuuucucuaaccuacccccgcccugcuucccuauccacucacucccacuucuuggcccuggcguuccccuauacuggggcauauaaaguuugcaagaccaaggggccucucuucccaaugauggcaacugggccaaguaaugaugguaucuuaaccaaauaaaaucucaccgcugcaaauauucuuuauuacuccaccuuaaaagcuaugugaagaaauccuauuguuuuacacugaaggggaauuuucacuuauucuuuaauaaaggugucauagccacucauuucuucaaugaugaacuuauguauuucccuucuggaaagcucuucuuuuaugaagcaguuauuaucuuucuccccugcaaggaggggagaacuugguccgacuucucuuucuguccuauaguuggggccaguacuugccuuaaacaugagaauguggccugauggugggacuuguccgggaagcuuuaguucucucuugagaacacaugcagugaagcuaggauaguuauguaaguguuucauccuguacucauuuguucuuucucaagaaguaaaagcuauguaaaggauguucaguguaaagacacuugccuagcaugcacaaggccugggguuugauccccggcuucauaguaccaugaaacaagaacaaagagaaaggaaaaggauuuaaguaauaagggcuuuagguuuuagguuuuuguuuuuuuuguuuguuucaugacacuuuuacaagacauguccuuucacauuuuguccuuuaccugguuuuguuugcugcuucuuuauuuaaaauguuaacaaaaauaauucaagaagcuuuuaauacuauugcuauuccucccucccccaaaccuagucagggagggagauagcuuggugaugagcccuuccucuuucucccucaaccuuuguuaauaucaccuucagcugggucucuuaacacugugacaaaacagaagcagccccuucuauaggagacugauguaaaagaccuuguuauaacagaacacaguaaacuucuucacuuccuaaacuuugcuucuaauaaaugguacaacauuguuugcuuauuuguuuuaggguaacauagacuucuuugcccauuuauaaucaccauaguguuucccuaaagacagaaaagguuuccaccuuauuaagucugaaguuauugggcugcuauguuguucucagugugcgugcuuccuuguguugguuugggcagguaucuugaaugcucuuuugauaaucugaguagucagauucaccaccuuuacaagccaguaugucaacccugugaggacuucuuuguauuuugugaagagguccaguugauuggcagcugguggcugagaguuauaguacuagaugaaagaugcuguaaucucagggcuagugagcaugaaagcuggacccauccauccccgauagaaccaagaaguccagaggacagcaugugccaccaagaugugucuuggcugauguuuaaauugcaucaaauuaaaggguauuucucauucuccauugacauugucaccaaagggcagaauuagugucauuuuuaacagcuuugagcuucuggaacugccacuuucucugagggucacuagggauaguagcucagugagucuuucuuguuccaaaaucgccugucuggaggacuucuuagaagaggaauuauuccacagccaguggacagggucucuuuauguauuccuggagcucucuguguagaccaggcugaccuugaacucacaaagaucaccuuguacuccuccaacaugcugagauucaaggcuuaugcaaccauacuugccagucuuguuuuuguuuguuuuuuuuuccuuaaucuggguuguguaaacuucugucuccguauugcaucaacaugaggaugugugaaaggaguguggcgagcagcauggacauuuucuuacauagaagcgcuagcuacacuaagagggagccuaggguguuagagggguuuagcccuaguccauuggguguucuaagcaguguguugugcuagggcggcauggaucacagguguucaggguaaagacuguuguccaaaguuuacacuccgauaauagcuacuugaguacauggaaauaaagcauuguguggaaaccugcucucuguguguguguguggggggggggaggcaggauccaguggcguuugaaucaaaggagaaauaacuuuugcuuugucgaaucucuuggacuauugugauauucaugguuguuucucuuguucauccauuuucccuuugguccauugauuuguuuccuuauuuuaaagccuuuugucauauccaguguaguaggaacguuuucaaaucagcaaaauugcaugugcuagucacuggcuauguggcugugcuuuaaaccuaagaguaugcagguguucucucuugagauguccauuuuuaccuagauguucguggaguccacuccucaggcagcuccugucauuuugcugaaugucaccaagcauuuacugucacuucucugaugccaaggaggaaggugaugccuucuagcaaaauagccccuguccuuuugguagcacauuaaaaggucagcacccccucuguccuucucuugccuccucugcccucacugucaucuguauaaccuuuccuuacugaaugcugcuucuguaaagugcacuggagcugcauuuaaagagauuagguuccuuaagucugaaggugccaguccacuguaagcuugaggugcaacacuggaaaucauuccaugacuuagagguagguggcucaccucguuauagagucuugucuuucuagaaguugcuauuaccgaaaugaucuugagaaagcuccugaaacuuguaaacuucaggaauuucuugagauuguuuuguuuacuuggcaagacuuaaaggauuguuucaguuugcaggucaccuugguuucuuuaguaaaaaguccaugcuuuauaggucuagcucuagacauacacaguuugcuuguuuguuuuuaaggggaauauuuuuaacuuggaccuuauaugccugccauuuuuggauuacaccacagcugacgcauauuucaguuuugaguuguuuucuuaaagaaauuagccaaggcaaucuugguaguuuucguggaggaaucuuaccuguugcugaagucccauuuaauuucacaugccuugcaccugucucuuagcaacuagcauauaaauugcauauagacacaaauauuuuuaaauguguaauaaagaaccuagaguuacuguaaaaaaccuuuuuaaaauaaaguuuguauguggugauuuuuaaugauagauuauaauguaucuuucaugaugaugauuaaguuguaaguuuagucaaacaucuguuuauuuagcagugaucaugaauauucccuuugcaauuaacauugauuucggaaagaucuauauuuauaauuaauagauuaugaaggugugcuaaguguauucagguuccuguucuucaguauuucuuccauauuuucauucauuuugcccuuuuaaagguagauuuaaauacauagauugcuuaugaguacuucuccuugugaauguacguugugacuuuuaaaauuucauuauguuucuugacaaaaugcuugcuaagauccuaagauagucuguuuuccuucaugugcugcuuaggcccucacucuguguacagugggcaugaaguagacacuccugcaugauugggcgcacacuucugcagcuuuuggucuauacaagaaucauuuugccauuauuacuugaugaugugcucauuuucucuuggugcccuaugcuuucucucaaaguaaucacccgaaaggagucaucuuuucccccuuuuuugucuucaagaaagcaauggucuugcuaaaguccauugucagaugguaaucuuucaucuuguucucuugcccuaaauucagaagcacagguguggaaaaggaaaugauuuuguagaagugugaaauaaauaauguggagagagguuggugugcagacacuguccgcuuauaaaggcacgugugcaccccagugcuuugggggcugcuuggagcagguucauaagaugccugcacucguagcugcagcagacugcucuguugucuccugugcauggucuuaccuugcacauugcaggaccacagaacuggaguuucuuucccaucugcuguaaacuguccaacgaugacaaguacucuuaguagucuucugaguacccuuagcaaggaggaaggaauuuuggaagggguacuugacugagugaugauuuggagaaagggggcaagcugauugggugguggugucuuuuuuaauguagucagccuuaagaaugcugcuguguuuuauuuucagaauucugcuacuugcccuaccagaaucugccccgaguuguuuccuguaacccacuguuauugacccguguaggcagaaaucuuguuaggacaaggggaagaugucuguaagguuaugguuaauacauacuuccuguucuccucgucaagacuauccgcagaguuaccaacaaggauuuuaucuucuuuuuacuucuuuauuuuucuugaauguuucuuugaacauucaagagcaugcccgaagcuccugaugccuuguauagucugauuaucagcugacuggcugccagcagcugggugggggcagcaugccuaggggucuuuggcugcuguuuggcccuuugcacggcuuauucagcuuuaagacauuucuaugcucagcacuuuuauuugcugaggaugccaugcuugugcacacaccugugugugaguguuguacguuaccuaucagcaccugggaggaaacaguggggcaugccuaagggggaauuaaccaucccuagaaugcccuuuuucuugguuuuauaacacagacucuaucugccauuauuaugcacuauaauuuuuaaaaguaccuuuaaaaaauaguguaaguuuaccauaucaggguuuuacagaaacagacugaguucauaauuuaauucuuuuacagaaacaagguuaaggauuuccuucaucucuuucuugacugcuguaccagccuuuugcacccuagcccggguggccucacauucauuuccauaacaaugguuguuguaucucaaacuccaggaauuaugccuugagauggaagcgaauagcaggagccaaugaaugcuuaaaugagaaaucuguuuguaaugucauagacuccucagaggagggcaugagagauggaaagcaagagugggaacauaggaauccugcugguagaguuagucucuccuuccuucccaauuuucuguacuuauuucauugggagcuauuucagacuggcuuacauggcuggccuucccccccuaauuccuuucuuucugagcauucaucauuucaguauggugguagugucuuaggucaaaaauugaugccuucauagaacaaaaaugcuuauuuauaccuugcauuuaugacuuaguugaugccuagugucuuaucccuucuaguccaugguugugacuggacauuuugaacuuauauuugagaguugcguguauggcuaggcaaagcuguuagcauucaguuuuaacaauuuugaguaaccaacuacuauagugucuaguuguguugagcauuauuugaggcaaacuuuguguauuucuuuguuagucuauauauguuuuaaauucgauauuauauuuuuaacucauuggaagaacuguauagaugccaugugacugucuugguauugaggacccauacagauaauuugauugcaugcauggaggcuauuggaugugaaauauauagaauugaagagaaaugugauuugcaggggaguuuuccaagcuggccacuuucuucaaagugcuuguauguuaccuauugacuguuuaaauaaauguguguguguguuguuggguauauauguauguauguguguguguguguauauauauauauauauauauaucuauauauagaauguuaguguaugugugggugggcauauauguuguuuuuuauuuuauuuucaagacaggguuuuucuguauaaccacccuggccauccuggaacucacucuguagaccaggcuggccuugaacucugccugcaucugcuuuguuugugccaccacaccuggcuauaaauagcuuuuguggaugaagaaaggacucaaacuguaagguagccuaugacaauucuugcccauguuccagaagaaucuugaacuagugaccugggaacaaaagagaucugggucauuguugaauuacuauauucugugaaauggugauugucccauuugugguugucaaccuuucuuaacuguuucuuuguguuuuuuacuacucugcgucaguaaacaucuuagccuuuucuguguuccuuacacauuuggucaaaagugcucccuggucccugcccucaugucuuccucuuggccuguuucuugauuccauaguacugaccaaaauguauaugcucauacuagaucucuguaccuuugcguugguugagccaaaauuauauaaaaaauuauaugcuuugagcugucaccccaaacaugcccacaucagguggauauaugcugggagucauuugucugaauucacagcuagaagcuaguuaacccucugauguggggccaagaauaaauauguguuaagaacugagcuaaggaucugcugagagcagaaauagaugaaaaauugcuuguucuugaaaggaauuuauugagcaaugagcuuaaaaagaaaaaaaaucaagcucagaaggaaaguaaguauuagaaaucacaaucuuaacuucagaauaggcaggaugacaugaauuggccuucuuugcaugaaauugcuguagaugcuaggaggcagaaggaauauguaaagguagguuggaauaugguaggugaguaugagaaauggcauuugaacagccuugaggcuggaugaguaaaagguacgagaugcgugggguaccgauagugaaaaggguuucaugaccccuggcuccuaauccaugaguggccauucaaguuagggaagagguuuaaaaacaaagaaacagcaacaguggccaagccaaaagccugccacagcaccuaaguguuugccuaggaaggagaugugcagugcgccuuccguggugaucagauauacaacuggguuuuaaggagaucaacguaggggcuagagagaugucucaagagcgugcuguucuugcagaggaccucaguucaguuccacgcacuuguauguuggacaguucacaauggccugugauucuagcuccaggagaucuaccccauucuguccagaauucauguguacccucucuucccucccacauauacauaauuuuaaaaaagaagguaagugucaagguaaaguugaaaggcuaugaaauguccuucuguuuuagcuuuguuuuguuggcuuagaaaucauugaaggucuuugagucgggauucagugugauuacaguuuuauguuaggaacauucacucugcagucaaaguuuugguguuauuaguaaugguucagaccuuggaaaaagaaccuguaaagauuuguugauuuuuuuuuuucccccccuaaaauugagaauagguuuuggaucaguugucuauacagauuuaauauuuugaucuggaggauagaagucaggugaauaaaaauugcuaguguugguuuaguagacugaauagccacaaauucaggugcaagcauguugauuuggaggaaccaauuuugaauagaaaucguaaaagaaagaugaaaaauuagggcaguuuaccaaaguaauguuuuguguagcaacaagaaauuuuuuaaaggugaacaaaagcuucuugucgacccagcagagguuuuaucagcugcagauggucauaaacuaaguacugacaagguugggcuagaccucgaaaugcuuucaguguguuguuuccugugagugcagaguuugaccgcuggacuacaggugagaggaagcuuaaggaaauagacaucuacaccccuugucucagauccuuagguugcguucggagguucugggucuuugaaaagguaugugggaaguuggggaaauagcuuaaugcaugaagcccuugcugugugagcaugaggaccugagcucaaaucccuagugucguagaaaugcugguagggucugguggccugccuuugaucccauuacuugggaagcugaccagcuagccaaacuggcaagcucuccguucaagugagaaacccugccucaacauagaagguggagcaaucaaagacaugcuuguacauaugugccccagcaaacacacagagagaaaggucacacagagcacuugugguguaguaaugacauaauaccuaccucaguggguugugaauaacaccccuguaauuaaacgcugauuuuucuuuuucuccaguacaacaugaauguuucuguuaugggacaaagacuuaaaagucacuuggaucucuucaugugagguuuuguaacagugucaggucaaguucuguuuuacugccaaguguguuauaagacuagagaacuuuaacagugaagggacagaggcagaaagccacaucugacaacuuucuuuaaaaaaauaacuuuguucuuuucuacacucaagaaaauucuuuccagucgaguuagcuuuccuugggcuuguuuguaaugguaacagguaucuaucuguggaugguagcgugguuuugauuuacuaauagcccuggagggguagggcauacuaagugcuuccuugaugauugugaagucaaacuggaaaacuaagcaucauaagcaaacaacucuauuuuauaugucuuuggcauugauuucuauuuuguccagguccaugcauuuucucccucuuguucaaagauauaaguacagaucuggaccuacgguuauaaauggcuacccuugggucuaaagaaacagaaguagcuucucuggagggcuguuugcagauaugggauucauaggaaggcuagagcuuuucaugauauagugaugugcauuguuuuacaugucagaccguaaagcugucauuuugucaguacuguguguguccacuuucuuaugcuacccuuuuuauuuucccuuauuuuauauaggaguugaggcagggguuagauucagaagguuuuccaagggaacuuuguauaguaaugagaaaggauguuggcgaaagggaagcggucuugauuuggccuagugacauucuagacuggcuucaguguccuccuuuguuugcagguaaaaggguaagguuugguaugauucagagcagugcccuguuauagcaaaucuguggcuagaggagcauuugaaauauacagaguccuugcaguuuugccggauuguuguucugaacaaaugacccuauugcguucccugguuacucagcacccuguggacacuggccuagucaugggcaauuggcuguccaaauagcgugugcgguuuugcagccugagcucuuagugaggaugaggcgcagcgccuccccagcugacugcuccagggagcauuacccggugugcagcuguugccugaauccuaaguagcauccggugugaggcuggcgccuucccgcuccccuuccuuuuuacuugcugcucugugaauaucugaucgauggggcuggguguuggcagaaauccagaaaagccagccauguuguuagauguagcauuuuggccucuccaaucuaagcuuuucuuuuuugucaacauuuaagauguaguuuuugcaaacagcuguagagcugaauagcaggaguugugcuggucacuguggccuguaaauggugagugauuuucauucuccucucuacugaagaugagcacauggcaguguggagaggauaagcaugaagguaagcagcccugugaucugcagugccugucuucaccugccagucagcagcacacacuuggcaaauccuagcuguaugggagacaggccauccacuccacugcccuccauacugcucugcuguagucuugguuguuccagggcucagcucucuacuuuuauguugcuucccauuugucagcaggagagaaacuuaaggagaaggaggaggaggacugccucccccuccauggaagucuaaaucguaacuaaugaagcaguauuaaauucugagaccuauuacaucucuauaaccacucaccuccgcuuugugacugaaaucacuaaagauccaaauaucuacuguaugcacaugcaaagaaaaaauuuaacuuuaacccugaaauuuaaaauugaaaaaguaauuucucuaaauauccaucuuuuuuuuuucaaccuauuaaaacaauguaaagaccccuuggcuccugagugugacccacccgucagaucugaugaaggcacuaggcuuccagaccuagcucuaccuuccugucccuaguguugucugaagagucccucaugacugccaguauugaucagcugcuguucccugaacuccuguguguguucuuuggcaacaaggagauaaacaggguauugacccagagaucuugacacacuccuggauuuuuagggacaaauagcagcccccuucagagugcagagugcugaaaguccaguggcugcuucugaauaaugacuuccugucaaguggcucgaaggguuugauggagaagaggcuggguuucaauucuucuggaguagcaugugcuuugggcaagaugaucugacuggaaacuugugcuaauaggaaacagugugcaggcccugagaggcgaggcagugggaagcuccugcagcccugcggacuccaaaccacauguuguuugugugaguguuugaagugaaauugaauuuuuauuuuccuaauguguuuuuguaauuaggaaaaauuccuucuuuuucucacugccauguaacacaaaccccaguuccuaguuccuccaucaaaucuugucuauucuaugcagaccuaggggaaaggugggacaagaaaggcccuaggugcugcgggucugugccuucucauuuaugaacaauaauaaucuauguuuuuucagaaaaaccaagguacgugcuucccccuuccguaaggcaggguaggcgagccuuguggaugugcuucugcucuucauugucuucaugaaggcagaggcuguaucuugcuuuccaaagauucaaauaauuuuuauaccaauaaacauuucaacucuuacuauauccugucucuuaaauccagcuaacaaagucuuacaacuauugaucacuaugaaguaguuacuucuuaauaccucacaguuccaaaucacaaugagguaauaauuuugguucuucaagagccaaaucaggucuccuccccaaguuaguuuauaccagagugccucuggacacucggaaaccgugugguacuugguuuacaccuugcccaaaguggcuuaucaguuagaauugaguuggaauuagaagucuauuagcagacuaggaggcaaagaaagaugaaauagaucacaguccauuuaugauaugucauuuugccaccguauuuccuguuaggacuuuuuguuggucuuauacguauuaucuuuuaaaaaauauuaauuuaaaaauuacauuuagaaagcaugugugugugugcacguguuguggcacauguguggaggucuaggggcugagcucagguaagggaggagugagagcagaagccuuaccugcugagccauguuuccaggcccuguauuacauuccugcaugagaagaaggcucaagaggccaucaagaguagcauguuuucuuuuuuuuuguuuguuuuuuuuuccauuuuuuauuagguauuuagcucauuuacauuuccaaugcuauaccaaaagucccccauacccacccacccccacuccccuacccacccacucccccuuuuuggcccuggcguuccccuguacuggggcauauaaaguuugcguguccaaugggccucucuuuccagugauggcugacuaggccaucuuuugauacauaugcagcuagagucaagagcuccgggaaaaaaaaaaaaaaaaaaaaaaaaaaaaaaaaaagaaugauacacuuaaaaaaaaaaaaaaaaaaaagaguagcauguuuucuuucuucaagugggcggccaccauacuucagaagugcuuuucuucugccucuccgggacguuuugcugccuuuuuacuguaacaucaguggcauugcucggaccaaauuucuuauauauuuuauucagucuuuuuauggaaaauuguguuacaguaacaaaccaguggcuguucacuuccauauucaucacagguguguugagauccaggcugcuagauuguuuuacgaguacccuaggaguguggagagggaagugugucaguuacgagccuguugaucccgauuuugcuagauacucacauagaucagaguagggacguauaguuuuuccuggacccacguggccaggcuugacaggguagggaagguugcuaacuggucgcauggaagcacagacaguauuguugaaacggucuccacgguuaccaagcuuauuuugucuugaacauggaauccacuuuccuucaugaggaaggaaaaguuagaguuguuuugcccugcacagauucacugguuuggugggccaguauucauagcguacagaaacuaaagggauauaguguccaagcuguagguauaacauucacuagcauucucauaguucugaaaguuucauuuuuuuuuucaagcucguugaaauuuguaaagguaugcuucauuuuggagucacaucguagcgggugaucucuggaacucagagaaacauuuggcuucugguuuuccaccugucaccaauuuguauuuuggguaaaugaugccaagaauuaucuauuguaacugacaucuacuuccucuggcuugaaauagcuaaguagauucgugcuaacuuaauucccugucacugcuugcaugguagguagcacagagcccaagaagagauucauagccccguggaguagcagcuaaauauuucuaccgcugugcaguuaaggguggaggcaucugacugaagaugggccaaagggcaguucagucagcaaaagcucauuucuccuuugcucugugucucuuuguuugaagaauggcauuuggugguuugaugugagugcugaugccaaaauccagugugaaaucugaucaugucuuuucccucugacuaaccacggugcagacuugaccuguagaaucuguccugcucgagaggcuucucacaauauggucccacugaugcagggcagguauaggggacuuggcauguggcagugaaacuuaaaaucuucgcagcugaagaacagcagggugaauguaguguugcuguaucugugcccuucagaauguacagcagccggcugcaaaugauagccuaauuugacgugguagcucuauuugaaagcggaagcugcugguuucagagcgguucccuguaggauaaugaauugucaugccucugcugauuaucuaacaaguuuguacaacguguaacacaggcugacaagacaaacaauuuuauuaauuuaagccugcugcuaaugggauugcaguacuauaugaauguaggaguauuauccacaaauacaagagugugcuacuccacaaauacuuguagucugggccugguaauggaaacagucuauuaauuuuuuuaagcaauguuuaguguuuccauuugucuuaaaugaaaugaaauucaguuggauuugaauugaaaaauacuuacgcaugucuggggauuuaugaagcucaaauaaaaugagcuguaauaucagcuuuugaagugguagaguugauaaaugccagugggcaguagauaaacuuaugguuuuuacaaaccaauuacaacuagaguuuugucuucaaugugucuuagaguuuggucuuuaguugagaguguagugagaccucuggggagauagauuuuauuuccaguauuuggccuuugaucugcaauauuuuaauuucaaauucuuucauucuuaaaugugaacuugacaauuugagguagucgaaucuuggguuguugacuagaauugauuaacuaugcuugugaaaccaauuuaucauccaugagaaaugaggcuaguuuaggugaagaagaaagguaucucaugagcucuguauaacauaaacccgagaaaagugcucuccaggagaaagaccccaacauaaucccccaggaguugguauaaacuguaaggcuaaauggauguugggauaauuucagcaaaagagguucuauuuccauggcuucuucucugggggauauuggccaggguauguagcaauauagccaagucuugcuacucgugacacuuaacauguauugcuuugggauguaaacugugccaaauuaaaguggcagacaauuaagaauuuaagguucuugcaauuuuuuguuguuuuguuguucuuuuaucuauuuaccuuuaaagauuuauuuauguauaugagcacugucuucagauauaccagaagagggcaucagaugguugugagccacuauguggcuuauaggaauugaacucaggaccucuggaagagcagcauugcuuuuaagugcugaggcaucucuccagucugucuguccuuuucuuaaaguaaaucuuuggcagacagcacaggaggcaguggugucaccaucauggaucacuuaucugggacuguaaugugcacuguucccccgucacugauggcauugcugccuguuaaccagccuuccuaucucccugacuguccuuaaaaugucugcguugucacugguuuaggcuccucagauacgcuguguauguuuucagaguguggggggcacagaaggaggggaaugugccgaguaauuggggcuaauuuaagaauucaaaacguggaaaguaaauugaaggugugcuuccaccuuuauucaucugauguagaagcuaaacacagcacccugacccccacaccccuugccucugcuucuugcuguaccuucugcacagccugagggccuuuuucuccuccagccucugcaccaaccagcucccauggaauucucagugcuugccuucugcuggacuccgugacaccauugaaugagagcucccuccaauuguauaccugcucccaaacaaauuagauguacaguuucuuuaugucaagaggcagaauugcuagcugcuaccagggauaauaauauauuuucagagugguacaaauuucaaguaauuuccaauucuauucccaguacuaauaaaaguuauucuucauuuaaauguaaaugguauugcucugcuuaucuuugcugcuuuagaaaagcuuuuuucucccccuaaauaacuuuuguauugagaucaacauccagucauuggauaagguacagcaacauuaaguucaaugaauaaugguauaugcacugcaauaucuaccauccaaaucaagauguacaauacuuugagugccccggaacauuccucuaagcccauucccaggcaauauuuuuaacaucugaggcggugugggacuuaaaucaucauuguuuaguugugccuauuucuugagcuucauuaaguagaaucauauaauaggcaccuuguuucuggcggauucuuacacaguacagcaccaagauguauacauagucucauuuguaucagugauuuucauauaugauauuccauuguguacacucugguuugauuaucugugcucuucuucauggccauuuagauuaguuucaggauaggguauugugucuuuuguggcagagcugcuaauauacaaucuugauuauauagccuuccuuucuuuuucugucaguauguucagaucacaggguaagaaguaguuggcuugguugacacuaugguuuuccgagacaggguuucucuguguagcccugguuguccuggaacucacuuuauagaccaggcuggcuucgaagucagaaauccaccugccucugccucccgagugcugggauuaaaggcgugcgccaccacaccuggcuugcuaaauacucuuauuugaaggcuuagaaaguugcucguuuagcaucuuuguggcuuuaauguuuguuauucugaucuguuccuccuacaauaucauuuuguuuucaguuugcaucccuuaaugccagugugucgagagcaacuguuuacaaaaucacuggguauuuaggugucucuuaugaaauacauguuuucaagcugauuugauuuuuuuuuuauauauauacauugaacugcucagcuuuuucauacugguuagaauucuauguauauuuugaaugugguuuuuuaguuggauuuuugugucaugaacauuguuauucuugagugacuguugguuuuugagauagguucucaauagcuagacuuggcugggcagaaacuugcucuacagacgggcuagcuguauccugccuuugccucgauuauaacacucucaaccauguccagcugcugauaguuuucuuaagugguucuggaaaugucuccuauguccuugcuucuucauuuuauuuaggagagaagaaaaaugugcuuucuuuuuauuuuugaaguuucccucucuaguguuccugcucugcuggaauguagguaggaggccaguguagauaaucacucagggaguccugacucccaggugaguuccaguuuuccuugaauggcaccaauuccucuuugagaaacguaaaucagucuugugacguagccacugugaucuugcuauacaaggcugaaacauuuaaaaauacacagcaaaauuauaaagcagcauuguugauaacuauugguacaguuauuauugacaaaugaggaaauuaaagaucacagagaaguccuguggugaggcuugguuugauggcaugcuggugcuucauguccuuguuucccucacagcugggcccuguccugugcaacacuguuaguaaauuuuuacuauguucaaaguuccuuaggaagucagcuguuaaaaaaaaaaaaaagcuccauccuuagagaauuuauuuacauucuuaguccaucuuuuguauaguaccugugauacauuagauuuuaagaguuuaauuaguuauuugguuuaauuuauaaauuuaauagauuguauauacaaaguaggauuacuuucuuucauuuuuguaauugauaaauuucugguaaugucuaauagugguguugaaaucuuguaguuuuucauguugauuuuuauugcuaaauuuaguggguacauuucaauugauaugcucuuuauuggugagaacguggaauaagcaguuuuaaagagaggaagaguuguugcuuucagauuuuuuaagguaacaggcacuauugacuauuagacaguguagggcuguuuuaaugaacagagaguaauuugaauguuguauaauauaggcugguaucugucaggcuuucucuguguaaagguuuuuguugucuucuucuucuuccuccuccucuuccuccuccuccuccucuuucuagaauuaauacuguguggaaaacccuguuggaauuauauaaauucuuuuaaaauuaugucaguauagaaccauguuuuuauacuuuauucaaugaauuaugcauuaauaguuucuuuuguuuugcugcccaaauugcccccaauuagccagugacauaccuuuuaagcugacuccuguauauguuccaaucauuaacuucaugguucuggaaugagacuuaauucaagcaucucaaccuccacucuugaguuaacauuucuauaacaagugauacuuauauauuuuaguagaaaaaucacauuuaaaauuaugauccacacuuuagauguguuccucauugcuggagugcuggacuguugcuuucagacccugucaguuaaucagaacuagagaauaaauguaugaaaacacacacacacacacacacacacacacaccuuuauuuuuguagcuauaucuuuuuggaauuacacaugauuuauuuaugccaacgccuuucauuuuaauccaaacuauaagguucaucuccuguucuuuaacagugagaggcccccuucuguuacuugcccacuuggucaauuccuuuauauuuaacuaguucuuucaauuuugcucccggcuuguccccuagauagguacuccaaucagcacucacucauacacacacacacacacacacacacacacacacacacacaucucacauuguuuuaaauaagcuuacaguuuuguguuggcaguauuguguugcaggcagccacaaggccuccaaguuggacauacuaaaugauggucaagcuagaugugucugaaaccggcucuaucucuaggucuuagauacugaguggauauugaguuuaaaucuguguuuguaaauauauauauauauauauauauauauauauauauauauauauauacacacacacacauauacacucuaaugauggcugucccuguuuccuaauuagcaaauaaggcuaaaugagcaaauacccaggacucccuuuaucccuuuuuuuaguuugcuauauagagacauccuuuugcuugaucacagcuauuuaaggguguuuuauuugaccuuaauaccauucaguuuugagcuuuucuucuuuuugccuagaacagucauuauguuccucaguaguaauagaaaaauuagucaugaauuagucaauggauagcuugacaaguaucucagaaggauucuuucacuacaugcuugccccuggcauccuguguguguguguguguguguguguguguguguguguguguguguuuuguuuuguuuuguuuuugccauuauuagagggaguuccuuggcaaauauuuaaagacauacauagcucauauaucccaggcuggccucaguuuucuguguagcugaaguugaccuugaacuucugaucugcuuccacuucccuaguguuggguuuauagguaugcaucacacaccaggcuuugugcugcugggaaucuaaccuagagguuuaugcgugcugggaaaugacucuaucaaucgagauacaccccaggcuugugaacucuuuuuaacugaauuccuugaguuuaguagcagucuuuuaagaguuaauuuuuuuucuaacauauacauguuagccacuuauucuugagucauugaggcuugacuguauauguguguauguauugagugcuuguauugcaagcaggugaaguugaacuggaauccacaguauaauugcaaacugugugccuaucaaauuuguaguuuuucagagucucaguuuauagcagaauacaauuuuagggaacauuuaaacagcauagcaagguuuaaaaauagaucucaagugguguguugcgcuccauauauaccuuaacuagggcuucugggaaacacaguucuccucacaucuccauaugguuuucuaggccaccuagcucuaucauuuuggccaucugaugcaagauuagcauucuggaaaacuuuaaauauuuugccugcaucuaauuaugcuucaacuucauggacgucaacuaaguuaaucaucccugcaucuaagcaagugucuguguuggugagcacggagacacacaacacuuuuuagaaaaauucaugugaauucuuuuguaauggccauccaagggguuaagaucuaaggcaguccauggccaucacuuugccagcucuauuucacgaugacaacgucaguaucuaguacagcgagguguauauuaccuucucuguuaguugagaaugggaagacagugaaagaaacaaauaggaaagcauaccaaaagugggagaguuugaggcuuugaacauaaacaugcauuaugagcuuagcucuccugcacugcuccucauccuugcccacguuuuccgagagcuuuggcaaccugaaagucccacuguuggguaaaucccaccccaugguucaaagccuagcauccaucuagucugauuagucauuugguuucauuuuuaaccaccaucuuucuuugaaagcuguuaaaauuaguuucaugcccugcaggucuugacucuuauuuggucaaagcccuugccuuuucacauuacccugucuucaauuuuucuuugaaggcauguguccuguauauagcaggugugauugguuaguauucuccaaagauuuauaccuugauuucauuuuauuuuuuucaaauuacuggcuguuuuagguaaucucaagaaauguacaccagaaguuaaaugauuaaauagugaaacugugguauagauguuuagaaauaauaauuauuuauauaauuauuuauaauuauucuuguaauacaauggauggguagaucuagaucccccucucuuggacagcaggcuugguuucaucucuaaauguuuucagagguucucuuugucccucaaaaguacauacacaccugagguucacauucaucaggauagccgucauuuuccggccuauuauaaggaauccauuuucauucuguuacaucuuuaaaagcccuguaucugggcguaguguauucugaguuacuuccuugguguuaggacuucaacacggauucuggaggaacauaguucagccuguaaguuaagcaagcaugcuugacauccugaccuaucaaagugacuuugguguagacuuuauaucugaagugacuugagaacccaaguaaguucaaaucucuagcaccugaauaaagggucacaugcuucaguaaccucaagugcucgggugauuggaggcaggccgaugaugagggcuugcuggccagccagucacauccuaaaccaagcuucaguaagauucaaaaacaaaaaaccaaaacaaacaaacaaaaaaccccacauaaguauagacuuuaaugcuccacacauaugagcacucagcauacauauguaauuauguagguggcuuuaucacuaguguacagucucuuuuuagguagucuucuuguagcuccaccuaaaaacagaauuuuaaagaagagccaaagugucccuaacaguauuuccuuauagcauggucucagaaagaguagcuauaggccaaauauccagacauaggggaauagucaaguaaacuguuuaugacuaauguuguaaaagauuuacaacuuuuaauaaaguacagaaaucuuaauuaauuauauguuuugaauuauauagaguacacauucuaauuuuaugucuauuaaaauuguacgauuauuuguaaauguauuuagcaugcaguguuaagugaccaaaaaaggacaguucaguuaguuuauguguagaacuguuaggcuugugcuggaauaggacuggacagaucacgugcuagggcacagugcggcaagugaaagaaaaccugcucuggaggacuuccugugagaguugucugggcaagugacuguccucugcgcgcugacgaggcuucucuaguaggcuauacuuuacguuucucuuugagcuucuggaaaaaaguguuucuuacacuguuuaguuaagaacuucauuguaaauugagagguuuucagagagguuuucuuucuauggauuaauuauauauaaauaauuacuuauauuagacauugaagaaauuucaaaauuacccauuugaaucuaaugaauccuuggcuuccuaccauuaaguaacuauuuuuugggggugcggguggggggagagauagaaauaacuaccacgagaagaaaauugagacuaguaacauuuuuuagggaugcaaaucuguuuuuaaugugaccuauuauaccauugcauucucugaucugccucuggaguuucucuucugaugucuuauucuaguugauguuuuugaaggaauucuugcuccggguguauggcugguuggaaagggggaagaagagaggaccaggagucuuugcuuaccguaugagaacuggugcccuuuaucagcagcauuuuccaaaugaugagcacauugagcauucugucagccccauggaaagcugaaaaguggcuguggauuguuuagucagugcuguugcuuaaaaaacuaaaccagguaucugucacuguccugucauucuacucauuuugguugccuacaguuaaaacccauaaaaauacuaccugaagcuaaacugggaugugcuccaauuucacauagauguagagaauguuuaaaaaaaaaauucugaaaucuuagucugcuccuucgucagagaacaggagcugugcacuguccacuguggcugucggucccguguuuagaaugcagugggaagcauucuucugauguuugcagcucugcuaccauuuagguauaggcuggcuccuaaauaauuucagguggcagacugguaaaagucaugucauagagcuauguaaugcugucauuuuaauccaggacaauucuccugcuauaaaguaauggaugugugcugaguccuaacaaucaucuaguccaagucauucaaauuaaccaugauuuguuuuuccaauuauuucuauuaauaggaacugaauauucauugauuuauugacauuugccagcaaaugaucguuuuuguuaagcuuucguggugggauuccuaaguggauacauucaauuuaccaccucauuuuuuuguagcaucaucuuaagcagugacaaagauacuuuucucuacguucugucucggaaacaucaguauucuagaaaaguauaaaucaagacccacugauacauuguuagggucuacuaaaucugauuucacauaaugaugcuguuauccauagguuagcaugcaguucuguaccuugaccacuaugauuuucauagagauaaucuuaaaguugcugacuuuuucugcauucaugaauuuuuaacaguucuugguuuccuuugccguaauuccuauauaguguguauuucugaguuucuuuuguguacacaaguguggacguaucuuaauagugugauuuugaguucucuucauccuaacucugggaggaacucuauguacuugcugggucugagauguugcuguauugcagaugcugccaaugguuuccuuuggccccagccaccaccuucaguuugcugagugcagaggauacaguaacaaaaccaaauggaguagaaccuuggcacauauagcgcaggcugugguugguaucaacauuucuuuugauguuaguauauuugaccuuuuguugaguugaucuucagaaauccugucuucuuguuucuuauuuuuauuuauguauauaacaaagggauuugugaucagaggaaaaaauaauuuguaaguugguuucaaauaauguuuccaggacugguuuguaagaucagaugugaguuuuucaaauuggaaccuuuccuaauaggcucuugggaaaugucuuagcuaaauugcaacagugacuggugaagucgaucgagguaaauugcucccauugcugagggcucagaaaccaggcuguggaagcuaaaauuccugggaaaucgggcugaacucuugcacaugguuuccccuuuggauggagaagaaggcuggugccacuguugauggaugagaggagaucaaaaccuguuuuuuuugcaaugaauuggcagcaugcucuuugagaaacuaaagagaaauuuaugagaagacuauuaggaucagcugggugauuauuuuaauaucaucuaccaauuaugucuaagaacacacccugaugccauuggacucuagugguuugucucugaaaaguaacacccggugcacuugaauuucuacuugacauucuacuauugaucgucauguucuuuuuuuuuuuuuuuuuuuuuuuuuuuguauuuuaaaaagucagucugaugcuugugacugguuagaacagagauuaucaaguaaguauuuauuuuggguauucuguugacauuagacaugucuugugucuuugagaaagucccuuaagcuuugugccacauggcaauaauaauacaucacaaaauuguguggcaacauuaggcccuuuauaauugguaaaacucaauacuaacaucugucuauucauuuuuuucaguuucuggcaaguguagacaguacugaauuaaggagcaagcuuuaaauccuucaauuaaagcuuuuguggcugaggccuagggagugcuccugguagcucucugugacaugugaaaauucuuccuugguagaaguuuuagaagcugaagucuuucauuuaucaagaaggauaaaggaugcagugacuuccugagcugaugaguauugugggccuguuacaugugugggcagaauuauauaauuaauagguuuacagcuccuuuggacuauuauaagaguguauuuaaaucagucuucuuuccuucuuucuucaucuguaaacauugggauaguuaauuauuuaccauucauauuuuaauuucccuuggauaagcuugauucauauggacagagaaccacaauuuguguuuaaugccugguguggucugaauguuucccccaaaauuuauguacugacaguuuaaucccccauguacuuaagaggggagauuuuaggucaccagagugggguggauugauacccauaaauaauaaaagguguuuguuucccuguuagccaguucugugcucuccugccacaugugggcaacagaguuccuccauuguggaggauguaccaacaaggcaccaccuuggcagcaaaggguaggccuucucuagauaucaagcccgcugcaacauugcuugaagguagacaugcagcuuccaaggcuuuauaaauuauccaguccuauguguucuaucacagagcauuccaucagacucagguguagccagaaaguuaggguuuaugacagacagguugcuuguggucucuaugaauucucccuuagauauuauauuauuuaguccuguuuuugcuaucucccagaauuguucuugccaugaauuuggugcaacucaauauuuuccuguuucccccuaccguucugucccugucuaauucaggcuuaguuccuccaggcucuggugccuguguucugugguuuguaaagugcuguguacuuugauagccucuauaaauaacaaaacagagcucauggcaacaacacuauugcacagucauguuuagauagaguguauguuagacuaugaggggagagagaugucuuucuacaguuucugcaaugcaaaacuguccuggucacauacucaucuacaccgcuucugauuuugcucgauuauuaucucuagaaugucuuaugcauaacgaaggcuuguugcugcugcucucuucucucauuucccuccuccuuuaacauaguagaaaggcuccuucacaguaugcugagguucuagccagaugcuagcaugcugggcgcccagcuuccugucuuggcugucuuuuuuuuuuuuuuucuuucaguggcucaccacagcugccuucacauaguuggaagaugugaagcucagaacuugaagcuauuucuauugguccugucaauagaguuugauaaaaugcaaaugccuguaaaaugguagacuuccaauuaaaaggcuccagcagggagucuguuuugauaaugaaagugauuaagaaggcucuauuuuuuuccauugguaugaaugcucaacuaaaauagcuugacuuucugucuguaauuggacucuguuaaugagguucuaauaacucuuagggucuaauaaugauucuagcaucaucuucagcgaucaaugcuagggacaugaagaacauaauuucuugaugacaaugucauauaaagucuuuaaugccauccguuuccauuuuuuucucuaucuaacaggaaugaaugcuuauuuucuuuaacucugagaucuaggugaaucuuuggucuguauaaagcuaagcauacuguggcuuaaugucuguuuggaaaaaccugcaccuugucauaagccuaggagcaccaauuugggcguguaaguauuagaugcagaguaacacacagaauuagugcagcugaggcaccaucugaaauucaauuugaagaguguuuaguauguacagccccagggaacagcugcaagcuaguagaagccuuucuggugaaaguaagcuggagaaaugaauaugcuuccuucucaacccacauaauccauaauccacauagaagacuguuagggaugggugccaugguuagcucacagcaccucauuaauagacugucaccuuccaucuuuccuuauuagagucaguguuuguggucucugacuucaaucagucuucugucuuaucacuaguuuuuucuuguucacuguuuauucuuaaagaaccaucuacguuucuuuauaagaaaccagccugccugucuaguaagaaaggauuacuaagugauggcuaugcuguggauuugcuuggugacagaaugguuaucaagccugcuuuguuauguagguucaccauccuuugucauacagccuuauuguagccauguaagugggagcauugaggacgguuuucugugcuuggcuuggguuuaugugagccauuuuuuuuuccugguuucaaauguauguugauguucauauucuuuguaccucauuacagaggggauauuguagcuuuuuguuuguuuguuuguuuuuuguuuuuugagacaggguuucucugcguagcccuggcuguccuggaacucacuuuguagaccaggcuggccucgaacucagaaauucaccugccucugccucccaagugcuggaaugaaaggugugcgccaccacgcccggcugauauuguggcuuuuaaaauagauuuuguguguuuguguguguguguguguguguguguguguguguguguguguaucagggcuacauuuacaugagugccagugccaguugaaaucaggccugagcucguccuggagcuggaguucugggaggaggagagcucucaggagugcgugcugggaacugaaugccuguccuucacagcaguagcugugcucuuuaacuccuuaggcuuuucauuccgauaucagaaccgcucagaguaaaaucaguuggugaacaaacuuaacaucccaaggcugaucccuggaaaacauguugaaggcccuggcagcaugcauugugcucucagcaauucugcuuugccaagggaagccagagauggagaagcaggaaacagcacaggcagaaguaagaaggaaccugaaccacaauugaggaaagggagaaucaaauccccugaaaauuguucugugaccuccacacaagugugucauaguuugugcauauaccuugcaugcacaugugcgcgcgcacacacacacacaguaggcaaacagacaaaugucagaauuagaguagaacuuuaccuuucuugaucaucaagucuaaggucagaacauaagacaaagauaguaaauaguguuuacucaucccccaaauguauuuagugccagcuuugcucuaacuuuccuucgcauuauaugggaucaggaacaauguacaaucucuuugagugaaauugagaagggaucaacuagccaguaauauuuaauccuccccgccugcuuuguuccccaaccccaucuuccuaccugagagagugaguuauacaaccaaaaaguuaaaacauguauggcaggcccucugucuucagucuucucaaguguuucuaaugauuugucccggaaaagguaaauucccaugauuuacacagguauuagcaguugaacugaggguagaggauucuguuugauucccugaguggaaauguguuagcuacugauacagaguuagaguggcugagacagagagagagguugguuauuucgggguacccauuagaggagcaaugcuuuagcuauauucugcuuccuugggauuguaacuagcuagagacaggccaaaugucaacauguuugcccaauucuguugaguuuuuugauuucuacuacccgcuguauugaauuacugaugauguaaagggacugcuuuggugucucuagcacaauuaauuucagcucuuuucucuggcagucauucccugguucuguucuauuagguauaaacugucugcugucuuuacugacucagaccuauuuauucacaauaccugaguggaauaggaacaaaugguucuuugaaauaaugccuuuuauuuuccuuauauuauguugguggaauccuauaguuuugggcauuucuguauaugaagauugacuacagaauuucaugugggggcuugaggggagagagaggcgcugggggcggggcagucuaguccucucccgcuuacuauuuuauuuuuucuauuauagaggcagcuguuaacugggacggugcccuuuguaggccacuacuggaguuugcacugcuaaauccucucuugcauuuuuaaacucucagccuguaaugaaugaaauagccuugccuccuccugaugaggauguuuaugggucaggccggcagccuuccucugaagcacaucacugucuccuuuggguugaagcauuuguauagcaacacacuucugaauggaggaaagaacugcugggagaccucucgaugccaccucgcuuuccuguuuugugguacugcucuucagugugcaguguggcaggcggugaauaccaguacccaaaggucuuaagcugguaauuagguucauucaugcuucguucacucagugcuuggguauuuucuuuagcaccucuauagaacucaaauauuucucaguauuaugccacuuaccaagaggcugcaaagaugcuucugaagguagauggggcugguggguggauacauuagguaaaauacagauuaacacugcaugguagaagcagagugcuuggcauagaagaaggaacccagagcaauagagaagcucacauaaugagaaauuguguaccucgguagugcugugcugguagcgcagaacauccacugcguuucucccacaccaagcuuugugccaagagcauugccugggcugucugucugauuacucaaacucaaagcuacaucagguuaagucuuuauuuuaagauguuaggaaaugggagggcuggcugcuuuaagauacuuacagaaagguaaauugcuggugaguggaacccuugggaauagacccuagguguggccaaaagaaugugcuugcaccaucuacuucuuacuguuguguauuugcuugacuuucaguucagugcuuuaucugggucaccaguucuuucaauuaaaaaaguguaguaaaaugaauggguugaguaauuuguguugugcugaaugcuuauugcuauuucaugcuauacacuuaauuacuucugugugcuuauugcuuaauuacauaaaaugcaguacuuccuuuaucaucuuucugcaaaacugccccuuauuuacuguggcuuaagcaaaccagaaagcaagaaaggaugcuaauuuuuaauuuugguggguagaguucuuuggggguaauguuuuaugagugcacugguaccugauggucaaagcaugugucuugucaggaugcaaguguucagcaugggaacguauaacagaugccaucauguagcaucuuuccaggcacuggggugacaucuggaccuaguauuuugguauaagagaaaugguucuugcuaaucauguugucacaggaucauacaucaaacagagcugggggcuguguauuucugccaguugccuugugaucauuauucacccugagcugaugcaaagaacaugaucagcuugggggccacaggcuaauucuuaguguacacauacuauuggugucuuaaaggaucauaguuaaguuuuuacauuucugugcuggugaaagugauguaaaugggugguguuuaggccugguuggauguuuucaacauuucauguucuucuaccuuguuucuauauuauacccuugacucuuugaguuccacuugcagauagauugaucuaacauagugggaaucuuacaggaguguaaaggguagaaacaguuaaacuagcuuuugccagugagauuuuucaguuaugauggaugaaacauuguauuuaugaaacauauccugucuucugggcuuuaucagugauauaugacacuuacuugauucuuaaaacuuccauauuacccccucccucaguuaaauauauaaugaacaguggcauaugaaaaaugauguguuuuaaaguaaguggaaucucucauuugauuaaaugugauaguucuauuaugccucauuaugagguucuaagccccauucucaucuguguuuccacagacuggagauuguucagcugauuggaucacuuggguacuuuugguuucagccuugccugcuccucauugguguuugcucuccuagcagauaauuuauguaacacuucguugggagcagucuucauaaaugucaucaacacagaggggcauuggaggaugggaguggagcgucuauuucagugagacccauuuagauuuaauacuguuuaccuccaccaagauaaagcgcaguggcuguguccuugagucuuggaggccugggccuggaggagacucugagcgcaugugccuuuucucacuauucaaaaggagacuuuaggaccucagaugagugggucuuuuucuugugaacagagaguggagauauauauauauauauauauauauauauaaauaaaauuuaucauucucuauuuacuuaggcucaaaaacccccuauaguagacagugggcuuuguguccucaguucuaaagugacucuuuuuaacuauguauauuuaaagacagguauuguuauugugucuaugaucuuuccucuuaaacaugguucuucuuaagguugaaagaaacaaggauauuucaucugauuuuccucugcuugcuuguuuguguguuuuaucagaucuguguuuaagaaugcauuuuccuucauauuuccaaacaaaccucuaguuucucacagugucacuguaugcugaauguaaagcagauguauaagggguccuuuuaacaccugacucacauacugcucugaaguaacaauagacuugaggcuguggcucaguugcucagggguggcugccuagcacgcauaagcccuggauucacucuucagcucugcaugccccgaauccuaacugacacucuagugauggagucuggaggauccggagugccaggccagccugggcuacaugcgaucucaucucaaauaaaaaagcaaagagauaaaauaagcuuuaugaagcauggcacuuuucuucuagaggagacuuuaagcaauaagcacaggguaagcgaguguucugcaaauggcugguauccucuuaagacuagaugaggacacagaagcacagggaagacaaaggcggaaguuggggugacauggugguaaggcagggagcacccagguuugccaucaucccgcagaccuacccaaacuggaagagacaaggaacugaacccagacugcagaagaaacaggguucugaaccucaaugccuugcucucauagacugggcuuugaccucugcuagagaacuccuguuguuuauagccacccaguuggguuuuuggcaguuuuccuguucuacaguuuacaguuugugauuaagagugacuuuccuuuuuaaauaacaauuaaaacaggcaaaaacuucacagagcuuuuaauugaacaacacauaugguagggguguuuuauuuuauuuuugcuuuaaaaaauugcuuuaaguuuucaagugaucauaaggaauugcuguuucuagaaucugagaugccaacuccugagcauugcugcccuucuguguguaaggugugccguuguggcuugccugggcuuccucaugcagccuuccucaaaagccaacuguuucaagcacccuguuauaucccuuuugcaaucacucucuggugccaggaaucccuuugcugggacugguuaacagagagcacaagucagaauugaugaguuguacagucauuucaaauaccuuuuccuuuuguauccccuggauugaaauuuuuaaacuuguuuccaguaaauaagaaagaucucuuagauuccauuauagcuuauaggugucaagcuuuaaacaaauuaaccaaaucaugaagaugucaacagauuuuguauagaucucucugagccucugauuuuggccaauauauacauguuacuuuauuucugauuuuuaagcuguucacguaccuugaagcagggagggagagguauauugaguguguauagaguugggggagggaggggaggucuuugaaaagcccagagcuaggcagggagccuguuagcuccugugauccuguugugauccuguuguuuucuccaucaaggcucugggguuaagguuacaaguauuuucaggaaacuacgccagacuucuccagugaaugccaggauuugaauucaggccuucuugcuuaugcagcaagcccugagcuguuucuccagcccugcaucauguacuuaaaaaaaaaaaaaaaagcuuuguauugagauuuauugauguugaaggaaaacuacccauauguaaaugcauaauuuguaaaaguugaggaacuaucuauauauaacuacaaagccauaacugcagacaacguagcgaacauguggcccuugguauucagccccacgucccucuuccacagcuggaaaccacucaucugcuuucuguccucacacguuaguuugcauucgcuguaauuuugugugaagggaauuagauagauaugcuuuugcuuuaaaucuggcuucuuuaguguccacauugugaccaguauccauaauuauuuccuuuucaugauauggcagugguguggucaugguuuguuuauccuuuauuuggugauggcuuaggugguuggauaagcauuuguguggagucauguuuccucaauguuuauauuucccuuuuuuaaaauaaucaccuuugagauuauaacuguauuauuuuugucuucucuuuccuuccuccaaaugcuucaauguaaaauuucuuugcucucuuucaaauucauggccuccuuucucacuaauuguuguuauaugucgugucugcucucgaccagcaagaacaacacgacuaccaguucuucuaacagcaguuuauucagcaagcuucagucuucaucucucucgcuucaucuuuuucuccccgaaccccgggucucucacucuuauauacucucagccccaauccacucacagcaaaccaugucaccucaccaggcacgcagcuucagccaaucagggcgacaggggcaugucuccaccaaauauggacuuguuuacaccgccagcaucauggugcaccugcgcagcucucacgauggucguggcuuguuuucagguguaugaggaagucaggugcaagucauaagacuuagcugcagucccaggcgccaucuugggacugcugccacacccgcuccucacaauuacacacacacacacacacgcacacgcacacgcacacgcacacgcacacgcacacacacgcacacaccauuaaaaaaaaacccaaccugcuuagccuguguaaugcuauuuugaugcaugcuuucaggacagacuauuugguauuggauaagcaauugguguacuuuuuguggggaagaauauuucucccacucugcacauuccucaguugccucuagugcuuucuguuggguugaagccuccuggucuuucuccuguccaccuuaguguguccuuuguugcgucuuuauucagcucauguuuaggcaaucauguuggugggacuauguguguguaccuucugacauucuuaggagacacaguuucagagaaaauucccuguucuucuggcucguagaaucuuuuugcccccucuucugcaaugaucccugagcagguugugugugggaguucgcuguagcuguaucugcugggacuggccuccacagcucugcauuuugauugcuuugguuuucuguaauggucucugucgguuacagagagacguuuccuugauaaaagggcaagauuuaucuuauuuaacugcauauuuuguccucuuuuguguguggauuuuagaugauuucuuaauuuucuguauuugaauauuuuauuucagaaaauauucauguuugcugaaguauuuuuauuuuucuauucuaaaacuuggcuuuauuguuacuacuucaugucauaaguuuauugucuuucugcagcuggauuuaaaucucucuuuaaucuugcuuucucuacccuguuugacuuaagucuuuggcauagaaagaagacuuuugcagugccuuugaauaagcuguuccugucagaagccagcucugacauugaguagugauugacaucccauggugcuccagcccaauccgcucuuuaaagcuacuuguuaaacaccauagcaugaacucccauuucuuucugcccuauuauugaaucuagagcagaaccugauagaaccuuaguaguucauuuguuugaguugacugcaugcauagaacacaccuagaaauuacucugaugaaaggaccugccauuuuuccucauggcuuugaugugcaaaguugauuauucauugaaaauaauuuuuauaaccuauauuuucucauuucuauauuuuuccaguuuuuguuuuaagaagcugguaaauguagggcuuucaaauagaaaauuguugcacuuggugacauuuuauaucagagaaguuuccuggcuaaagcuaaaacuuuacaagggcuucuuaggaauaauguagaaaggcccauaauuguaauaauauguaaaguagaugaguggcuagauguguauauauggauauugcaaagaaauuccagggaacagucuaaaauagugacuuucuaaaucugauaugugugacaaaugagagcuugguuuauguggugguccaccuguuuguuucccgucuguggggagguggcagagggugaguaccagugcaaagcauggugacuuuccucuuaacgggcuggucacuagguaaacuucuuaacccaacuguuagaaaauccacucagaggugaauaaaggcgacugcuuugagaguggagggcagguucuaguuucugugccgcucaugcacgugaguucucgggggugugaagcugcgcauuuuguauaacuaagggcuugagguaaugguaauggccagcagcaggaaugaagacauugggguccauuccuucuugccuagggcauaagucuucuccagcucagccccauuucacuccaacucagaacagacaugucugcucagggaccagugaguuuuaagaacagagaucuuuugggaucugugugcucaggggaagcacacuccuccuuacucuccugucacccacaguauuaguaugcauugcuccugccggcuaugcacucuccucugauuuucagucauuagcacccuuuucaucuuuauucacaacugaaugaauuuugaagcuguuagguuaagaaguuacuuacugacccagccuguuaggaaugccacaguugauuugacuguuucauauuguuacuccucuccccccuccuccaaacaccccccccccccccccaguuuuugcccaccuucucauagggcagaaacaaggugaaccaccaaguaagccaagcuguuccaugucuacgugggcugcauuuagagagacacauuagaauacggcaaugcucuguauagauaagauggcagaaacaagcucugggaguucuugaggaacaucugugguugcucaucagccgcaggcuuugguagaggaaacauuucauagacuuguaccacaacucaggguagguuuucuuccuccuacuuucagguucauaguagaggaagccuggcuguugacaggcgcagugaaggguggacgggagcaaugccuaccugcuauuacugaacuuaaaugagaugugacaguguugguuagaaaguguagcuccgaggagucuguagaguagaaauguauuucagagaccaaaagggaauagaguguuuuugucagcuucuacaagguaaccaguuuaguuugagauucucuuucaguguugacacagagguguuuuuuuuuagaauagaagacuuucuaguaaaccuuuaaauguucaugaaaguuguuccuccccccccccccuuuuucccuuuuuaucuuuuccccucagucugugcccucugcuuugcuuuaucuggaauauagcccaaaggcuuuuucuuauuucuucauggccaaauuugccugagcugguggcgguucagaacuuagcguugcucuuuucuuaucgucuuccuaggguuucuugcgccuacuggcugacauugcucccuuuucuuuaugauuccugucugucuaugucuucuacauaguggcuugcuuuggugucauacaguaaugucagagucaauuauuguagaaaccuggcaguuuuuaaaucagacugggcuggguguuaguucugucuguaugcuugguagugacagucagacuucuuugcauccuacuucuuuugucuaugaaguguugacacugucauucuucuccauguugaauggcuuucacauagugcccacacgggcuaggcauucagacauuguaucccccuuuaagacuuacuguuucucaagcuuauuuagugacucguaguuagccuacucuggguccccaaggugcauagcuucagcucuuaguuuuucauuuccuguacaugcagcucacuuaauugagagcugcuggcuucuucccuuaggucugauuuuuuuuuucuuuuucuauugauuuauacuaauauucuugacuuuuguuuucaauggcuauccucaagugccauuuuaauuuaauuuguuaugcuaauaucuuaaaaauaauuugcuuuguaauuugucuaugugaaauaaggcaaggcaccuaccuacuuguauacuuggacauaaaauuuccuaugccagaacccacagcugagcuguucaguguuggcaggggauuauugcagcacauaaagaaaucuugcucucucugacaagagugguaguaucauauuaaggaaggaagcaaggaagucaugaaagcuggggguucaugauuguuggaaucaguuaaaauuucaacauucuuaguccuaauaugucuucuaucaucagaaaggccucugaauugacucuauuucuagcucuuucuuucucuaauuauagauguggcugcaaaauuaauuuuucagaaauuaugauucugcuacuuaucauauaguaaacuguuaaaaagguuuccauuucgugcaaaaaauaaaagaacagcgucauauaggccccguguuauggccucugcuuucaugcacuuucuguaugcaugccuuucuucuaaaagaguuugugguaacauuucauuccugugucacuguaaacacuuaguggguagggcccaacaugcaauaugggacagucaucacuacucaauauuuggcucacccaaacucagcagcauacucaagaacagaacaguacaauuuccuaagucagaguguuuuucauugggcuucauucuuucaucuuccuuuuauuuuccuguucuacuccugccugguuugcucuuuucugcugucuggguauaguuguccccacucuucaacauccagcaggcaagaccaucuucaugaagccucuaaagagccucucccaccgagcugcugccagacuugauccacaucuuguuuuguguuccucuuuuuuucccucucacagucuaguguauggcucauccccauugaaagauuuuuagcuuccuugaagguaggauuccuauuugauuuaguuuuguauccccagcauguagaaugacuccuuguagcccauaaaugggcuauauacaguagaaggagaggucuuuucugccuugaggcaauagcaagcuuaagaacuguuuguuacuugaaaauucucuccaaaugugcugaaauauuuuguagcaguuuauguuugucauuuuuuauuuauuuuguaauuacuuucauaucgcacagaguagauacaguaguuucugcuuggaaaauugaaccaacauguaaagacuguuucaugauaaacaggguagaccuugaaagucgccaaaggcuggguaccugaaucagaauuuuuuuuuuauuuuauuuuuugguuaagguaucaaaauugccaggaccuuuuagaguacagugcuuagacuccugaugugaaguccucuaaggcuaacgugagacuuccacgagguccagagcaccaggacucacaauaggaauaauuucaguauuguuguauuucuguuuucuuugacaucucaaauuuggacuuggaaucacuacucuucaaagauaucuuccuuuguaauuuuucuucuugacauaaugaaagccuaucccaguguucucugucuggaguuuagcucacuaaucauaaugacaccauuagucugucuuaucucuuuuucaagaauuguuucagagcuguaacugacaaauuagacaaugagaagacaaaauccuuaauuuuagauucuuuuuuauccaguugggucauuuagaagaccagagcaacaggcagccaaguuccugaagaaugauuucacagugcacugggauuugauugccuugagguguccugugcuggaaagugaguucuuuaugauucugguggcauuuagaaucccacugagcuauagaaaacucaaguuuuaugacuuccuuguuaggcugcacugcagacacacuaacacugucuagucagugagaaacaugagggauuuuccugcaggacaaagcaaaacuaagaucugacacacgggaucauauuuuugcuuaacgugcaccaaaaaaaaaaaacaacaaaaaaaccugucuaagaaaagguguccaagagugggcauccacaggaggaugcugucauucgcucacugaagagguucagacaaaggcugguugaugcaccuuauagaaggaaccuugaggagauuuggaaggacuuucaaauucucauauaauccauaggagcugugauucuguggguuuuuuaauucauaaauguugagaccaguuaaauucaccauaaaaagaaugcauuacuuguaucaaucuuucuauacaccgauuauaaguguauuaaaugcuucucacuaaagcugucuaugucguauugcagucaucuugcuuuguuuuguuuuuuauuauaccaacugauaaaauugagcuacugcauucaagaaaaauggaacuauggcuauaauuguugaauuuucuuuauaauuuuaaagcagauugauugauugauugauugauccaggauacuuauacuauagauuuguuuagaauucaguauguaguccaggauggucuuaaaugacaaaaguccucucccauuagccuccaauuucugggugagccguugggcagcucucuuuuguaauuuuaacuugguccaguucuuugaacuuacagggccagagauaauggcagaauuauuguucuauagguggcaggaaaggaagaagagacuuuuguguugggauuuuuauucggaauggaaauuuggcugugauccuuugggacuugauuggcaaguguuuuuguuguuuguuguuuguuuguuuguuuuucccggucuucccuuucagccaaggaaucucuucaggucguccguauacagagcaaggcagucacacacccuaguaucugguggagcuucccugcucuuauuaauaaucaaagcaaaaaguagucauaauuaaaugucgcuucaguaacaaaacugccccaaagcagguuuggauuuucaguguucuguucuguucuguuuugaauauauaggaacaauacccaaguuuuucauaauucucauuucauauaggcuggacccaagauacagaaauccagcagcucuuuucagaacuuaguguggauucccccuuucacuucagaucaguucccacaacagguuagccugagcuaaacuguguggcauugauaucagagguauccagaucccgaguagcagcccucacagucaagcugcagcauuuugaccccgcccuggauucccuucuuagcuacauccucagcaacagccucagcccagcauauuauuuaacuccuuacuuuccugugguggggugaacuggggggguucgguggggaccagacagugcuggugaucaagcccagggccucucaucuacagacaguaauuuuacugccagacuguagccucagccuccuguuguuucuugaccauuucuccuaagcaaagaugaauuuaaaugcugaccucccuuguuguugagugcaggcacagcugaggucugcuuauuuucagggagaaaggugaagcuauuucaguagagucuucaucagagcaguagucucugugauucauuguacgaggcagugugcaaagccuugauugguuacuguguucucaccaggaaugccgauaagacucugcucuuuagacgggaucuaauuccuuugaggcuaugauaucucaagcagcucugggaguuuauuuuucuacuuaaaccucauucugucauagguuacaguccuuuggggcagauauggguuguuaguuugcugaaaauagaauuuaauuggccacuguacagaguaaugauuuuuaauuuggcaagagagucaugauucaaucagccuauuagguccuuaaaguuguguggaaggggagaaguaacuguagcccacuuggaacuucugugugguugugcacacuggagcaccuggcuaucuuuaaaagcaagaaugauggggauuaguggucuggacugagcuuuucaucugcuguacauuuacuuccuaugggaaugccaaagagaacaaggcucuagcgggugaaaacauuaucuugcuccccaguuuccuagauaggaaagagaaaagaggagcagaaauggagcgggccaguuacuucuucaauucaauaaagauacugcaggagcguggggacugaugauaagaugacauaggaacaaaugaauauaacucuggcuuuauuuuguuaaauggugguuauagcuucaccugcagaggcaugugugagucaccuuccaguauggcaccucuuuucauugggauaugcagaacugugguggccauucccagcagacacugaaccagaugugcccgcauuauggaagugaugucugacagcuguuaccuaaacucugaaaucucccagauucucucuucuucagcccucuuaauaauuucugaagccuuauuagauacggaaguguuuuacucaugaggaacaggcuaccucuccuugcugauugacauaucggucaggugacagugauuagcagaacacugugauucucauuucucuuugaugacuauuguguuaacagacuaagaucagcuucuugcugccacugaaucguuugauguaauagggaaauggaucuccuuccauuuucauguuguauagaccagugcuggagagaaguugggugcauuuacuuaccacacugacgauugagguugcuuaggccaagcacauucaccgguucccaugguuccuguagggcaggauggaauuagugaguagacccagcuggccuuugacuccgcagugcuggaauuuaaggugugugucaccgcauuagauguuuauuauuuguuguuaugcauaugguguuuugccugcaugugugucuguguacuacauaugcacugugaccauggaggccagaagagguugucugaucccuugggacuuagaguugugaggcaccaugugagugcugggaauagaagcuggauccuucuacaagauaagucaguacucuuaccuguugugcugaaucuucaagcugucuccacuuuuuaauguugacauuuuauuuauuuauuuauuuauuuauuuugguuuuuugagacaggguuucucuguauaucucuggcuguccuggaacucacuuuguagaccaggcuggcuuugaacucagaaauccgccugccucugccucccaugccgggauuaaaggcgugcgccaccacgcccggcuaauguugacauuuuaauuguauugauaggaaacaugucaaauuggaauauugaggguucuuaaauauuuauagaaaaccagaaccacaucuaaucgauacgcuagcagacuugcccaaucuuuuggcaucagaacauggcauuauuaucugcaaaguucauauuugaggagcauuuuaagucacuuaaaaaaugguuugaaaaaaaaaaagcaauauuggacuauuuucauuucaguguccaaugcugcuauagguugccuaugaaaaugucuguaugcuauaaagcaaacauaaugaacagagaaccuacccacuuuuguggacuucuaucccuagaucauguuauguaauaaucacuuuacauagacauagagugcagagguaaauugacccaguagugcccccgccccaaacuggaguagccuuuaucuccugucucaccaccacacagcuuuuaacucccuuuugaaguauugucuucucaaucucuaacccuacccagcugcucauuugaucuuugcaaaauucaaauugugucaccuuucuuccuaagugucccccucauccuacuggcuaacaucuaucacuagcaagcaaagcuggacucuucaugauugguucucuggcucccucccagaauuaccucuugucucuuuucccugaauccucuguucucugcucucgccuccuuuuccucugucuggaaaaugagcucaucuucaggucuaaaauuuaaagagaagugugugucuacacccuaugucugagaugauuucauaaaagaagggagaucuauuucucaaaaggcaugauuucauagugauggcuguccuucagucuggaguaauuuaccagcacgaacucugcacguuguuuuccauuuuuuucaucuugugacuacuggggaggaccucaccucaucagucccuggcuucuugacauguguuuucuugaacucuaaucaguauugaaauugacagagauguugggauuuggggaauguuaaaaaaagagggaaagcaauaccuaagguuugauucauugaaagggagaguguguaguaggagaauaauuuucagaggaauccaugaguaccuugacagcagugaggccuaagaaacuugacagucugggauggaugugugggaaaggcaggcaggcaggcagucauucugauuaccagugggagggagaaagggauguccaagcagaaauuaauuggaagaugaacagugcagugagcaggggcaagacaugcagccucccucaagauuguuuaaugacugcuuccgucaugugcugcguccgauuauaccaagacagaagugauauugauucauuuugugacaucugauacauucuacucaagaaaggagaugcucuuacaaguuuauuauuaauugugagaugacauucuuuaagaaauauuaccugugauggccacuagggaguugagccauuuaagccuuuugcccuaaaaguaauuuaacaguucaguaucuuucugggugacuguaauugcuagaaguucgauagucaugaaauuuaguuagcauucuggcuauugaguucauucuuaauguuuauuugcaaaaccucaaaugugugccuaagccuugaauucuuucccagaguuauccauuguacacucccuagauaugaaauaucaauuuuacaagcuggcaaaaugguauuuaaugguggcugacaggauaguguuuaaggacaauauauauuggauacuuaaauuuuucuauuaucugacucuuggcacagaucauugaauuuaaguuguauugagauugcagauguagcugccuuaauaaccucugcugugcugccuguuuauuuagucucggaccuuccuaagcguuucugcuuuccaagcaugcacagaagaaaauaaaacaguuucagcuucuaccuucauaucuccuugcauuaggaaagacaucuaaaaaauaucagggacauuuuugaggaugcuuuuucuggccucaagcauggagccagaccaguuuuauaugauuuguuggcaugaaguuuuuguuucugcuuucccugcuucugaggcuuaacuuguugauaauaccuagugauucaggguuuugccacauggaaacuuaaaaaguugugggcuaaguuugguaaauguggugcucaaaugcucgauuucaugcuucucucauuuuccuuugaauuuuaaauugcucuucauguauguuaguuauaugcaguuucuucuaaauggccucuuggauaauacauuguucaguuagauaaguaaaugaaugucuguguuacugagcgugacucauuuaaaaucucauuuguuacaaugucuuuguccacugucugcaaauuuuguguccccuugaucugcagcacccccagcuuuucaaaaaauugaauaaggcguagagaccaggauuuggggggacagcuuacccugaggacucuauccgaaugccuuuccuuugaucucuuguugguuuuucuuugaucuuuggcuauauuuuuuguaguugacuaugugugugcacauauacaugugauguuuaagaauggaauaucugaaucaaaucccaaggaaacuugaagugacuaauuugcuaugauacuguacacacaaccuguuggguugacugaauaagucaccucugguuggcauauauuugcuuguaauuucuucucgucucgcagugagggaaugucugggcgcacccuuuucucaucauuuuuauucacucuuucugcucuuuggaacaaugucuuacuccucuaaggccucaacacugugaacucuuggguuagagcguuggcgugugguuggaagggauaauaucuguaauuauugaacaccacauaaagcucuuaauaaaauggaauggaaaaaaagcagaaccauuaauguuugcuucauucuuuuaucuucucuccucuugaacaguuuagcuuuacuagagcucaauuagaugaaguaaauaaugauaauuuacaaagagauguuuuucaaggcaauggcaacacaaguggcaaagguguagcucuuuauucuauuguuccugaaguucuaccacuacagcugccuauaccaacagucaguuacaaaaucagcauuugcuuuagaaacucuaagguagcugcuauucaaauagacaauacugugugugggugugcaugucuauguguguuacagcgaguccugccuuuggaggucaugauacaagcugugcuguagguuucuuuccaccuucuugugaguuuagggggucagauuucucaauggcaagcaccuuuacccaccaagcuuucucacccaccccagcaacaauuuuuuaaaguaucuauguaauggaaagaguuugauucuuuucuuuggugagauuucuauucucuuacaguaaguuuuacauaaugcuauuugauuucuauuugaauugauugccacaauagucaacuaaauguuugcugauuaguguagaaacuuguuaaguccacguaauaaaaucuaccuacuauggacacuggccguuugagcagucaauguuuaaaaauaaucucaagcaaaagcauuguuacuaaaaaccuauguaauuaugauauuucugguggauuagucuagauuaaauugcuggcauuauucccucucuuuacagucccauuggaugaggucaguuuauuauauauuuaaauuuuguggguugaacuggaaagauuugaagagccucuuaauagccugugguguuagaaguggaggauaguuagcugauaagucgguagcuuuguccuaauaaaacugcagcuuuucuggcuauugauuucuucaccuaaccugcuuaucuuuggugguggagcaggaagggcacagugugaggucacuggcucaucagccagguacugugugucauuucuucuuuuucacaguacauacacggcugcucucugauuugaggcuguuucguucuugaucauaaugagaagcugauuguucacuccgugguuagugauacuaugauguauuguacuucuuuaugccccaggaacuauguguacucuagugacugucuuuuccuuccuucgccuuccuuuucauuccuccauauuucccaacugggauuaaaacuuuuaaauagcuugggccuggaagauguaagacuuuuauagauauauugccuuugaaucuuugaaaauuaacuucccaauauuucuuuuccaauuuccaugaaauuuuccauguagugccagaucuacaguuaaugcuggguggggaaggugguaaaggcuagcucaucacauuuucucaagugcccuaccugcuguuuccuuucuuugaccugauuuaauggaaacauuuccaccucaaaggagccacucaaaaaugcacgaaaucucacucuuaggcuaguggcacagcuuugauguucuggugcccuugguugaauaugaauuguacaacaaggcaaagaaucauagggaauugacccauuuaauauaacauuccuaggcugaugggcauuuagagcuggaaggaacaucauuuagaucuagccaauucuucuuuuuaacagagguggaaauugaaguccagagagauuaaguaauuuuauucaacaaacauuaauugagcagugcaccauguguuagacacagaacuaggugccgggggcuacagagaugaauaaguuuuaagucccuguuggagacauguacauagcucccagaucauacaguuugcaauuagcagaucagggcauaaguauuugugaaucauucaugaucacauccuucuucacugagaagguagaauuuagcuuagcucucuugucucuuuugcuaccuuuuaaucauucaaauauauauaaauucagcauucaccugaacucuaauacccucuuuuaaacuaaugcuugcuauugaaagaugaauauaagcuagacaccuccauuuuccuaccuacucaacagccuagaauuugacuguagcugcccuuuguacuucugggguauauuagaguuauucugugguuguuauuaugaugucuuacaauguuugggcuccguuguccuaucuuccuucagguccuaucuugccaugaaaauaucccuugucaaugugaagugagccuucuccccuuuuccuuuuaaacauuauuuccauggaguuucaacuuuuuccuucccucguagaccauacuucugugcaucucuauagcuacuggucauuuauccuucaagucuuaucucagaugucaugguaugaagcuuaucacccuuuuaagaauguggguccugccacccuucccacuguucauaauucuucacgcguguuccccagcccugcaguucuuguccuguagagcaggcuuucccuuuucuccuguugagaacaagaaccuuuucuccaguaacuggaaccuuacauaaacuuuuuaacaacugcaauugauuauccagugacuucacacuuggucagggaaaucauuggcuuuguuuuucccuuccuucuaacuccaaucuuuucuguugucucucccugcacacucgcauguaggcacacauacccuccauccuuggacuagauaaauaagccagauuuuucauugcugccuaacagcacuccauagugguuugcuguuagugguaaauuuauaguucuaucaauugucugucaguauauuaauucaguuaagaagcuuaaacauaacccuuaguuauacucaaaucgauuggcaaucucuuuucuaauucauaaauuauacaugcauaaacuugcguuuagcccugucugauuaagucugaguuuauaauuagugugggauaaauuauuguguguuuuuuuuuaaguuagaguaagagauuuuuauacuuuuuaucacucugacagagaaaacauaaccauacuguucccauacuuaauuguaaccuggacauuugggaccuuuaccaugccgcaguucaccgccuuguacaaguuacauuucuaggaaauccaauagccauggugcaaaaagacacguguugguugguugguuucgcccaucauguacuucuuguauugcaauuauaauuuuuuuggacuugaugugaggcgcugcugacugaguuugggugcuuguuucacucagguuggggacuucucugcugugugcuuuuccucccugaaacuuguacaauuaaagcuaagacaugccaaaaugagaauuauccucaaaguugcaguuacauguugcuaucaacauauucagaaauaaauguccauguuuuuaggauagccuuuucuuuuauguuuaacuuguucugaugccaaaccuuuaugcauuauaucucuuuuaggaauauagagguaaugauguuuuaggcugguguggcugugaauuuuuuguuuguuuuuuaauaguaaccuccugaucuuggguuguguucaaaucuguaagauuuauuagguaaacauucuguagcuugguggcgggauguucuggcuuucucauuagcagugacccuggguaguuuucacacauucagcaacauuuguuaggaacugcccaguguucuugucaccuaauggugaggcagagcccagcuuccaggugaggucaccuugugcacaucucccagaggguggggguugcuccauagggaaaacacagccuaaagucaguuucccuuuucuccucacuuuugagcucugcucugcuaggaccagggcccuagugcuuagacaaaaggaacaagacuauuuuucucauacuccgagccaucugagcaguggucucagauuuuaggugacuguuuauagucccagugccuguuggucuugggggugguucaaauucuaguuugucuucuagugcugucuucaaaggucuccauuuucuuaaauaaauuugagaauuaagugggaaugguggcaucaagaagccaguacucuccuuuugccccuguguagcuuuuaaucaguugugggauguggaggguguauuagcuugggucagaugugcuaaggaaaaaguggagguuugacuagagaauucaaagauuuccugggaaacaauaguggaaacaauuguuuuuguuauuuguuuuuuuuguuuguuuguuuaauauagaaucucacuauagcucugcuggcuuggaacucccagaagucuaccuuuucucucugugucccaaauacugggacaaaauguguucauuuugcagaacauuugacauuuuaauugauaaguugauuuaaccaauuuuagcugagaugacagucacgcucagcuaaauaaaucacauuaaaugagacuagaugaugccuuuguggggcuuauucaaaaagcagaccauuugaagauaguuuuggaguccagaacugggccagcuuguucacuuauguucauaaauuguaacugaguaaucucuuagcacuaaaccaaauaucagcauucauaucugaaaauucucauauuaguguggaaaaugaauuugauuucaugucugauaauucucuccaauuaaagagucaauggaacauuaucuuuaauguacucaaauuuuuauuaugguaaaacacacaauauaaaaaucaaguguaguucagaaguguuauguauacacauauuuuuaugaaacauacucauugacauuuuucaucuuguaacuaacugugaaauaguaacuuccauuucccuucucccagagucuggauaauaagugagcccuaccccucaccccucccuuuuuuuuccccauugccuuaagagaugcuuguagaguucacugcgagauaaaguacacaaucacaaaaccacuguacuagaaaaauaguauuuccuugcuguuaccaggucuccagugaguuuugcugugcgcaguaaucuuccuuuauuuacauccugcucuguuauaugguagccauauugacguguuuaagcuaacuuuaguuuucccucuuuaccaugauugugauuugcaaacuaugacuguuuccuugugguugggcuuuaaaagaacagaaugauucauuacccaugggaguguucaacaacacgucaggaagggagaaauuacugcuuauaugguucccuuuuuguauaacuuuuauaucuuucagacuccauagauuagacacauuggcucgaaagucuuauuucuuacucauugucaguuguuaaaucuuugagcauuaauuucucuuccaucacauauuuuaauuaugaaacuuuucauaugcaguacaugugcacauauguacaaugggcaugagaguuagggaauaauuuaucgggaauguguucuuuaagagaccuggagacugggacugguaaagcaauugccuauaaaugugggaggcuacaaguucaagagagacuugaauuaauacuaugcugcagucaauuuucuuugcccagcuacacagaauacuucuggcuguugucucacaucuggacuggaagcagaccaugugaguuauuuaaacaaugcaaacaugaggaauuuguaacagaguaugugaauacugaaagaguaaagaugaacccagugacauaaaaucguuuauacugacacgugugauacugguuggcuaugcuguuucucugacuuugaaguaaagcucauuauuuuagcucuacugguuauuguggagauuacagaauugguauguuuaaugugcuaaucacauagcaagcaccaaacaguucauuuugcuuuacaguaauuuuuaaaaauuuagaguaguguugguccuauauauugaaguagcuaggagaccagcaagaggaagaguaaaggcauggcugucauggucggugcugaugggggcaucggacauuuuaaaauacaauuucauugucuuguuaaggccugaucuggagaauugcaaaaacucuucucccagaucuuggugccaguccuauguucuucacaggacgaacaguuguggaguaagaagccccugguugugcuugcuuuccuccacucacaaguaacuguuguaggguuuuguuauuugugaacuuguuuacugaguacaaccaaugggaacaaaaggaucccaagcaggugcuguguagucaauuggagauucggugaaggacaggcuccucccaacagcauccuccacugaguucucguuaaggucccuucauacaaauaucaagaccguguugucuauaccugcugugacagcucacagucugugugugugugugugugugugugugagagagagagagagagagaaugagagagagagagugagagagagggagagagggagaaagagagagaagaagauucauagucucucucucuuucucucucuucaccugccaguuuuccuccauuguaguagugggcagccaaugaccagucuuucugacuauugccauguacacuguauaguaaaggaaggaaggugaucuucauuguguaacauuagaugggugccuggcgcagggcggcagagaacaggcugucuugguagauaaaauaugugguacuagacacagcagcuugauuuagaccuuggagggaugcaacuggccaagcagaaagucacugucuaaagugaggccuuucugccguguucuuacauaauuuagucuccugguuugaaaugcgcaagaauuuauugcacaaauuugacuggaacucuggcucaauugaagguuccucuggcaccagcuaaauaauagugucauauccagcaucauuuucgcuucuguguuguuccaggaagaaacuuuaauaauaauuauuauuuuuuaauauggugaagaaagggagauauucacaaagaggcauuucucuaacagaaugauacaguccucugaguaagcccagcccauccugcuguugguuauagagaaaaucauuuuccuauuguaagagauguauuuuuccccucuaguuccuuucuucucuuugagaacugugggagggccuguggcacaucgcugugcuggauggguuucaucuggcuuguagccugugccuuaaguaacaggguugucucuuccgagggcauuggcucuccauuuuuagcaugaguaugaaggguaaaaaauggaggaaaagauuucuccauuacuagaaaacaugauuugaggccaacugguuaauuaugagccuccaaugaagagaaguggggcuagucgggcauagccaguggugaaauagcuggucccugcugcugcuguguaguucgugaugcacuaccuccaagaccucuggguuagucugcacuuuuacuuuuuagauuuguauuauuuauuuacuuguuguuacuguuuugucaucuucuuucugguauugggcauuggacucaggcucuguguuugcuaggcaaggacucuaccacucagcuacauccagccaagcuuuugucuccaugggcuuucucuccucaccucuuucccuucugccuuuaaacucugguuuguuguuugugggcuuuuuacuguucuugccagugaaggaguuuccccuuucaacacugacucacgcuucugguucaucuacaaaauuccuagcuagguacaagagagucuucucagugaugcuaauuauuuuuuauuucucgucuguuccaucuguucaugugaacagcagaugaauuccuuucauuuagccaaacuucaugccuguuuucuguaucacugccuguuacucuucuagaacaaaggaaggacucuacaacccggcccugucuucuccuuuccuuacuuuccuuuacuguuugauugguggcagugcaguggaggucagacugagaucugguacaggauggcugugugcucugcuacugaggugcggcuuuagcucuuucuguuucuuguggugcuggagggccucugcuuguuucgcagacaugccagcacugcguuccacccagcuccccuucaucucacuucccagauaccacaacagacuuuugcauagacuuagucucaaauuuauaaggcuuuggacaacaauuuuucccuuucuuuuucuuuucuuuuccuuuucuuuauaauuguuaguuaauggucuguuuuuaguaauagcugagguaucucuagcucaucaguuaguucaucuuuccuugaacuguaaggauuucugauuccuuguagcuccuggcucuuuacaguuugucucugcgcccccccccaccuccccucaugauaaguaauaagaguucauuguguuaaacuuguaaagagacagaagauugccuuaaagauuuagccaagaggccauggugacaugugccugucucuauucccagaucuuagggugcagaggcaggaggauggcaagugcagggucaauuuagacuucauagcaacauucugucauuagaaaaaaggcuaaauuagagaagaacauauugauugcuuggauuuuauuucucacaauugugcauuguuauuucaagccuaggugcucugguaggaucauuaaauugccaguaguucuuagucagcuaauauacugugagagaggccuucuucaguggaucugcuaacuguguucuagagcugggugagaacucuucuuuguaacccacguggagauguacccauuucacuuaugcccauaaucacaauaaguacauuuugauuuuucagaaaucuuuccuguuuucucuucugacuguucacccuuggcacuuuuuuguuuguuuguuuuuuguuuuuugagacaggguuucucuguguagcccuggcuguccuggaacucacucuguagaccaggcuggccuugaacucagaaauccgccugccucugaccccccccccccccccaucccagugcugagauuaaaggcaugcgccaccacgccuggcuucccuuggcacuuucuaacauucccuugcuggacacuuuagaaaagcauuuuucuccuucacacuaaucuucccacgugagguguggcucguaagauaagaccuauaugaaguaauuaaauuauaguaauguagaaagugauuaaugcuguaauguuacuuuaucucuucugucucuugacauuagcucucuuguuaacacaagaugguauaaaacuuaacucaguuaaguagauuuuauuuucucguggaauuuguauuuuccagccugcucucugagcaugaacucaagaguucaauuaauuucaacugcuacguggguuuugccuuguuuucucugaaaaaccauuuaaaggcaaaaacugaggccaaucaccauguagacuaguaguagcuccuaccaugcucacugucaggagccagacuuccauuauuugauugguagcaaacagucugcuuacccagaucaucuggugccaggagauguuuaaagaauauuaccuguggauuaaggugccucauuucaccuuuggcuucuggauuacuaaccuugaaccuuguucucuuugaguaugcuguuccuuucugucuaguuacccugaauccucucuacuccucuggggaagcugccgccgccauuguuucucaucagagcaggguuuugugugugugugugugugugugugugugugugugugugugugugugugugucgggggguggggggggggaagguuuucgcccaguuuugugugggaagccacaccugugcagaaaggacagauggggcaagucuccgggacugucuucuuuugaaguuuccuucagugagucugggauccaccuuucuguuggcugcacuuucuuacuuggaauucuuggcuuccuguggcauuucggucugcaaggcacagcgcuguucuuuucuucuacucuuccaauuccugcaggagcuuuuucagugaggugagggaccccaugugcuuugcugcuugaauagugguuagggccuuagagccuucacacuguuuauucauaaagucuugccagggucgggguggggacuugucaggcucccauuauuuucuccccuccccacuuuucacucuguucuuucuccccuuucucacugcaucugagcaauaaauagcaggcacuucugaaaaggcucuuaguuggcuuauguaauugaguagaagagcagucucuugagagagauuuuuuuuucuuacaugauagucuugaaaaugguccuuuaauuuugggaugugccaguuccuguggacuauaauaaucaugugcugugcaccggagauaacgggucauucccuucaaggacacgaggcugccuucaguugcuggacuucacucacucuugguucuaugacgcuguucuccuggcagcuugccagcagacauuuguaacugggaccuuuuguagaauugccaccucccuugccuuuuuccugucaccaugguuaguggagggcugcuugcuccucucugcuaugguguggucaaguuggcuugcccuaucaugugcucagguucuacuuccagccuuagacuaguugcauuugagggauguuuggauacugugucuuccccucguacucgaguguuaccagcugucacuguccagaaggucacagaggaaugcauuccccggggcuuauuuaaccuacuuguuuauuuauacugaaacaucuuaucgucagucaggcaccucacuauggcuuuccugccuuucuaaacuuucugcuuacuuuugucuuuuguggcauugacuucuagacuaagcacaucuguguucuuucuuuacuucuccccaacauuuucaguuguggcuugugaaccuuuuuucuguuucuccccggaauauguaagagcaguauuagauuguaauuuaguacuuacccauaucugucugugccuuucuaguagacuuguuuauucuuaagguguguuuuaaaugggaaauauacauagagcuaguuaagaaauaaagcugacaccucucccuaccgccacagcaacuacuccugggcgugguuugagaaugcgcaguuugugcacacuccugcagaaauacuuagguauugcccauuuggccaagauggcuacaaggugaagcuuccccugugcugugcuaagcuuugugcuuagcagacacuuuuaauaaauaaauagaaaugugcugcucuguguguucaggacuacaaacuaguggauauccuuuuggauccugucuccuggcugccaagggaauugaaagguccuugauuguaaauaugcggagggcaugugauacuguuccuauuuuaagucuauaauucaaauggaaauugcagccuuuguuuauuaaaaugccauguaaggcagagcuacugggacugguccauuauuuacuguuugaaauuuuauacauuuaagucugagcaugucuguucuuauuuuaauucagcagucaguuuuaagaucaucacagaguauaauucugcuuggcuacauuaauuaauauauuauaguuuguuucauuuuuaagacaaaagucaaacuucuuauugacccuguuuaucucauagcacauuuuguaguuaaauaaucccucugcaucauggaaagccacaucuuugcugggcugucuuuucucccuuugugauagggaagaauauaauauaugcucugugaggggaauaacagccaguuagucugaugcacacaggaauaaaaggacaagacguggugaggaauggcugaaggcgaucaacuagguuuagugguaaucagcaccugccuucuguuuccagccugaacauuaucccacauuugcuucuuaauaucauauauuacauuuguguuuggaggugccuggaccugggagucaucauuaacccuguuugucuacugcccuuaucuuccucucuccugcaucgguaaccauuagccaugggucauaugugugugugugugugugugugugugugugugugugagagagagagagagagagagagagagagagagagagagagagagagagagauugguuuuuuuuguuguuuugcuuuguggcugacaugugucuaugaauagauaauauucuuuuuguuuauucuauauuguagaguuguacuaugucuuucuggaacuuucuucuucuguucaauauuauuuucaaauuuauuccaugguuauguuguccuaauucaaguuaauuguucuguauuccauuauacaacuacacuguacacaguguuaauauggacacuguaauacuugucuaccuuauguaagaauuuucuagguccgcgaguccauacuuaccuguaaguagcauucauuaauuagaggaaugugucaagcaaauaucagugcucagcacugugugagaguaacguuucauauuccuaacaguagguaaaggacauuccaauuuccccacauucuuaagucuuaaguauuuuugucagagugauuguuguaauguuacuguuaguaauauuauucuuuuuucuuaaacuuaccauucugaguuacuagugaaguaucuacacagagucugccuguucuuucaccuuuuuguuuguuuguuuuaauuugucaguuucuugccaugcaugaguuccaccacaccuuguguuccuccuccugacaaaacccugcaucuaacagauguugagcaguaauagggugcucuguguaaagccauuguucuauugguauauaaggguaguuacuuccucucuucugaugucacucaucuggucacugcuugacuaugucugucauuucucucaucugaaauuaaaaccuaaacuccugaaacccuauucgccuggcagcugugaccuuauuuuugacugguuuucagcaccuuucgaaggaauccuuuacgccuguuuucccuucacucauguuuuugcuuucuuccuagugucuuguauacuuauucuuagauugggcauagcugccuagaccaugcuuagcuggagagagaguuuggcccuucaggccugucuugcuuggcuaacugcaguacuuaauacagacgaucacccuucugcucagcuagucuucuaguguccucugcucugcucacggcugcuccuucucucuccuuaugcacugcacauucaguacucgucaucccagacagauaaccauggcccggacugugaacccagguaucaccucacacaguggcuuucacacuaacuaguaagccaguuuauacacagcccaguucccuaucuguguguccagcugccuggucagcuuuauguagaucuuagcagcugaagcuuucaagcucagcuucugcuugugcccucucuccauagucaaagcaguuaugguuucccuuuucuuugacgaucucugcucauucuuugcucaauuccaauucauccuugauucuuuccuuucuuugacauuuccuguuguguuugguaucugccuuugauacugcuaccgcccuuuuguaaucuaguaucauguucuaccuagaucgcuguauuaauuuacuaauuuaugucguuucacuuguuacaguggaaauccuccaucuaaagagcaggguaauguuacucacaucccuucaagaaguacugugugaggagcaguugggaaaugagcugccuuuccuaucgccucuguugcugccuucuguucuggggccuaguguccuuuaucuugucuugaaccaugaggcacacucauggcucacacuuagaucuccucagcugucuucagaugaccguuucuugaaucucuaagaagauguaacuugugugaagccugccacaagcacauuaugucagcgcccugcuuaagcuuccucugacuaacucuccacccucauuuucuuauugcccaguaauucuugccuuuaccccuuuccuuugcucugucuuuuugauagagaacuuuaaaggucuuacuagaacauacuuagccaccuuuucuuuauccccagauccauaauuugugucuguugaaccucaagaaguacuguacugucucagggucguuauaucuuauggcuacagcuuuucaggguagacuaggaaaagccugaaagcaaggauuugacaggaagucucuuuuugcucuucaaaagaucuuugacccaacacuucucaguuuugucuacuggccuaaaaugcuuccugucaaaaggccagcuguguccucauaugcugaguugugaguauugggcucucucuuaaggagagggacggaugacuguaguuaucucuuccggcuguaaugugagucauuacagggcccgcacgcagugucaguucucaggaggaacggugauuacagcccauauugguuuguguauuauccgcccaccagauaaagcaagcauucucuucuauuuuuauuuugaaaaaaauauuuccauguaaauuagaaucuaaacuagacaguuccuuuuagcagggacucaacugcucuccucuuccccagaauacauuccauaccucaauugccucuuuugagauuucaaaggcuuuuauggaccugguaauuuagaagaauugcuuuuauuuuguggcuucuuugggacuucuaaucucucucuuguaagauguuuguagaugucaauagcuccuggcucugaaggguuagaguagcaagaucacucacucuguguucacuuguacuuucuguuccuccuggcuucccgagagacacacagucagacucugaguuuguuguuauuugggugccugcugauacacuguccucacuucccaucuucugaggggauuucguaucaguccauccuggaaagagggucuucagauaguauucuuguuuacauaaccacacauacguguguaucauucuguguccuuacuuggcauacuucuggaaagguagcucuugccuuccauuuucaguauuagcguuucagucaacucucauuuucccauguaggguaugcagggaaggcugggaaauucagguguugugacauggcauaaaccuguguguggucagcaucauuguuuuguucaauuaauuuaaaacauuuuuguucacuacggcuucuguaaucaaacugcuacucuuuguaaauagauuuuucuuucuuguuuggugaguaugagucuauugguucuuuuuauuccugagggcugauucugauaaccauugauuuuuuugucuguauuaaaaauccuguucaacugggauguagcucagcaguagagggcuuuccuggcaugugccaggcuuuguuugguuuugagccuccuuaccgagaaacaaagcagaauccugccauuacuagcaacugaaaucugucagaaaguuuccugugccauagugacaucagauacucuuucuagauuguuucugguaucucuuacccuuggugcaaacauugacucagcacagaucaucuuggcaaaccaguaaguucacuggaauuacaagagugaaugggguucuuuauaggggcacggaugacucaaagcucaccacaccaugaagaagcccacccuagcaugagucguuacagcugauaggugucgggaggaagggcucuccuggccaggaauuguuuguguuuucuuuaaacuggggggaggggacgguugaguuuucuuagauucagcuucuauaacuaguaaggaugguuuacuucuacuuaacagugucuuaauguauguucccuugaucgcaccuagcuuccuggacauuuauaaaauaucuacauccauuuuuuucuuaauacccagcauuuuuguagacugugucacucucacuaugcaccuccaguuuggcucuucucuuguuccuguaguauuaccauguuuagcgacaugccucaacauacacaaugguucugauaucucaguaccuuguucugagcuuggauacccaugcucuuucugcuucauguaguagauuccuacaugugaucugugaaaagauguguuuucucuuccugggagaaugguggaacaauaauuccuuuuuuuuuuuuuuuuuuuuuuuuuuuuuuuuuuuuuuguuaauuucacagaggagguaaauggccaugaggggugaauguaaagcucagaaucccuuguuacgcaaagaauuguuuccauucccauaagcgaucuucuuggccauggcacugaauugaaaugccuuauuauguauuccguacaucacagcucagucagccuccgagaggaaacaccuacuucauuucccucuuccauaauauuggcuuuaggaagaguuuugaauguagcauuauaaugaugaagauuccuaacuugaaagcuguuuaagagaaaaaagaaguuacaaauaccuuccuuaaguguuacacagauuagacagacaucuuaauuugucagauagagaauauauggcaaagucaggacuaagccagcuagccauggaagauggaaaucacugacuuucauauaugauaggagguaguuucugcuuuucuccuccauauacuuuaccccagauacuauaugggucuuggagacccuuaacacacauucauguuccucuagcauacuuaaucaggguauaaucuaguaaggagguccuauagaguuagagucuuuguugauucagagcuuaugccucaugugaagucaucauaucagacucuccagauaugcucucuuucuuaaguaguugugucagacuguccggauccgcucuauuucuuaaggccauccucuauguuuucacuccccacaacagcaggcagcucugcacuuaguccugucaucgugacuuuggguuggauuucuauccuuuuauccucucuguccacuguguugucaaauucuguuaaugccuuuuuccaaaauguucucauagcucuuaaguuuuauccauuccuacuccugucuccuuccucaagacuuccuuauuauuugcagaggauggguauuugaagcaacuguggaggaggagucuaaggcacauagggugaugagccaacuuguggauguuaaaauauauuccuuucugucucuuguucugcuuuuucuaauucuaguuuucacacuaguuauuuucccugucaugcaaauacauuaaauacgauaugucagugaaacuuuuuuugaucacuucuuccuuuccauuucucugaauucuuagcacauuauuuuguauuuauucaaaacuacuuuguguugcuacuuuguaucuaggaucuugucuuuaauagauagguuuuugucuugagucuaggauguaugcauauuaggcuguguguguguguguguguguguguguauauauguauguauauauguauauauauaguuaauagcugguaggugcuuaauugagguuuugaaauuagauuuugugugcaugcgcguauacaugcauccagugggugccagugaauacugaauuucuuccauauugcuuguuuccaacuugggucacuccuuuugagcuugcuacuugaaaaagaaauucuucugccaauauaaagcauuucaaccaacuauuuaguaaccaguuauaagauaccuaguacauuugugaucuuaagagacagccaguuuuacauauguuccuuuguguuacuguacugccuauguuaauuuuuuucauuccuaauagcauauucuguuuugcuugcaggauaagaacaagaagcuccggccccuguaugacauccccuacauguuugaggcccgcgaauuucuucgaaaaaagcucauugggaagaagguaaaugaugagcauacauuagcauguguuuggacuuagucucaugcucuagaagugaugauuuucaauuggcucuucucuaggcgcuuuagcagcaaaguagaaucacuuugauaugaagagaggcaagucugugugucaggaagugguuuaauauuggggcccugucauuguuuucucggcagguuccaggcucuauuccagcuucacuaacugcauauugcccaugcuguauucaguuggcucuccuguucucuccagccaccuccauuuuaaguccagggccaugagacuuaguacugagggaaaguccgcugcuuuugugugcguuucuccuauuucuaaggaacaagaugacuacaggagagggaagucagauucuccucuguuaggaggaugcauagggaaaugcauuguauauggaugcuaccuagccuuuuuagacuuccaguagcuucugcuccagcuacugggacaauagggauuuuaucuggaaaccauuguguuaucuuuuuaggaucccagguaaagacugccuacugcuugguauguugacauugcagucugugggcucagagaccuagaguguaugucuuaauauuauuauuuauggcaauauucuacaaguguuaggaaacauuaaacaugccuuuauuuuucugacaucuuauuccaaaguucaggacgauuugugugaucuagauggauguucagagaacauaaauggggucgcuccuuuaaugccaccaaauguucaggaagggacugugaaucaugcuuuaguuugggauucuagaagaaauuucacauuaugaauugauuuuuauaugauaguaucuuacaaauccucuagcacuuuagaacaccauaauaguuuuugaauguuuaaauucuacccguguuauuuacucuuccccuacacugaugauguuuugacggguguaaguacagcucugggucucgauugguguacagugcacccauuucuacucacaaucaagaugaaguguguuucaagacggcuuuaaacaagcaguguagcaaaagaucuccugagaucuugccuccgucucccagguuuugggauuacaaacauuugcucccauaccaaaaaucuguagcuuuugaaucaaugucaaaauaauauauuauaaauauaggcacuugucuaugcauggugacucaugcccgcaguccuagcauuugagaugaugaggcagggaacucaagaauucaaggccagccucagcuacauagcaaagucaaggacagccuagcuacaugggaucccaucuuaaguaaacuguguaaguagcuuuauuauauuucauagcaguaugguaaaucauagcaagguacuuugaagauggauguaaauugaaaugucuaauuuuguguguguguguguguguguguguguguguguguguguguguuuaagauagccaaacuggauucccuaaaaugaguauuaaaucuccucagguuccuucagagaauaggcucauuugucacuguauaaaacuugacagagugcuauauucauucaugaaguguagugccagugauggcuuuaagucucuuucaauuuccugauccucuguuaucugguguaaugucuuaacaucucuaucuuacccacuugauaucacaucauucauucucugucucauaaacaguugcauauagacaaccaaagaauuccauggauuuugugggaaacccacacaguaauccagcacaaugacagcacauguuugauuugugugguagggucugugcauguauuauggcacccacuagucuccuaaguauugucuuguuauucugugucauuccuggacacacagaucacagcuuauugcagcagcugcugaauaguccugaagggcuagcuuuuuuuguuuaaagcagucuugaaacacacuucaucuugauugugaguagaaaugggugcacuguacaccaaucgagacccugcuagccagggcuauguucucaagaacuguauggcaggccacuguaaaguccucuaucauaggacagaaggacugaccucaagugucagaucugaugucaguucuuaagcaauuaggcuccuucuuaguuggagaagccucauuuacugguuccugugcaacagaguugauuagauucuguuugugcuuagaccaagcuuugucccccacagugacauuguauaaaugaugaauacuuuauccucucauagagagcuggaugcaucucagcucugcuaggcuggagcauuccugaugcaaaccacuuuccugacucaccaccugaaaccacuugccugucuucuaggccugucaguuacagcagucaacauccaugagugcuggcgucugggagcaggcagggcaguagcugccucagggguggcuagcacaucauugcacacuucugccaauucccugcagaccucugcagcuguucaucaugguacauggugauuaggagguacuguaaggagcaugugugccugugugcaugaaagcugauuagggcagccugucacagguuaaggaagauagggcuguaaaauccucuugccugccuccuucucagagagucagcacuaauggcaucuuuaagagaugucuagaauguggagaauuaagauggaaggugaaaugcugaaguguuuuauugguuuugauggccccucuuccauugugggcaucuacauugauuuaaauccauucacaucgcuuucccuuuggaugugggccaugcagcugcaguaaggauacugcuccuaacucuugcuuucaucauuuguacacuggcauuguauuugccucuccuuuccuagugcugugcuaugaacaaugcaaggugauaaagucuugcacguugguccagaugucaggaaugugugugcaagguuugguuuugcuuaauaagacuuauuuuuguuaagaaucugguggagcccugcucuuuuagauugauuucuggcccacuugauaucacaucagucauucucugucucauaaacaguugcauauagacaaccaaagaauuccauggauuuugugggaaacccacacaguaauccuccugucaagagaaaugaaucgguauacaacuggucucaugacuacauuguuuuucuguguguuuuguuguuguuguuucuauugacuuugguugaugugauaacugguaagcuguuggaucaggauguuagcuucucccaaacaagcaugcauuccguguuuuugagggcacgaaaaaaauguaucacagccuccuccuccugcccuguuuaucacuugccauccuuccacuaaaaucauaacuaacgaauauucaugauaaaugacuuucuuccugauuucuuccaagacuuaucaugaaauaaaaacuauaauuuuagcugucugcuuauuuguuuguuuaaagcuugccaggguguccaagauggugacuucuuaaaggauucauuguaacuguccacuacuaauagcagaaacugcucuccccacaucuuuccucccucccucccucccucccuguuuuccucccuccaugccugccugccugccugccuguguaguccccuucuaccuuuauccucgaagaacagcuuauauaaaauaggagcaugcacaucucgaucauuuguuuugggcagguaauguaacuggucuucauuggaaguucccuucaacuuucucuuaaaggcuguaauaugcugaguuccaguauuuucuuucuugucacacagcauuuacaagugacauaugaaucauuccuacaacucuugucccuuaauugcagaaugucuaucaccaugggaaccauuguguucauaguuggaacuuguuuaaauaauugagggucagaaugguggaggagcuagacuguaggaagccugaauucccggaugcacaccgcugcaguaggugcucacugcaggcuuccaagcaccagagaccucauuucuuuaaauaaaucuauggaugaaacucauuuguaaacuaaugggugacuuuguuucauuuuuaugccacugaaauuuguucugugaauuaacuuagcucuucaaauuaagcuccuuuuuucuggauucuugcagacauuuuagaauuaugggguuauaaauccuucauugaggguuauuucauuuccaaauuguuguaaguuguuuaauccuuuuaggaauccacuuuuccaaaaacauguacuuuugggaugcaaagcuggaaaaaaucucuacguguacccacucaggcuuacccagaacugaucuauugccuuguaucagucaugccaguggcuccuuccuaguuaucugggaauuaauuaucuuuuugugucaguccuuugucagugagacagaauuucuaauauaaguagcuuaaagagaggagcaguauauuuugacucauuacuucagagguuucauccaugaucacguuuggagacgauucaaacuauuuugcaaggauauacccagguuaaaugcauauacuaugccaaguuuuaauauuccugagcacguaugagcaaggagacaggacugcacauauuuaaauuagacccacuuccuuuucauguauuuguaacgugugauugauuggaucuguacguguggaucugaauuccccuuugcucuuguugcacuuacccacuuucaugcagugaacagagccuggacuucuuguagccuggacucugcagaccuuuuuguuuuucuuaauucuuuaaauuuuuuaaagugucauuuguuuuacacauaugaaccauuuggaauucugguaccuacagaggccaagagaggauaucagauugauaaccugacaccagagcuacagccauuugggagcuuccacauggcugcuuggaaccuaaccuggcuccuugcccagaacaucaguuguucuccuccuuucugcacccccccaccccuuccauguaaaguucaugaaugggguccucaucuauggcuucacaccaugcucugcuuuugccugaucauaucggcuucuguugguccugauggcuuugcuucuauugugccagcccgugugguccuggacagcuuucucagaggaaguugccccuccacagccaauccccuccuggcuccugugcugaaaugcauccuguuccaucccaucucgggauuugcuuucaguucauagugccuucuucuuuucuucauuucccucuuucuguuuacuuucuguuuguccuuuuaagauacagguuaaguuugacuuuaagaaaaucuuucuuuuuuuuuugguuuuucgagacaggguuucucucuguagcccuggcuguccuggcacucacuuuguagaccuggcuggccucgaacucauaaauccgccugcuucugccucccgagugcugggauuaaaggcgugcgccaccacgcccggcaagaaaaucuuucuuggcuuguccccauuucuuguacuuuaccauguacccguuucauaguuuacaguaauguaauagaaaccacauguggauagcugucucucuuaccaucuuugugggcgauagaguucggguaccccauaggugcucagucaauuuuuauuaagacacuucaaaggcacugaguuuaauuuguaaguguguacccaaaauaagaagauaagaaaauggaagagaggagguugaaguuagacucacuugacuaacuuaagucagccaaauaugcuuagccaaaaugguauccuccuuucgguaagcccaggacaucuagaaauagcuaaugcaauauucagugauaucuggguacuugugugugagcaaggcugaccacuugauuguuuuuagccuucuuccuacuacugaauaaauauuucaaauaucuaaacagguuuuaugaacaguuucaacuucaucauuugguaauuauuuuuguaugacucuuaaugcauucugccuuuuaaaagcauuuuauauggcucagguuuuuugcuuguuuguuuauuguuaugguauuuuguuguuguuuguguugagauaaagucucacuguguagccauggcuggacuggaaccaggcauuuagacaggcuguccuugagcucacagagauccuccuucaucagccuccaaagugguagaguucaaggcauauuccacccucucuguuaauguugaguuuuacugguuacagccacuguuacuugagcuuucuuuucuuagaaggcauugauuuuuuuuuuuuaaguauagaauagaguuuauucagggcauggggaggggaggguaguagagucccagagaaggagaaaguagagaaguagagguuggccaugagcacgaggagagaggggaaaggggauggggagagagggggagcaagguagcaaaaggcaagagagaggcaagaguggggcauugaauucucaagauuauuuuucauguuuuguuuuuaccuacauccugaaaauuauauauaauggucccauuuuuaaaguaaaaucccugaaaaccauaaaaauuacuuuaccuguaauuuuucacuuuaauuguaauguugaaguacagacccaucuagaagaaucugauucccagagucaauaagcuguuauacuuugggaacagugucaacguccccaaaacaugccuuuuacaugcuccaagaaguugaucuuaaucugccucauucuagucuacagcuuugaagaaguaguggcagcgccagguaucugccuuccgagugcuugcggcccuccagaugucaucagucucugcgauguccuugucagggcgccuuuuguucuucauagaacacacucauaucauacacucucuccacaauuaugcaggcaaggagcucgagccucaugguggaggugguggcaaaacuuuauuucucuuucucguuacuccuuuggcauagcugcagcagaaggugaggaggggugggucuagccaacacuaccaccaccaaacccaccuuugcccagacaggcgagggacuguagauacuuguuuccugaacaggaacagaucucuaaagguaccaggcauuguguaccaggaggggcuauuuuucuuucagccggggugaauuccucaggggcagagagucuuccugaggaaagggccucagccucucuggcuggcuaccagauuuggccccuuuguuagcuacucacugaagacuggcuggcuguucugaguguuagucagucagcugugcugaguaucagcaggcagccagcagggugggaauucuuguucugccucugauguguuuuaguuuggguuuuaaaaacauuucuuuugucaucuccacauuuuccacuucauguuacuuugauucauucauacuauggaaaaguccuuuauauuaaugaucagaacagucucuaagauuaugaaugcauugugauuuaaauugacagguuuauaugucguggcuguccuugccucccagugccagcuguuaccaucaguguggcuguaaauauuugaacaagugacuggagauacucuccagacgaagagggacuuugaaugacauaccuuuagaugucuuuuuuuagcaggaggcuuccuauugggcaugaugggauuuggacaauaugcaucagacaccuaugucuauguggaugugcuucccucucuaguguucagcagugauccuguuugucccugaagccauugacucccuuguuuggugacagaugguuagcaaaaauggccacugaguugccuguuucuggaagcucggcaagguagcuuucuucucauugccuccuaaaugcucuuuacaauuaagagcucuuguuuucgucuuuggucugcagauugugugcaguaccccuguggucuggggagcaucaguguguugagcugaguacacagcuccuuggugucaucuguuauuugugugauuuauauuguaauauccucuucuaaagcaucucuaaguuaaauuaagaaaccagaauuuucaaccacauuccuggcaguuucugugugcucaccuguggggaaugauuuauuaucuaugagaauccucaagacgcucuccucucuugcugauacuuuuguauuacucuggcuauuauugaagacuuucugccuuggauucccaagcuguccacaguuuucugguggaaguucucaccuuuguaacugguuugcaguggucuuuucucaagcuguccucuuccagucuuuaauguuagguuucuggaauguuguccuuggagcuggaacuuuccauacuuauuuucugcaaacugagauuuuauuuugggggagauuugugcugaaucagcucagcugugcuuggggguagggagagcacaggcccuucccccacuuuaaaaauaaccauuaugugccaaaaauccuauaaaaugugcugaauugcagaucuuccaacuuccuauaccuccgaauuuacagagaauagauccuuuugagcucaaguucacugauagugugcagaacaucucguguguuaaagggaguaagacagcccucaggccaggugugcauuuaagggaagaaaccugacuugucuuuucuugucuuuugauuuucuucccacaguuucauuugccuauaacugacucugcaggguauugauguguugacuaggguuuguuguuguuguuguuguugucuuuuuuuuuuauagaaguuguuggguuuguuagaagaacacauucagagauagugagccucauuuuagaacaccgacuuucugaagccucuuuuguuugugcucaucacugcuguggcucuacaguauuagccaucuauacauguaucagaggcuagaauguaaaagugucuuuugguuuugaggaugaaauucuguugauuccuuaccuguguccuagaagugauacuuuagugguaugucuauauaaauacaauuauacauuuguacauuuaaaacucugaauaguggauuuuugcuuuuuacuguaacacauucuuucauuaauaacuaagauagccuugcuuacuuuuacuccuaugguauauuuucucuggcacacaugcagguccuucccccuucaccccucuccuccccucucuucugugugugugucaguguacauggagguuagaggucauguauuguuacucaauugguuacucauuauuuuagaaauacagacucuuccugaacguggaacuuacccauuuggauagauuggcuggcccacaagucccagagauccaugucucucucugucuagcacugagauguacaggugcacacuacugagcccagcuuuuuaccugggaauugaggcucugaaaucaaaagcacuuuacugacugagccuccuccaugauauuucauaauguaugcauagugaaguuggugaguauccccaucuaucugccgucuuagaaugugaucugauaacauaguaucuuuugcagaaauaauugaauaaauuuaaauaaaaucacacugugguaaauggguuucaucauaggaaggagguggcuguauaaacaguggagguggacagagugauucuacaguaugagccccggggaggccaguggugguuagaaccucuagaagcuugggacccaaggaagggauacuccuuggaucuuucagcggggauaaugacugcuuaugccuuguuaccagcuugaagccuccagaauaccgagggagugcauaucuguuguuuucagccugccaguuuaugguguccuguuacagcugcucugggacuaagauagagggaaguauguuuguuucuugugucuggucagcucccuguugccugaugucugguuucuugauuuuuacuucaauaaugagauugauucucaccauaauucauggaguagagucuggucgucugcuaguaugguuuauccuuguaauuuguguuugugcuuugucauuccuucuagauaguaaggcuagccucccuccaagccaggggacaguuguagaucaauugauaggcuucuccacaucugucaguaggcucaaccuuagguuguggcuaucucccuuaaaggaugagugcugguucccaccacagaaggcuacauugccuuguggccaucugggucacacgaccuuccuccuugaucauuauuagcagcauuuugaaauagaacacugugggagaaaucauuauugccuaaaacuuuaucaguauuuuguauauuuauugugagccguauaugaacucuagcucuuccuuuugugcccauuggauuucagugguuugucuuugauugccucuuugugaagaugucugucuguccaucugucccucuguuacuuugcuuucucaccuuuucuggcuuaauagaugggcuggaaugagucaggcugggcuuaugagcauauaauguucugaaaauaauagguggcuuagucauucucuuuuaguuuguaagucuugacaucuguggucauguauacucaguuaaccagaucaaaagcagcauaacgaaaucaauuuauuguuauuguauagcugauacuuuucaguccuaaacucaggcauugggaacagagcaccuccucaugagcuaauauuuucaaagaggacaacacacuugcugcuuuccuucugggacaugaaauaaaaauaaauacgguaucuauuaaaacuuugcuaugaucucacugggcuaagacgaccucaacaugugcaaaauugaaugagggccaauuugaauaacuguuaagauaacagaaaaguggcccauggcaguacuugauacauauuaaugugaauugugcagaucacaguuauccaccacagguuggcgaggucuuaccugcugggugacgguauagacucuauuccuggguggccacacauacugcugacuaucuuaugacuguuuucacucuuacuggucugccugaagcccguuuccagcugcuggcuagugguuaccuaagcaccaauuccugcagccaacaggcaccuaucauguccaaaaugcagcucauggauuccauaugauguuuuuuacuaccuggaaguggcucugacuugguuguuggucuuucauaauguuacuacccuccaguguucccccagaucaguuuccuggccucuaagccaguuucucaguuacagacucaucugcuucugccuccuguagccuccuuccccugaaguucccagugagcaacucuaugucucuguguuccuagugcucgcuuuuuaauuauugcaacucugccuuaacucauuuuccugcaacagcccguaaugugccaucuuucacccuccugucacaguugcuuucucagugcacaauccugaugugccacccacucugguguuaccugauugccugccgaauagaaucuaacucucuuaagugaacauaaaagccugaguaggagcuguauauaaauuaccauaauuuuaaaugagccuguuuccauuucuaaucucccuuccuucccugcucucuguaaccucuccaaagcuugaccuuucacaaccucuugccuccacauucgauuuucuuugaagaaccucuccccauucugguacucccuguccucaugguaguccauguucacuuugccguuguaguuuccaggucugaccuggacagccagcaugggacaagcaucugucugaugccaagagucagguuuggguucuccugagucuccagggaggagauagcuccuggccugugaaggucuuuggaagaucgggagcaucuccacaagaaggguguauagagagcacgcagcuuaagcugggcaagggcuuucuugccagcuauguguccuuucuuugugcuucugaucauugugcucugauucauggauaccaugagccuugugaugacugacagcucuguaagccgaggguuuacagacaggcggaauaaaugucuucuccuguuuucuauuuaugcauugaguugauuaacuuagcccuccauuauuggcugcaagaugucugaagcuuaauguaguuaguacccuguucagcugacaugcugcagucagagacuugcuucacaguggugauuuuggguuauucuucucuucucuuuaaaauugagucugugcgguacuuuuuauuuguucuuccuaaaaauagcaaaagguuuugcucaaguaguacacgauaaguuaauuuuuuggcuugaauuccccauuauuauuuuauggcucuaagugacagaaguucaauagccccugaagaugcccugcuggcccaugcugggguucauaaugcuccaauccucucaucacaguccacacaaauuggaaauaaacaaauuagugacuugcuccacuugaccacuucauguaucaugggccuuuuugucugguugcuuguuucugagccgagccccuccuagcuugucugauguucacuggaguccugagagugucucguuagaaaccuauuguaccuuccaagccagauaaucucuggcuuauuuuuaauaagagcacaacagaaagggaaagggagaaacaagagaaagaagggagaccauuauagcagccuguguggccucggcuuugaucagaauggaagugagcauguuuggggagaucguccccugugcagcuagagaacugggauagucuuugcccuguguauuuccuguguauggcuguguguucaugaugccccuuucuucauuugcguggggccaugguucugauggcuucagcuccucagauggagucgugcagaccccagcuagcacaucuaaugcacaccuguguugcuguccacgcuguucucagcuacauuaaaaucaagagaaggggcauguuugugaccuugaggacagggaaagaaguaauuuuugcacuugggaagaauuaauuucuucacuuuuuccuuccuuuuuugagucuuuuuggccuugauuuagccauauagaugagcauuuuuaauuucuaaaacucaaaggaaucuugcuuuuguccucuaaaaauaugaucuuacuaaagaagccaagauuuaguuaauugucaagguguuucuaaucagagucuaauagcaaugacuuacaaauguggaguuuuccuagagugucucuggagagggccaucaugaggacucagauuccauuguuggacacuggucuuuccccauauccuuaaagcccuggaccagaguuccuacacacacgcacucacgcacgcacgcacacacucgcacgcgugcgagcgcgcgcacacacucgcacgcgugcgagcgcgcgcacacacacacacacacacacacacacacacggacucacacggacucacaugcacacgcacucacacccacaggcucacacccgcuaccucuuucaccccgagggcuuagcucgcacugaggagcuguuccuagacugccucagguucauuuguugcccuguuuuauguugauugauauucuugauuaauuugcaguucugaaaggcuaaucuuuuuggcuucagagaucuguuuuacuuaggugagugaauauaaguaccuaaugugaggagagcuugugccucacuucugagccuugugagccacagugaauccuugugcuggcccagaacccugauugguacagaucuuguuuauuaaugaugcugacuuuaaaccugacuucuauggaauuaaaugauuuugccuauccccaucccaacccgggcaguaaaccuggcuccugcaugcuaggcaagggaugugucauugagcuccacacccccaguccagcuguaacuucuguuauaucucaauccccccacuccugaaagcugucauugaacuccaucuuaccucuauucaugguacugacuuacgaucaaagaccaucucugaaguuuuuagaugguuauaauuagaaauuuagccucuuuucuuucucucuagaucuauguguccgaaucuuuuccccauauuugaggucuguucuuuguuucccuccauuuuucuguucacuaaauuuugaaauauggcucuaggaaucacaauccagccagaugauuuacuccuuaacuuuggccaggugcuuuugcgcauuuuucuccacuuucuccaguguggaguuugcuugccggcaggaauaugaagaaaagcagcacgcagugugaacuccacagcgugcaaggaucuuugaagaugaaagacaggaugagucauguugcugcuguucaguuuuucugauuuugugguaguuagccauagauuuccaaggagaaaauggaagcaaaaucgcugagucuagauggauuuauaaugucucucaucauuuagagacugaaagagauauugauagcagcaauuauccccuacuucauaaacauaagcuccuuccuuucuuucugucuuucugacauuauuuucucccucugcucuuuucucucccuccuuuucccuuugguuuucguuuuucauccccuuucucagcaauucuuagaccguugaugucagaaugcaagcugcgcucauuuccgguggguauugucucucugcuucagugccuggcuuaacuguuggaguggaucccugagaccuuccuggccuuagaagaaaacagugauuuguuaaaugucauuuuuucccucauuucuguucuuccuuccagcaccuugaaacuugguucacuaccaaaguggacagaguuguggucuuucucaaauuccaccuaguuugccuaauuguuccaguuccugcucaggcucaagucucucggaugaacccagaggucuuuaggcuagacagauaauauuaugguaucuuugagccucugucauaacugccauuuacuacucuugagggaagagagaggacauuugagcaaggggacggugugucagccauccucuuaguuugcccuccuggccauugagguucugguugcccugguuggucuagggugcccaugaccuugaauguacucaugcacaaagagaggcaggugcuugcuccuguuuaggugacccauggccucuuucagacucuaugugaaggggcccacagugcugcaggucuccccucacugggauggcuccuuuccuggcugcaugucgucauccuuguauagagccagcgcuccucgugggucaucuuucacugcuucccuguuuguuuccuucuuucuuucuauugcaaagaauuuuuuuguuuguuauuguuuuuguuuuuuacauugauaggauuuuuuuuguagccaccaaacauacuuuuuauaggacuuuuuauaauuuaauuuuuaaacagaauuuuuuuaaagguuguuuuauguaacguaucuuaaauucuuuacauuuuaaaaauagacagaggaagggagaaaaauggacugguaaaaagcauaugcauggaccaagcagugauucuuuuuguuucuaaagcuuuuuaaccucagauuaagacaagucugaauuuuguugguuuauugacuugaaacagacauccugauguuacuggcaagaaggccaguauggagauaggauuauccccaucuucaccucuacccccucacacagaugguaaauaaaacugacuagacauuuaauuuauucaucucaucauuuccagcuuuuaaguaggaaaauuguacuucuaggcugaacugugccuuuaucauuguugugaguggacaguacacuuccuucaaaggucacauaaagaguguuaggagaggcuuccccuucuccccugggcuuggccgucccugguccagagcguuccugagaagcagccacauugucaugccacauuggucuuccccgacauucucuagaccuccagcuaagcaugguugugggaaugagagcuauauucuacacaugugcuaguaccauaaauauaguuaaaugcagggacuguagaccaggaauagucuuugcauguguguuuccuuucuguguguauacaaacacuagaaccuuagccgguuuuguauucacaguucggggaaagcuugcugcuguccuauagagauuccauccuaauuuucucuauggcuaauuuucuacuugaaaaugcaguuaucaguugauuuuaacacugguacuguugucuacuauauccaugcuuaugauccuguuuuccgcuuucucacuuacugccuacuucaucagucacaaaacaacacuguugauuguaucggcuuauuauugucguuguuaaaacaagagaaaaagauacaggaaaagcuguguuucccagagguaucaucugcuaacauuugagugucuaucaguccaguguuuuuaugcacauggcucuuagcauaauguucacuucgacuaguaauuacaugcugcuuacugcuuuguaacccucaacaugaugauuucccuacgucgauaaguagucuucuacaugagauacuuuuaucauuuaauaccaagugaauguuuaaccaacauccugcugcuggccauuuguagugguuuagugguaggcauugaaccacauagacuugaguuugaaucccugaaguggcauuaccuaaccugggcugucauaagcauuaaaugacauaauauaugcuaaguacuuagugcgaugcucggcacaucuugacugcucaaucgauaucagcaaacuucugagucaggacuuaggaaaauuaagaacagaaagcaguauauaauaugacaaauaaaaugagcuuguucuaguuuauguccugauaaagacaaaaugaguaugagcgugagcaugcgcaugugugaugagcaguggggacagagaaagaugcauugaguacuuaggagggagauaaccuacaauccaagacugaaggugguuguuuguccuucagaaaggccuugcugccuaggagcugggcucuccugaaucccagaguaagaggaguggaccuggggaaggcagaguaggagagaacuuaaacaccccacucccugccuuccuugguuugcaggcauguuucacagccaggagaguucccaugggaacugacuucugaggacuguagccuaagggaagcugaagaaagggcaaaacgugccccuccuacuuguucuucugugccaaguuucucugaaagucuucagcuugaaauuaaggauuccauauccauugaccuuaaccgucuagucaucagugaggaagaaaugcuacaugccuuccugugugcuuucugcauggacccaacauuucgaaagagcuccccacauacccucaaucccucucucuccuacuuuaacauauuugcuuuuaaaugcaacacuguuaauugugaugaauucagguauugacaaaguuugaaauaguauuaugaagucaguuacuucuggucauacaggcaacauauuuuugcuuaauaucuuuugaugcuuugaguuaguaagcuguuaugguugauauuaauggaugauggcuauaguauagucaaggguuaagcagugaagaguuuauucugguauugaauacagagaauguuccaaguuaaacuggaauagaaaugcuacuuuauugagaaauguauguagucuguguaaggcagaaugguuaggaaaacacaaugcuguuuuauuacuguguucccccuuucccaugguuuuaccuuuaaauaaaaucacuuuuaaaauuaaguauuugccaaaauacuuaauugaaauaaaaugcccaguucuaacacacuuucaacagcagggucuuuuuuuuuuuaaaucucaaaaauuaacugccagauuguucuccucuccagugauuuccagccagcagucaggggcucguguucaagaaagcauugaagucacuuuguuuuguaagcauucaagcuaaauuccuugaaguagaugaaaucucucuauuuuuggagaaagaacacaaguuuagcaucagcucuggggguuucaucguggccgccugaaucuaugagcuuuuucuuugaagaccaaaccaguuuagguucaagacucacuuuaacauuuuccccagaauuaaauucugauuuacagagaauuucacugcucuaaacauuuuaucuuuccuucuuaucuuugguaaagguaguuagucuucuagaugcuaaaugcagcuucuuugcaacuuauacacaugcagguuuccucaagacagucauucuuuuccccagccuuguacacaugggggugagacuuuguuaaccugugugaaggacagaggucaacugaaugucauuuucaguggcaguccagcaugguuuuuuuuuuguggcagggucuuucaucaggacuugggauucacagauuauucuacauugguggcuagccagcaagcucuacacuuuuaaaguuuuguucuauuuuuauuuuauuuuuauuuguuuauuuauuuugguguuucuaggcagaguuuguauguagcccuggcuguccuggaacucaugcuguagaccaagcuggucucgaaauuauggagcgccaucugccucugucucacgggugcgggaauuaaaggcacauaccaccaccuccucaucuauuagugaguuucaaaugauaauugauaggcaauagggcugucauuuuuggcuguucucacuauuuuauuuuuuuaguucuugacucuaggaagcuuuacaaauaucuugaucuuucaauguaaauaacauugacuuaggucgcaggcaguauauuugccaaauguaggucaaauauuucugacauguuauauauaacuacagauguuuuggacaggcagugguggcacaagccuuuuauuccagcacuugggaggcagaggcaggcagauuucugaguuggaugccaaccuggucuacagaaugaguuccaggacagccagggcuacacagagaaacccugucccaaaagaaagaaaaaguaaaaguuuugcagguacaaaauaagaaaauagauacuucaugguggggaauggccgagcaauucaaagaacaguauugugugauguuuacuuagacguguuuauauaugacucagugccuaugaccgucuuauuuacaguacagugucugucuucccacacacuuaaacaaaauguuaaauauuuuaauggcuuugucaccauauucugauuacauaauuuauuuaaccaguauauacucaucuuaguuuguuucauaugauuuuauuuuaaauuguaauaaacagaauguuuauauauuauguaucagaaucauguguguucauuaaguagcacaaagucccagaccuguagagcugggaagguguaaggagggcacagggauugcacacuucuccuuuuaauccuguguguuuuaucucacaugaacagucaugcuucugugcuuucauaggguuugcuucuuauucugaacauuaguuuuauucauuuuuaucuuaaauuuuauguuaugcuuaaauuuuuaacuucauucuuuauuuuaaaacaagauagccacacaauauucccuuuuuuuuuuuuucuguguaacuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaucuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucaggaugaugcccuccagguccauccauuuggcugggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacugaugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccaccagaaguucuuuuauccuugagaagacuuuuugcuauccuagguuuuuuguuauuccagacaaauuugcaaauugcuccuuccaauucguugaagaauugaguuggaauuuugauagggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccuuugacuuguuugaguuuauuuuauauccagguacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcaaccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggggacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccuucuacuccucuugggugaauuugcuuccuuuuuuucuagggcuuuuagauguguugucaagcugcuaguaugugcugucuccuguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuuggugucuccaucuaugguaauugagaguuuggccggguauaguagccugggcuggcauuuguguucucuuagugucuguauaacaucuguccaggcucuucuggcuuucauagucucuggugaaaagucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagcucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcuguguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcucgaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcugucaagguagccuggggcucgagucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgaguggaagggacuugugccccagaucaggcccggguagccugcuucccuauguaccgcagucucgaguuccgcgcgauuggauuggggcaggcacugugauccacucaccagaggucuuagggucccguggggagucccguguggacccuugcggguguugggcaagacucugcuggcaagguagcccggggcucgaguccaauauucccuuuuaucuuaaauaauugucauguuuuguuuucuguagacaaaugagguauagauguuggaugcuaaguuugagagugaaccagggucgguaacaggaauuggauauuuuaaccccucucaccucuuucuggguuuuguugguuuacuuuguuggguguagagauggaaccugguauuucacuugugagaggcaggugcuucaccacugacugacugcagaccauuugcgcucauuguaacaacaguuucucagucacuccgacuugggaggacuuugggacauccuucuuagacuguaguucuauccggacaaauacuagaucugaguuauugaaaugauauuaguacucuucucuuuauuauagguucuuacuuuaccaauucagacuugauuuauucugauagguaggaaaucuacuuagaauuuuucuuuuggagcagucuagagucuuuucuaacucuguaguccccucuguaggagugugaacuugcuuuagguaguaaccaugaucacguuccuuugcauuuaaaauagacuauguuuauuucuuaaaaaugcagguagcacauuaagagaauaaacaauagaauuuuuauauaauugaauauuuaacaucuaaugcuuuuuaccauauagguauuuuuuuuuuguuucuuuuccauuauagacucuguucuuuaaaauuuuuaucuuuuguauugcugacaaccccccuuuucgucauuucuaugugaauuuuguaacuuuccaaaucccuaauagcuaugacuguuuuuacugcuguuauuaauguggcuuccuaauauuuuccaguccaguuauccuuaaguagcuaaagauuucacccagugcucaaaaagaagugugaugauaaaacaagaagcacaaaguccccacugcagaugcuaaguuauaguauauuguagaauuauucucuguggcucuuugccuuuccuguuuggaaauuauuagacaaauaccagcugauccuuuuagcuaucauucauuccaggucacauuggcucuagcaagccuacaaguuccuuuugaucauaagauacuuuucuagaccuuuuagcuucaaaauuaucauucaguauuaaacuguauagucaucaggauuaagcugaugccacuaaauaguucucauuucauuugauuuggugcaacauuucaauuuaugaccuacuaucucuguaaucacucauuaugcagauucuauuuuuaacuauaauuuuugauuuagucccacaaugccuaugcaucuugguuugucuuuuaugggagaaaauuaagagacaguacauaauagucuuuauuaaucuacuuuaggagauaauuaaucuacaauccagucauuuaaaauuuuauuuacuuuacuguuccauuucauuccuuaguaaacauauugaauuagcauuuuggucauuuucuuuuagcauauuggucauuuucuuuuucuaccagcaaguuuuacuacuguuuccugaacuuucuagcuguacuaaaaugugaacuuuaguugucugggcuuuagacaugucucuccauguuuuaccugaagguuuuaaguaaugauugcaguaaacuugugugugguugaagccauacuugcugauuuccugggauuguaguacuugugucuccucugaguucuuguguccagauguucuucuaguaacuuucuguaccuguugggagcuuuggcuuuguuuuucuucuccauagagcugugcccuauucuguggcaauucuguagugauggaauauuauuaaauaccaccaguaggugccugaaaagaugggucaguggacaagagcacuugcuguucuugcagaggaucuagguucaguuccgagcacccacauggugguuucuaaucucuuguaacuccaauuccacaggaaaaacauucauacacaugaaauaaaauaaaccuaaaaaauaauacuaucauuaguucucuacuugguauuuugacaccaguauauuaaauuuauagcuuaaaacuuucuuguucauaggauguuaauugaacucuuaggcuaaaauacagaguuuuaaaaagagacuuuuucuaauaucacaggcauagggcuggcaagaugacucagaggugcuuacugccaagccugaugaccugagcguaauccccaugcuacacaggguagaaaaagaaccuccuuccaaagccaucuucuagccugcagauguacaccuggaguucccaaacauacacacuaaucuaucagcuuuaaaaauuguuuauucuauguauauguguguuuuucucuguguauauuuguguuccauguaugugcucaguguccauggaugccagaagagagcauagaauccccuggggcaggaaccaccauguggauacugggaaucaaaccuugguccucugguagaacauacagcgcuccuaacaaauaagccucuugccuagcuguaggaacuuucaagauaacuuacuaagaacagcuguggauuguuucuguuuauccuuacagauggagagggagggagagagaauguaaaaaguuaaaacaaucaaucaaucaaucaaucaaucaauguaaaaaguuaaaacaaucaaucaaucaaucaaucaauaaauaaauaaauaaauaaaaucuuaaguuuucccacugugaacuccuagcaguaagugcagaagaggaauggaauuaauuaggaaugaccucaggacacaaauuguagugagauaccaugcucuauauaugcauaugguuucuagaagaccaagacagagaaugagaaucaaccugaaucagcugguucagugcaaguaugcacaaaguaauacagaaacccauggcuguugucucagacagacuuuccauuuuuauacccacaucaacuuacaugcuaucuacagugcacaucuaguuuaugguaaacaaauaacuguuguggaggagguuuccuuuccucugaagugauugauuucucauuauuuagagaaugacacucagccccucccacuacacacucacauacuuauggauuuggucaagguuaucugaaguuggcaaauuaggagauuaacuguuuacacgacuugauucuggugucuuaguuuuuguacauuauagguaguacuauguaugcagucuauuguucucuacugacucccaguguacccuucuuauaguggucaaaacaguguugacauaggcugucauuaguaaagugguucauaauauacuucuucuuucagugcaauuuacaguucacaccgucugccuaagaaagcacugacguucauuaacauauuacaguacaguuaaaacugguuuacuuguuuugauaaaaaaaaugaggcagaucuacaaaguaaugguuuccuuguuagauaaucagaauagugaaauccauagggacaguaacuaaauuggugauugccaagggcucagggaagcugcaguuggaaaggagugucuuaauggauacagggcuguuuuccuaauuugauaaauguauauuggaauuggcuaauggccaugguuauaaaguauuaaaaguauacuuauuuaagcugaugaauuuuauacuaucacuguuaugaauuuuaucuaaauuaaaagguaaaucugcuuguuagguggaguaauugcugaagaaacauuugguguuucuugguacuuauguuggcuggcauuuuauucaguguguuaaauaaugcauauagaagguauauaauagcaguuaagugugggcagggucuccucauuuagaagcagcaauguucaaacucauggaauguauuccuuucauuggccuuaucaguuguagacauaagggauuaggguggcaugcauagccaaucccagcaaucucuuauuugacucuaucuguuaccuaaacucuacugaaaaccucuuuuuaggacauacauacuaguuuguuggcacagaaguaauggacaguguguuuucagauuuuaucuuguauauuauaaaguuaggcuagaucuaauuaaaggagcacauugcaggccagcuugcugguauauaaccacacuuucccuauugugaucucuugccacauugugucuuccuccugagcaguuuuccaucgguuggcauuuuaugacucuugcugccucacccuuugcuugcuucuuuagaccaucccaaaaccaaaggggcucguuggcauggcucccguucucauguguugucuuagaguuuaagggugacggaggauguccaauucauggugggcgcagagguuucuuuucuuccuccuaaugaggaacaagaucacugggcagagcccuacagcccuacaagucucagcacuagaacuacagggagagcagcugacuucucugccacauacuguuguaucgcugugaauggucagugggcagagucguaucuuauaucccucugccccucuucucuaacugaagagcagcaaugacguauaacaagcaccaaccaauagcaucaaacugccagugaugggcaugccaaugcaguucccuguucccugacaaguagggaaaacauauggcaggcaggugguggcuacaggaccauuaucaacuggcagugagauuggcaguucacuugcagacagugaugcccaccugccaugguaacagcacaccacugggcgcccggaagcucuccucaucaccuccuuccacugagcagagaccauggccucaagugggaauugggaagauaaagguguucaacacugaagauccugguugugaguagguugcuguugguuuuacauuugaagguagauguuuucaucauauguguauuucaggcuccugcuguuaauuuaugaaaacauuacucuuauuuucucuuuaaagguuuuuuuuuuuuuuaacuuuccaacggaaagaaguacacuaauugcaacuuuagaaauaagaucuucucugccaagaauguucuuccagauucuauacauccuuuacuuuuguucccccaccuggaaucuuucucugaaucauugagcaguaacauuuuuaucugaacauuuucccaucuuagauuguguagauaucccuugcuuucagcagcuucaugguuucauugaagugcuaguaauacacuacuaagaagacagccugcaguucugccaacauggauuuuuggacucagcauguagcuaacacauuuauguuaagccacaucaguacaaaagggacauggcuuuuucaccagcugcuuuggucuguuagaaugaguuuucagaaguacacuugcucagccaaaggacauccuauguugaauguuaucagacuuguuaacaggaccucaauggaaaauacuuuuuggaggagcacaugaaagcauacguuuauuagacaaaagugcagauagaagcuauuagaugcaguggcugaauaaguagauagaaguguggaaauuacaaugggauacaagaaaauucuuaaggaaagaucuacagggagaggcuauucuucagaggaaaugugucaggguauacaacaucaaaaaauucacuacuuuagucaaagcuauguacccccuucuccaggugccacaugggaauaacgauccaguuugaguagauuccucagaaccccuaucuacuguguguucagaaaaugauuggcccuuuucagaaagugagaaaauaggcaaaggcagguuuauauccugggaacaguagacacauuuuaauaucuaguuccuuugaugucuuaaguuauuacacaugauuucuaauuaucaguugccuuugagaaccaucucuuucccugggaauauugaugcaacaagauauucaugaguuugucacacugaagccuagaucugccuggucucugacagcucgccauucauuuauugcugacccaugguccacauggauauuugagucuaaugguguuaaaagcuucgucuucagaaauauuuguaauguuaacuuuucaguguuggauucuucuggccaucauccauuuccagaacuugcucaguugagaaacugaaaccacacccauuaaacauccuucccuccaguccucccugccaugauccauucccuuuucugcuuuucugaacugaaguacucuuggcaccucacuuaaguggugacagucacuguccuuuuguauaucuucucugugacuaguuuguuuuuguuucccaugaagccuucacacuagcuccauguuguaacaugucaagaguuuugagcuugagugauauuccaugugccacauuuaguucaucaauucauccauugaugcacauuucucuguuccacauuuuggcuacugugacuauuuuuucagcaaauguggucauucagauucuuuguuaagacccuauuuuccaguuuuucaaauguauacccagaagugaauugauagauuggauagugagacuagauuuuugaggaaccuaagcaguguuuuuuuccuucauguaucugauaacuuagugauaagaacugggguggggggagagggagggguggcagaggccuggaagauucauuugucuauauaaagaaaugucuagaguuuauuuuauguaguucaaugguagaauaguacuuaccuagcauucuuauugcccugaguuugguccccagaaaggucaauuauuuugaaauguuuacuuagcuacauaaauaagaauaagauacagaaugaucuauuaauacaaagcaaccuauuaucagacuguauuuuguuccaaacaauuccuaaagaaugauuacaucuuucacugcaauucucuaaggugaugacacagcucuaugaggccaauucaccauuuucccauuggccuuuaguuaacuuccuugaaagcauuaacccuagucauaauggcuucuuuguaccagcucaugagcaugcuggaguguuuuguacuguggugaugcaggguaccuuuuccacacuggcucagcucagcauuccucccucccacagcagugagaugcuagugacauuguuggcugagugaauacuuugauuauucauuuauugccuaggcuuuucaaguugucuucauugugaguaggacacauuacaagucuucauaggcuagcuucguuagcagauguaacauguuuuacuucugcacaagccuuagucgccaucaucguugucauccuucaccuccuccaguaauucuuauaagcuauuaagcacaucugcuuucuuuaucuuccuucuagucaucuuuucucaguuuuaguacugacgucugggugacauuguaugcauuccccacaaaggcaaaggcauaaguagcucauguucuugugcugcuuauguggcuggaucuccuccagggagacuucuagacauugugauuuaauuuccccugacugcuggugaccuugggaauuuuagacacauaacuuugauuggcacuguauagaagagaaaaaagacccaccccaaguucugucccuggggaaaggaaugagaagcuauaguugugauaaggaauaagccugaacaugcaaggggcuacaggggacaguuuggggucuuucagucauuagagacaagcaguuugguauuaaaaguuauggguuggaguuuugacagugacauaauaaugaguuaauagaauaguaguacaaacaccaauuacacuccuuaauuauauuuguaggauuauaaagacugaaagaaacagaaguuuggggcuggagagaugguucagcaguuaagaacacuggcugcucuuccagaggaugaccuguguucauuccccagcacccacaugguagcucacaacugucuauaaccccugaucucagagaaucugacaccucauacaaacaugcauuagcgcaggcaaaauaccagggcacauaaaauaaaaauaaauccuuuaaaagggaagagucaaguuuagugacugugcuggcaucuguaaggauauuuugaaugaauggugauauauuuuucuaaaaucgucaaauuuaauuaaaauaauuuaaauuuuuaaagcccuguuucccuauugucuuuaugcaucuuuguuugcuucugugguuagugguacaguguaucuuuaggucauuuuaauuucaauuuguugucagcuagcuaucacugcuucagaaaucugcugauuucaaaugaccccucacauaaaaagugucacuguauauuuuugaaucaugaguuuguguaugcuucuaauuaaauauuuaucagccagcaaugauguccacuuagaugaauccuuagugucauuuagggacucuuggcaucuccuaugucucuguauaugcuauauguuaccuuuccucucaaagcagagaaaggcaucuaucugcccauguaaguugggauauauaugugcuugugguggauaagggauguugaagacuuguuuguuagaaaaacaucaaguaagaaagguauuugccucugggacuuuaaagguuuguaaguacuauagguuaccauuccauugaugaaaaugaaaugggcuuaaaaacagaucugugcgcaggaggugggagggugauuguagguggagcacagcauaggcacaggagaauaaacaaccaaccucagcaucuaauuacagugaugugcaaggagguguuccagaguacaguaggcugcauugcacugguagcccaggagacuggauugugucuuucaauuucuucaaguguagaugaagcaauagaauguauaaguuuuugugaaugccuguuauaaaggcuauuucaauuuaagagacauaaauauacaaaaaugacugaaugaaauaaaauaaguuucagcuuuaacaauuaaaacuuuaaaaaagccaaauaagucauacuuaaagauagcucauuuaaaaaaaauaauaucuccaaucaacagauaucuuaacuuaaauagcauuuuuuuaacaugauuuaacaagacuggucuccaccuaucuuagaauaaauuuuggaucuuaagguaaagaagacuagaguuguguuggccaauagugaguuaauuguaaaauuccagcuguggaauuagaaaacaucauugaaaauuacuuucaugagacuaccaaaccggagcggggcuuaaaacaaagacaggcugaagcccuggauuugauccccaguuccaccaaaaucacagccagaaacaggaaaacaaacaaacaaacaacaacaacaaaaugauugaacaggcauaucuuuuauauuuagaagacuagaagacagcccuuaugauucuuauacaaauguauucaaauaccagaaauagauuuuagaauuacagaaguaugugauauuucuguagucuagucagauuuuuuaaaaugaaagcaaagaauaaacauuuuuuuguuuuuuauauuauaaccuuucauacuuauuuucagaguuuucacaaggacucauaaaaucagaagauauuaaaaguucacaggggaaaauaaagggaggaaaugagauccaagagguaggaucaccuaaggguggaagaagaucuugacugggcccuggagagagagagcucagaggcuaagagcucuugcaaacuuguuaugucucacaugacagcucacaacugcuucuaacuccaguuugaggacgucugaugcccuccucuggccucaguaaaacuccugcaugcacaugguacauauaaacucacacaacaagcucagaucaaauaagucuuugugugcuacaaaaggcuaggaauauaguaccaagggacucaggccauuaccauauguggcuucaaagacuuagauggggcugucuaaauggagaugugcuauauauacaaaacauaccaaauauuaaagccuuuauacaaaaaaaaucucuuuuagcuguauauuaguauggugguaguuuguaaauuuugaguaaacuaaguaagauuacuacuguuccuacuagggcgaugugugcaugcccacguggcucucaggguuuacuuguuucuuucacauauugacaggaagcagguaaguuugucuugugaaguuguggggcuccauaggugaccauaugcgaaaggcucauuuugcuagguggucagcagagaugaugccuggaaacgggaccaggaggccuuaucaauaacaguuuguucugagcuuauuccauuccuagaugaacggaugacugaccuguuuuaaauuguuuuuuuauuaacuaugacuguauucagaaugaucacauaagguauuuuuuuuuuagcaagaaaggauuaaggaugcauaauuaauuuaaauagugaugaguaguauguauggaaggcccuacuaaauccaaagcaguuguacucauggucuuugauauuuauugucuuccucguuuaaaaagucaagaagcaccugcacagauuuuuuccaguuaaccuacuaacugagaugguucacagauucugcuucaauuaucuucaguaaauaaaauauucaguaacuaguaccugugaaauuaauccuuaaaacauuuaaauaaauacuaaauagugugucauucuuuaaaauaagcuccacuuaucucaaaguugggaugaauauguaugagguacacauucuuguuugcugggacuccuuaaggagaaaaguguguuuaauugagucugccugucuaaugauuucagaagucuaaugacuuaagucaacaugugucuuauuuaugcauauauguauguauagguguguuuguuuauuuccugcauaguuauuuaacacuuacucugugccaggcucuguucugagaaaaucaguaccuguuuauuuaaaaauaagcugcuuggaacuuaacucuugaguccugcccuguucuauucccuuaugcauacuaaugcuuuucuuccaagcagagaaagguggacacagagacacugagcgacugacucuccuaaguucacacagcugcucugggagguugggagcccugggugcacccuggcugugccacgaccuggcuuugcaagcucuccaguuuacucaccuuugugucuagucagagggucuugggcuuaggcccagaugacgccauccucugugugucuguaacuucugccaugagaacaggcacauagcagagcuuauuucuaaaggcagggcauugcagcuuccugugaauuuaugauucacuguguggacuaauaggugggauuaugugguaauuauacaaaauagcuucacauaacagcucuauuuauauuaaaaguaagccuacagugugaccuggaaauguuaugguaugcaguuguucuucuccuuaccucaucuuuaaugcuuggguacguuacauuuucucauuuaauuagcaucuaucuaguucuuuggcaauuugauguuuucuagucacuacuuaugugacgaauguccauagaugcucagagucuaaguguggucaaagugauuuuauuacacuaacugcuuucaggcuuuacaagaaacagaaauguaaaccgagguucucuaagguuuccugaaauugcucucaaagaaguuucuguaauguaguguccaaagauugguuagauugcuuucuauucuuucauagcuucaagaaacaaauuuuaugagaaauacuauaauguauaauuuucuuugucugucucucaugguaguuacuuuuuuuguuaaacuuuggaguuucaucacaauuuuaaaauacuuuuccucccucaggcuuccaucacccacaguugaaaucauucuucuuguuauauaaaacagcagauucgccaaguuuucagauuguccuuaaaacgcccaaccuucucauuucaaagauguccucugcaauguuaugccugaacauauuccuguuuacauacauucauucaugcaacaaauacuuacuguauuucagcugcaaguacgcugcucguucaaaagacauguucgucuguccccugguacuuucucucuuucuguuucaguuaauuaguacaagggagguauacauuacagagauuuaaaaacuuaggauauaacacaccauuuuuggcuagguuaucuuuuacaguuuuagagcuaaaugguacuguaaaaucauaaucuaguguucuuaguuuccauaugaagauguugcacacauguaaacucaauaucuauggaggagcaucugcaauuguuuuucuuuccaccuugucuuuagagaauagaucauuuacauuuuaucauuucauuaucagcagcaccuuaaacagaaggaaccacuuaccacaaauacaaaauuuaggucaccauuuauucagacagacauuacuaacauuuccugucauuuuaauugaaccugguuaaacuucagcuuuucagagugauuggcaggucagugaugaauaucuggagaugaaaaacuccaaggcaggggaacagaucugagaauucacaggagaggggcauaaaugcuaauuacacauugacuuuaauuccuggcuugccauaguagccugcagguguguaucuuggcugugggcuauucucagagcuucauuuguaucugagauuuucuuuaauaauguugccgccacgaagagcucuuuaaucucugacucauuugcaauucucuuucucuugauauaggaaauaauuaauugaaagaugaauguaguuguuauuucuucugguuauugcagauuaaagugugugggugggagauguguucccugggugcagcuccucuggcuggccuccugaccuggaagcacgaguguucguucacucugguuucuugucauuauuaccccacugcaaccacaaccccuguggaacuagagagaguguuccacagacuauuucuugguuuguagcugcuuucccaucccccgccccacucccugucugaggaacaagcuuggcauuggcaguacaagguaaaugagauucacauaguuuauuuuuaaucaguggugauuuuuuuuuccccuacugcuucaauuuguuggauggggcuugaacuuguuggauggguuuuucaaaauucagggauauguuugcuuugucauuuccauguauuuaaaaaauucuucuuauucuuugaaauauucauacaguguauucagaucauauucucaucucccuguuccuccuagagccugugcuucaccuucucuuuuccucuuaaauuucauaagcccaugaacucauuuuugcagccuucauguuaguggauauggagcauccacuggaauaggaguaacuuaucagaaaccacaccauuuaggaaaaggagcugccccuucccuagaaaucaucaguugaggugggucuaauggaccccuuucuguuccaugcuagaauuuagacuacguugaguuugugcaugucuugaguaggccaucagggcugcuaagaguugaugagugcaaccacccuugcacaucgaaaagacaguuuacuuaacuccuccauggcccuggcucuuaaaaucugccugcucccucuuuugugauggucccugauucuugggcaaaggcucugauaaagauuucccauuuguggcugaguaccucacaaucauuuguugauguaauuuauguaauuuggccaguucuguguugcuuuauuaagugcucuccauucacaaagaaacuucuuugaugagguuugagagcuucacagucuaugacccugagacaacuuuucuuccaugauauggccaacuuugguauuuaggugacauguugacccucuauauguuuuuugccauggcuuucuauacucuuauuauuuucuuagccucucauuuuaacugauugcuggaggccuuuucuggagaguuccagguaacuaaguacuauaguacuucucccuaguaacucagucccccguccucucuaugugcagcccucccaugcuuuguccugacucuguccuauaucagcugagaucagcuacaugccuggaaacuuaaaaccccugaaguauuuguuggcuaacccuccugucuguccauauuccuuguauguacauaaguugaaugcagacaccugauuuuaggggcuuuucuuauuacuagagauuuaccuagucucagcccuucugggccugcucucugauauggcuccuguuuuuugauuuggcagguucccaaauuuaaaaguaugaucagauuuguaaucugacaguugaaauuuuaagacaucugucucuuuauguauuuuuugaaauauauguguguguguauguguagguagaggucaucgucguaugucuuccucaguucuccuuauuuuugaagugguucucucuuugaaccuagagcucaccaguuuggguagacugacuggccugcaagccccagggaaccucuugucucuaccacccagugcugaguuuacaugcauguguuguuggccucuuuuucuuuuagauggggccagaggcagaacucauaucuuuauauguuugugggaagcacuucacuucugagacaucuccugagcccuuauuuguuuuguuuuuaaaacauuugugaaggacaauguaaaaguacuggaauggugcugaccagaaauguggccaaacuuccugcauuaugcugucguuaggcuggugcuaagaaccgauaaugugcuuagaaaaggcauucuggacucggaaauggcuucaugugcuugagucaggcuucgucuuuaguguaauugauaaagcuuggcccaaaccaaggcuacagauacgaccuguaaucuuuccuaauagauacucuguaauugguuuugacacauaaauaugcauauauuaaaccauuucauaaagaaauaguauuuuuccguauacccacacuuauuuauuguacaguauucucauuuaaugccugcagcuuccuguucguaugcauguccuuuguucguugaaaacuuaaagauucuccugcucucuucuguccuggcaugcccugaauucccccucaaacguuccugacuccaucuggguugcuauuagaccuaguuagcugugucacuuugauuuauacacugugaaaucagauccaagcaaccuugugauugccaucuuguucuucuugauaguucuucacuugguccagaagaaguuagggcagacuaaaaccgcgugcagucucucugaggaggcaaggcauauauuuggacacagguauuuugaugcagaaauggucuaagaaguauuuugccauaucaucugguggucucuaaagauuuauaccacccuugucaaucaaguggaauuuccuuagagcuuuucuuguucaaucaauugacuccuuugaguuaucaguguuuuucuugauuucuguuuugagggggugggcaguuguugagacagaauuucuccuuauagcucuggcuggcauuaacaagaaagagaucuaccugccucugccuucugagcacugggaugaaagguguggacccccacugcccagcuuaauuuccacuugaauauaaacuauucuuugacagugguuucagguuuauaccaaaauugaacagaauauauuggcuuucuaugcauucugugccccaaccucuaccuaugugcaaacaggagggauauuuccuaaaauugacccauguuagacagugggauccugcaguaggaggccuuugcagauggcauuuguggguuuucugugucuugucuauggcauggcacaucauuucugugccaaauaauguccaucaggauuugccaguuucuauuaaucuccagaugguuaguuaucaugguugccuaauuauugucagcuaugaacaaagcugcuguuaacuuccauguauagguuucuuuguggaaaaguuuucaacucucaaguaaauuucaaggacucauauuucgcuuagaauuuaugcuuaguuguuuaaggaacuacugaauuuuguuccaacauuugauacuguuguguuuuacauuuccagcaggugugaauaagaauucuucuguuccauauucuuuugaagccauugugugacuccugauuuagaguuugucuauacuauuaagcauauagucuuaugugugggggaacaauuuugcaaugcugcagauugaauagaaaaaucuuguacaugguagccaaguauuuuauuaguaaguccaguccucagcucauauuucauugcuaaaaauugcaauuaccuagacauuuugaguggacccucaaugccaauguuuucucaucaucuauauguugucuuugaguucgaguccuguggcauuucguaaucaaauuguccuuuugagcuucaagagcuuuuucuauauccugggugcuguccuuuauccaaugccuuuuggagaucuuucugcuauguauuaguuugccuuuuguuguuguuguuuuuaauccuagauccuuaaagcccaccugaguugaauguacaugugccauggcuacuagugagcugugauagacucccaaaccuaacucccuuaauucucucuuuccaggucaaugugacuguggacuacauuagaccagccagcccagccacagaaacggugccugccuuuuccgagcguaccugugccacugucaccauuggaggaaugugaguguuccaccuggcagcgucuuggcuuugguuuuaaauagcugaacacucugcucagucggccuccccugccccccaugcuugcucucucuuguccuuaacccaguggacuauaauuaugugccuguguagcacuguauuuguaaagcacuuuauaaucacucauuaguuaaucauauacuuccauuauuguuauuauuuaagauuauugggcucugugugcuuggcccuaugaaguacauuauuacuauuaauaaugcuauucauugaguaucaagcuguuccuagguauauccaaaacuaguuagagcuucuucguguuguuuuagaaaggugaguuuuagauacuuccucccauuaauaaauuggggaagaaaaaagagagagagguuagccggucuuuucuuuguauagagauagcauaguggcugugcccuagcuauauucuaaggucucuggauagccuggcugaugagcagaaucuuucaagggaggcaucugacacaggaaggaggaagccugcugggccaugcuuucacaauuaauauuaaagcaaucagucaguccccaguagcaacucuuacuuugcauaaaauauaucagcauggucauuguuucugucccuccguaacauucuuaagugcuguuuguuaccaaacugguauuuuucucuucuguuaagggaaggcaaagaauggggcuuucagcaaagcaggaaugaagcacugucuuacugauugagcgugcagugaagcuggguaggagaacugcgcacacaaucuggugguucaccauguagcuuccuccugucagacaggagccucuuucuccucaucgcugccuuugcauuuggaaaggacuauuuuuaggcaguucucaauguuaauguugcuaauguucacacagcgauuguagguuucauuucugggggacaaucucaguguaggcaauugaugucacuaccuucacaccagcagagcuuuuauaaggagccagcuucucacaggccagauaguaccuaguaauguggaaaacugggugauauuuuacucaucauucuguccaaauaucuuacaauaguuauugccaguuugucagcaauucuucaaagugagugaguggcucugcacugggaaaugauggugguuaguauuccccuauacuaaauugugacuggaagaagcaggacuugccuccauagauugcugcucuugcuuccuaauuacugggggaacaauuuacgucuauacaaacauaaucuuuauuuuuggcagauggucuucaccauuguguaacacuucaucagaguggauuaucucacuuacauaccaccaaaguagauuuuaaaauaacuuugcauugccuaaaaucagauauucggggacuggcuuuuugggauucuuaaauuuuuaggauaauccacguccgccaacuuuaaaguguuuucacacugggacaguuguggcuaugccugugacucagaccuccagguucaaguuugauuuaucacucccucaaacugggcaggucuuauuuagucuagcagaaguggacuggcuagguggacagagagggggcacuuccucagcauuucuguaguggcuguacuguuuuacaccaacagugcuagaaagugcucuucccggcgucugcagccuuuguggaauguuagucuucugaucaugacccuucugauuggguggagacaauaccucauuguccuuuuggcuuacauguuuugucuggucacuaguaauggugauuauguuuuaauauggucacuuguaugccuucauuugagaaauauuuauuucaguuauuugccuguuuugguucaaucaccugcuuuuugaccauucaauucugagucucuuauauauccuguacuugguguauccaggaagcagagacuugauacagucuugacauuagaaauuaccaauaccugccgggcggugguggugcacgccuuuaaucccagcacuugggaggcagaggcagucgaauuucugaguucgaggccagccuggucuacaaagugaguuccaggacagccagggcuauacagagaaacccugucucgaaaaacaaaacaaacaaacaaacaaacaaacaaaaaaaccaagaaauuaccaauaucuuugaagcuagcauucccuagcauuaccuguugucacucuggcauuggggaauuuugucucgucuacucuagucaaagcucaaguagccaucggaugauaguacaagaaauuuguugaauucuuuguuaacuguaauucagugaaggucucuuuaugaagcagacguagguguguuugaauguuucauuccuggaugauacaguuugguaguugguugguugguugguugguggucgggagaacacauguagagaucagaggacaacuucaggagucuguucuccuucaucuuggauuuuggagaucaaauccaggucuucaggcuugccaaggaaaggguuuuaggcuaaaccaucucuccacccacuuuggguuuguuucuauguacccagaaguaggaucuaaaaguuucccuccuuuccuuguucuagaagcuuggugauaaagguagguuuucccuagcagguggaccuccaggcuugcuuucugcauccuacaggaagggcuugguuuguucuucaucuuaguuuguguuuacuuuucuccuuuuaccccugaauuuucuuuaaauagaccucaaauaauauuguagaaaauugagucauuaauaaaauccaagcauuuagcuuauauucagaaauaaucuguauuaagaacccuuuaucugguuaaugcuuacuuauuuuaaaccacuguggagagaggaggauuuugccgacgcaaagauugucuuguaugugggugguagggcccgcaucugccacaguguuccuguggaggucagaggacaccucgaaggacuucccucuuuuugccauguaggcuccagggaucaaacuuagcgugucagacuuuagcagcuccuggacccauugagccaucuguauggcucauauuuucagaucucuaguacaugagagacacaggucccuuggugccccagugaacagcauaucugaaaugaggguucaaaaauacuagccaggugugguggcaugccuuuagucccagcacucgagaggcagaggcaggcggauuucugaguucgaggucagccuggucuacaaagugaguuccaggacagcccaggcuacacagagaaacccugucucaaaaaaacaaaacaaaacaaaacuaauagcugaacauuauaacucugaacucuuuuuuuuucuuuuucucuuauaguugugugccucacuuauuuucagccauuugaaagcugcuccucucuauuuagcuuuuaaggcaugugagguuuucauaaacauucccugaaugcuuauauuucacugcuuaacaugacauuuaaagaaacacauaaaaaaaaaacacaagcaguaaacucuugacuuagggacaaagcaaaugacugaacaaauucagugagguguucagguuugugcguguggcccucuauuauucucucaagcaccuucccuguauuugcuauggucacagguuguguggguaucuuaagggaaggguuaaauuguguggugagcauuucuuucuggaaggcaggcuuugcccugucuugucagugugugcuguguccugaagcagagagccaucuaaaucacucugcagucuuacaugccuccaugaggccugccccacaccucauggcucucacauuguucagacuccugaauggaggagcuccuuugaaguugaugauuccaggggaacaagaaaaaagaggcagaugagauggugucuugcaaagggcuacuucaaaggggacuuucagagguacugcacaugcaaaaugugugcucugucuguauucucaguagggcucaguggaacccuuaugguuuccucuugaucuuucuaugggagggaggugccucuagggcccuguagguccuugcuggugucaaccgggcuucagcuccucaugugccccucaagggaaucaaugcaaacaggguucaucauuccucuaauagauuaaauuuugauuaacuucacuaugggguuggcaagagcuguuaucuguuaaucaaaacaguuuaaauaaaaaauaaaaagagcaaaccugaguccuuucucacucucucacucccggguugggaauuagcugaucuuuuuaggccuaguuugugaugugaagcugucaagauggcgcugccugguaauuacuuuuuauuguauuuaagacacuuaaauaacucuucuugugauuuagucuucuauguaacuagcugcagugauuaaaaucucauucuuuccuucuugccagugcuuucuugaaaagugaguuuuucuggggugaccuuuccccgugcuggacuucccaauuacuuugagcuccaauuuggcaaauccauaaaaccgauuaacucauagcacauuuucugcauaucauauauucaaagaaaaguauuauaagaccauuuguucauguuuauauuaaaagacaccuaaaauuauagcaaggguuuagcuucauacaaacacacauugucuagcaccaucuccccaacuucaucccugcaaaucggucauauaucaagauacauuugucagccaagacauuuccccacuguuucucaguacauggcauauuuuaaacuggugggaaauguuggaggugagaaaugguuuacugauagaauuucaaaaacaaacaaugggaagaugcggcuucauccguuacaaucuugcuuuauaagagagaugguuugucuaacaguuuugcucuauguuucugugugucucugcaucccugccucacccuucguggccccuccauugccuauaucucucaucuuuuuuuuuuuuuuuuuaaagauuuauuuauugauuauauguaaguacacuguagcugucuucagacacucuagaagagggagucagaucuuguuggggaugguugugagccaccaugugguugcugggauuugaacucuggaccuucggaagagcagucgggugcucuuacccacugagccaucucgccagcccuauaucucucaucuugauaccaguguugaguguagggacuuggcauuguaggaucuguccacaauauguguguuuagggcuucugggugcgcucuuugcucugaguacugucuagcagaccugucuuugugaauucccuucugucuuuguggauucuucacagauagagcuugcuuuacuauccuauagucacaugagccagacuucugaacucgcaaggaaacgacugacuuuuugauuucucaggaacacuuuuguuccagcuguuccacugaagcauugagcuaagucuuuuuucacucugcuagaguaagccuuuuuuaauccaaguugauucuccccacuccugcaacccccucccccaucacaauaagaauaucauacagucuccagaguucuguagcuuugaagccuuccuugugagccaaucucccccucaguucuaaauccuaaacuacagcaguaccauuucucuuucaaccuacacauggaaagaaaguagccucuugugaaggugucuuuucugacugagccccaacucuaccugaauuuaaaagagaugcuuagaguauuuucuggaaggcguaaguugcucacaauacuugggaaaacagucgacucucuucucugauaacucaaggauagcaaucauuugaagagacuugucccacaggacaugacaguugaacagauucaagaccagagucuggaagauagugcugaguuucagacaaaucucacaguagcaauugaguagacugccugccuguggaggagucgcauacuuccugaguugauuuuuguuuuuuuguuuuguuuuguuuuguuuguuuuucgagacaggguuucucuauagcccuggcuguccuccaggacacuuuguagaccaggcuggccucgaacucagaaauccgccugccucugccuccugagugcugggauuaaaggccugaguugauuuuaaaacucuccuuuuuuuuuucccagagcagaacauggagagccugagagacaaugagucuuuguuucagaccaguaaguuaguccucagggaagacugucuuggaauauugauagaugcugguccaacaagggaggacuuaaggcuuaagaaccaugagacuuagguguuauucuuuaauuuuauguguauugguauuuugccugcaugcaugucuaggcaccacucuuuagcuuggugcccauggaguccugaagagggugucagaucccccuagauguaguauacagaugguuaugagucagugcaccaucuaggugccagaaauugaacccagaucuuauggaaaaccagcuuuaaccacugagccuucguuuuaaccccuuaauuauuuucauuuuuaagugugugacuauauuaggggguggcagggaauaugcacaccugggaguguagguguuuaugggguuuaagaggcuguuggaucccuuagagguagauuuaacaggcgcuaccagaugugcuugucaggaaccuagcucagguccugacaguacaagcuuguaacugcuaagcaaucucucuaguugcccuucucucuccccuccccucuuuucuuuguucuuucucuagaaaagagaaaaaacaguccugcauagcccaggcugacuucaaacuuaccguguaguagaggauguaaucuuuuuauuuuauuuuauuuuauuuuuuauuagauauuuucuucauuuacauuucaaaugcuauuccgaaaguccccuauacccucccccugcccuguuccccuacccacccacucccaguucuuggcccagguguuccccuguacuggggcauauaaaguuuacaagaccuaggggcuucucuucccaaugauggccaacuaggccaucuucuccuacauauguagcuagagacacaagcucugggaguacugguuaguucauauuguuguuccaccuauaggguugcagaccccuucagcuccuuggguacuuucucuaguuccuccauugagggcccuguguuuguaggauguauucuuaacucuucuuccugagccuaaguauagggcuucagaccuacuccaccugcuuuccuccuguauauuaucuagcuuuacaaugcuuaugaggagauuuucuucaagaaacagagguguuauuuauucgaggcauaaaaauguuaauuuuuaucuaguuuugccaggcuuuugcagagaccucauuuuaccauuugguaacagggugaauaauuauaggagaacuaauucuucugaguauuagcuaagucaggaacuuacugaaacacucaagugccacucagugacaccugcccaaucaugguccucguucauuccugguggaaaagcucugggaaugccauucaguuaccauuguuccugccagguugcucaggagccuccaggguaaccucuuugguagggccuagguguuaccuuucagauaguuuggcuuauaauguucaguugacuuuguucucaucaccguuacacugguguggucuuuauucuaaauggugagggaaauggcaaacucaaauuccuuuucuccauuuaaacacuuuuauuuucuucugugaucaugauauauagcauuuauugcauuucucuuuuguuauccuaauuguuuucuauaauuugcccauaaauuuauccuaaaaguuuaauuccgcaguaguuauaauauauaauugcauuagacauugggauucuauuagaucaaaaaacacgauagugauuaagcccauggcagagaaguguguguggcauagcauugugcauuggcucucccgacccucccuucugugccucauguucaguuacugcuuaucuccugcuuuccucccugguguauccuuuccccugggaaaacgguuuguuuguuuucaugugcugaaaagcaaacuuuauuaauuccuacauagucuaggacuaucuuuauaugggaugaacucuuaauuauucuaacuucaaaauagcugaauuuuaaaaagcuucuguguucuuugacaucuuaaaguuuuuacaauauuuuuauuuaaguuugguuuacugaaaugcuuuuaagucguuaccagguauauuuuugcccugcuacauacuuacuggucuguuuaaaagaacauucaucuuuaaaaguuuacuuuuuguuuuauuugguuuugagagauggccugcuauguaacuaagcugacuuugaacuuguccaccuuccucagacuccugagugcuagagaugcauguguucacagcaacacacuuggauuucaggagacgccuagaaacucagaucuuggauuauuuauucucccuguuuaacuccuucuguaaacuguauuugaccuuuugcuauggcuuucucuagagaccuuccuuuacauuucccuucaggauuggaagaugccucaacuacauccucgagcauccuuguuugcucagccaaucacacuaguugacuuauguucacuuuugugcuuagucauccaucauauuuguuuauucauuuaguuauccauaacuugacucuucauguauuuauagagugcuuguguauuuauuguauguacuguauaaugcaucauaacuauauugguaaaagcagaaauauuucaaaccucacaauauuuacacccuguucuauugauggagcucacuuuauuuugguugauguaucuuagcacuuuaauaucuauuuaaauguacuauuauagacccaucuuuccaguuuauaaacacaguuuuauuaucugugaguacuaccuaaaagaaugaacaccugcuucagcugugacugauuuguucccuuuuguugauuuuguuccuuuucuuuucaagucccuaauuguucuguguuccuugacuuauacuuacguaggcaggcagaugcucacugguugaaguccgaccguguucacugcauugucccagugcugcuucccagaggggaaagggagagguggccaggccgugucagaagcugccuucuguacaaggugcuucuccgaacaucagccccggagcagggaauuucagagcccaguaaaauugucuuggcagacagggcucuguuaggagcuuuagugcaccucacaggacagagaguggcuccauugugguguaccucgcucucccauccuuuuuguucaggccacagaagccaucugguaguuccaauguuacauuuccuacuagcuguauauaccacguguuucuuugggacaaacagccugcugauugauaauuuggagucuggcuuuguuaucaaguugaaagucacauucuuuuauagacuuuucucaaagacugaaaaugaaggcuaccuuucucgccuuuuaugagaguuguggaguauugaagacuuaaaaguuuggagcccuaaauugaggaacuuauaguuucaacuucuuuucauacuaggcauaagaacuuuaguagcuucuagucuucuguuguaugggugaccucuguaacaaaccuucaacgaaggcauaaaaucugugaaggugaauccuuuuaugugaaaacaauggacuaauggagaagacuaacccugugucauuuucuauaguuugauuaaaauggucuguuuccaaaacacccaucucuucaaaucucaucuagaaggagcaggagacaagagagccugcagaauucaaagcauucugcuaauagacauuuuguguucgauggcggauuuacuaauguacuuuuguaagucauagucuacaauacccauggccuuaaaugaaaaaucuucagcucuuccucaugagccuuauuauuuuaguguuuucugugagcaacauuuguuuuauggaucacacauucaacuauggaauagcggacaugccuauaauaacauaucugcuuauaaagguauuuguugaguuuuugccaaguagaccaaaccuuccuguucuugauaagucuguggauuucagggagacccaggagugcucccucugugcagcucuucuggauggcauuucugauugguggauuacugcugucuucagagccuccucagugugguccuuuguauuugcaguuuccugucuucuugguguuugugccauuucuccuccaguccuucccccucugcuucccaucuuuuagaaucuacguguguuucuugcugugguguugacaugcuuucuaccuguccauuuucuuuagagcuuuauuuuuucuggguugaucuuugcuuuauuuuguugggaccuuguaaaggacaaguuguggacaguuuucagucuagccauccugaccuccacaagcauuccuccuuuaucucuaugacuacugcaguugauguaauaaggaacuuguggcaugcuuaucacuaaccagaauaucuggauccuuuaacugcuguuuuucaaaccuuuucucuuuauaauuccugugguaagcauauuuaaaauguguuaagggauacaggaauagaguuuuuacagauuuuucuaucucccaguugugauagugccuaagagacuggcugcaguggucuuuuaaaaaguaauagaaggggcaaaguguccacacuuuggucuuccuucuucuugaguuucauguguuuugcaaauuguaucuuguaucuuggguauuccauggaaggaguuacagagacaaaguuuggagcugagacgaaaggauggaccaucuagagacugccauacccagggauccaucccauaaucagccuccaaacgcugacaucauugcauacacuaguaagauuuugcugaaaggacccugauauagcugucucuugugagacuaugccaggaccuagcaaacacagaaguggaugcucaccgucagcuauuggauggaucacagggcccccaauggaggagcuagagaaaguauccaaggagcuaaaggggucugcaacccuauagguggaacaacaauaugaacuaaccaguacccucagagcucgugucucuagcugcauauguaucagaagauggccuagucggucaucaguggaaagagaggcccauuggucaugcaaacuuuauaugcuucaguacaggggaacgccagggccaagaagugggaguggauggguaggggaguggggggaggguaugggggaauuuugggauagcauuggaaauguaaaugaggaaaauaccuauuaaaaaauauaaaaaaguaauagaaauuauagaaacauuuucagaaagguuaaaaaaaaagcgguuugauuucucucugucucucccaagcccaauaguagcacagaugagaaauuuggaucucugugggguuuuuuauucccauguagacuuuggagguaaacagacaugaagguaaaaaccucuauuuuaccuuuagauggcuguauaaucuugggucucaguuuauugucuguaaguuagagauauuaauggugcuauuauaaaaccacucuuauaaaugcgguaauguguucagcccagcacucucuccgcucagcagucacuggugaccuaagggcaucucuccucccagucacccccucacauuucuagccaaucccauuccucaguuauuccugauuuacagcaaauuuucuuccauauuuuaugugccauacuuuucuuguuucucacauuuacuuaugagcccagccacggauccuauucccuaacaaacaaaucagcacauguauuagcauauuccgugaacugaaugaucauugggagguagaaugcuucuuugccuacuauguuuagguccuguguucaaguccuacaccaccucccuuaauaucugccucccaaagaccaccaaacauguccuguuggauuauggucuagauuugacucucuguuugauaguaaagaacuuuguucacauagacaguaaugauugccaaguuauugcauaaauguagacaaguggacugugcuauucucagcauuucaggaaacuucacauaccauugcaauuuaaugacgccaggaaccgugcuggcuaccuucccuuugugcacuaggugccugccagcuaagaaguggcaaauguggaaggcuaucaguguaacgcgcugggcagacuggcauucucugucuugaagucuuuauaaauuuuucugccuccagugaaaaugaauuagaauauggagagauaagaaauagggagagauuuaguguaaacaugacuggcucagacauaaagguagaagcugagagcagugacaauaguggagaaguuugagccuaccuuuucagggcuuuucaguggauuuucuuuagagccuuuggccuccugauguaucugcuuacaaauaaauagagaaucagcaggcaguugcucuaauuugugcuuccuuuguguugaaauugugauuuaucaacucucagugucaagucaguagcaaggggagcauguaucaguucuccugccauccuccuccuccuuaaaaacaaguuucuuuuuuaaccaagaaguaacugugcugcgcccuacccugacacuguucaaaccuuccuucucugaaauauuuguguugucaugugucauuuagcacaaucugcagcuuuggaaacaucggaucaagagaagguuagccagagucuccuuaguggcuuauucuacuucaaagcauggagccaagucacuucucucucaaaggaaaggaaggacggaaugggguguuugaaaaccccuuaaccuuuuguugggcucgguugugguucacacuagaaagacaacucauuaaguaaaacagaaaauucuguucuucaauucuuaggaaaacccuuggccugauuccccacccauauuuucauuuccgaguauaguucaguuucccuggcucuuauuucuauaacucuuaauuauagaccuucuagacucuguauagaaguaaaaguuuacagaagcugccacccuuuaggccucaauaaaagguagaccuuggaauugguccaggugcuaauaaauucuggagagcaaaagcauacuccgccuuugcuugugccagcugacugggcugugaccaugaacuguaauggggcaagguggaaagucugccuuuuuucuagcaucuaaacaagacaaaaacuuaauuuaaguuuucucccugagaaucaaugugugccaaaacaauuuuguucuaucuuaucaaaaaugauugaguucaguagugcuuggugcuccugacagccuuccagaauccagauugucauuacaguccuuugcugugacagaagcaguguuugcacacgccaucaggaaugugagaggggcugggacugucccaucccuacuuuggacaucacagggucugccugguuccaguuucuucaucagaguugaucauuccagaugccauuguguaauuuuccaucuugggguauguguuugugugggugggugguuuuguuuguuuuuaagugguguuuaaugucaggcuaauaauaaacuggauacguaggccugguuuugucacagcggccaugaguuauuugucgcuguucuuuagagaggcugagaacuagccucccuuacuuccaaaugauguguacacauggggggggggggugcucuugucacuguagcugccuaggaacugcaguauggcagcuggcgaguucuguuguaaagaaguaaaagaugagggaucuucucccuuguugcuauacaacugauucucuacuuccuugcaaccugcauccggagugcaucacuauuucugaagcaauuaauggcauuuagucuguucccuaccuauacgucuuucucaagaucagguguacuagcaacucuaugauucuucagggagguggggcuuaaacuaugcucagucauucuuggccuuucaucuuuuuagaacuugaguauauuuuuaaaaaagauucugacuacuguuuuucacaaagcuuauuuugaaucccgugagauacuuggaaaaaaacaauagaccaugcccccaauuaaaaauaagugcuaaggcuuggaguuuuagaaauagugguuuuaugccuauggguucuugcuuuguagcucuggagcagagcuggcauuaagucuuuacuuggugauuucagugacagaggacgccuguagaugaaacagaaggcucccaaaccagcauuuuccuguccucacagaucaggccccagcagaguuguagguagcaagggaaauggaaacccuuacagauguucauucuaucacuccucauguguaagaacagccuuuuauggaucugguaauuucuccuauuccaacucuauuuagggguugagcugcuaugguuaguguaaacucugccuccagcucaagccaugauguugguaaguuuuguuuacucucuuuuugccaaguaccugguccuucuggaaagcagugucaugagacaauugguguucuguuucuuucauguauuucuucuuggccaucuaagacugacagaugggguauucacuucugcuguuuaggggguggaagaaccaguaacugagaagcaaauuuccaguugguuugagcaucuagccaugauuucuuugucuucuucccuuucccuuucccuuuuacccccucccucccuccucucucucucucucucucucucucucccucccucccucccucccuccuucccucccucccucucucucucucucucucucuuucuuucuuucuuucuuucuuaacagccauacucuuucacaguaaccauuuaaagugacuguccuaccugugaugggauuuacaagucuacccacaguccccgcccuucaugagcacacucagccuuuccuaagcagucacuuaucuucuagggauuucugguuugguuugguuugcuuguggauggguuucacuggcuggccuggaaucugucugccugucucugccucuggagcccuagaauuaaaggcacagucaccauucauguucuccucgugaauucuaucaauugccuccauaaucuauugucauuagcugccaacauggcccuaguuaagaugcuuuccugagagaguagugguguguuuucuggucaucaaauucagauuuaugaauuuaguuacuuauuuuggauagcaggagauaauuguaaaauuuccuccucaacagaaacucuuguaguuauuguucuuaaccucauucguugccacuguugauaauuagcucaaacugcaucccccaaucauaauuucagugucauuuaucuauguauuaguucaguaaacaccauuugugagcuuuacuccauuuuaacccggcaguaaaacagccaugaagaauaguuuguuguguucuauucgggauagacuggugugucagaaauuaauaauguguauuuuuugauaacuaaagcuugauuauuuggcagcuuuuaauccgaacuaauuuccuggaguagauuuacuauuuuauguugaugcccuucuagauacaacccaauuuauaauccugguugcuuucucucauggcuuucuauuugugaaaagguuuuuauccagccagcauacccagaacagauaggacaaacuaucuagggccuuaauguuaaauauuuugaguaccauuuaugguuauauaacacaagauuuuagaauuagauuugaucacuuggccuuagagagcccuucaaggagagauguaaucucauucuuaacuguuggcagaaaggauugucaagcauaccacagcuguccuucaguauccaaggaggauugauugcaggacccucuagacauccagauccacacacagucaguguuaacauauaaccuggaccuauaaucccauauacuugaucuucucuggacuguguauaauaccugacacaguuggacaccauguaaguaguuguuacauuucauuguuaagggcauaauggcagggaaugaagucuguguguacacuguagucaugauuccuuuuuucugaauaguuuggaauguugguuggauacauaggugugggagccacauauacagagggcuaaauguauucucaaauuuuauuuggauucuuuauauuaauagcauuuucaacaccuuacccagagcaucucugagaauaaauaacuguuuguaaaguggaaccuaacacuauaggugccguuuuguugggcugugauuuuuuuuuuuuaaaucccauuaagaaauuugguaggccggguagugguggcgcaugccuuuaaucccagcacuugggaggcagaggcagaggcagaggcagguggauuucugaguuccaggacagccagggcuauacagagaaacccugucucaacaaaaccaaaaaaaaagaaaggaaggaaggaagggagggagggagggagggagggagggagggagagagagagagagagagagagagagagagagagagagagagagagagaaagaaauuugguaacuugaaugcauaaacagauuaugucuaccacuugguguuagcuguggauucaaagauaguuugugacggucagcacauguuaguucccucccucacagccgugcuuagagcuuucuuugguuuuauucacuagguucugucucucucucucucucuccaucgugacucagaaagccuaccagugaagaauggcuucauuauagagucugcuaaaucaccagagucacauuguuacaaagcauaaugaaccuaaaccuguguuuccugggcauaaaguguugguggcccucagucucagaauuacaaaauuacuuuucugugagaaaagucaagggcaguaguaaaauuuggacaauuuucuagaacugccauaacacugucaaucuguuucuuggaaguucuuugcccagugauuugaggaugaugaguccucauuacugacagagcuucuuugcccacugucucuuccuccuauaauaacaaaauugccgugauagcuguccaaccuguuuuaagaagaucagguaauucaugucuaaauuggaacuugauucuuuuuaaucagccuuguaacauauuacagacaucacucucagcauuggcuacugaagugauuuaaugcuggcucuuuaaugacuccuucauuaauccugguauucugggauuuaacacucacuggccuuugaccacuggaaaugaugaaaacuuugauuucaugcauauuggauaacacuggacuguugcuggagccaugaaucuugccucugcaguggcgugugugauugacugugcugcggauggaugggugugcucccaggccgugcuccgcugcuaagagguguccaugauaucucuaucagcucagggugaccucuucccagaaccaucggauuugaaacaagaaucuguucugacagcuucauuuccuagacaguucucuggccuugugaagucagggcuugccucuucauccacucucugaaaggugccuucucugagaacaugcaccaugaugucugucuuugaaucccuuucaucaaguuuguagaauuuuacaguuaguagucacuuccaagacuguccuuuuuugugucuguugcccacccccugcuucacaccccucccuauacacagacaggagacaggaguccagcagcagauguaacacaaccaaagcaguguuaauaauaaugaaaauuaccagcaacaguagugauccccagcaccucccaggcuuccuaugugccgggcaggcucuaaauauagucauucauuuuucccucagagaagcuucaggagguagcauugcacagcaaguccgguguucuacacagcuucucucuggaucuccugcugcugcuaaaagcagagaugacaguguuaguugcucucuuuccuccuaauggaagcacugugaguguucuuuggaagagagguacaggguuauuuaccaugguaucuuuggccaaaguguuaauacugugaauaaaugccagguucuugcccccuccucauaaaauuauuccaggagaaaagaagucaccuuuauccugagaguguucauagagguugcuguauuucagagcacuucuucacuugcuuugaauacaugaaucagccugagacagccucagagguacuaugugaaggucacuugaagcauguucucccccaacucaguauaacagucauucucauggugugaccuccuaauuuuaagacuaguguuauggaaguaaccucuuaagagucaguuuaaagggcaguguuguaagauagagaggcuggcauacuuuuuccauaaaggaucaaaugguaaacauuuucugcuuugagagccauauggucucuccucaucucugccacagucagcacauagauccacagcauggcuguguccacuagacugugauuauagaggcaagcagugugcuugcaagccacuguucggggacuuacuuauggugaccauauaccuagacaucacuuuguagauagagaaauugaaagaaaaccgucucugacagugauauguauucuccaucacagaauuuacaugaauuauuauuauuacaggcauuuacaugaaugaaacugaaugcaguggcuugaauaaaaauuuacucauagacuagugaauuuuauaaggaaauauuuuucagauuaucaagaaacuucacccagguuuguuguuuguuuuaagcuagcacugcucgucaugcaagcacauuucauggcucucuuggcguggaagggagaggcugauuugaaccuuuccaggcuggccgccacccuccuauugauuauguucuccugguuccggggucccacaagacuguuucucuggguauucguuucuuuauucuuugucacuagcaccugguagugucuaugcagagcacuauaaacaggacguccucccucucggagucuuagugcucugcugccucucgcucccuuuuccuuaucccuuucuaagaucuuucuccuguucguuucucuugaaaauugacuuggcaguggcuugcuuuuuccuuuguugaauacuguugggaguuuugguaagauaccauaccucccuucacagugaguuuugcuggugugauagagaacauuucuucuuuauuuucagcauguucauuuuagcugcaucuggaauaacagcuuuaugcccaguccuaugucagacacauuagaaagguuucauuggaaaaguauuugauuuuccugcaagguacggaggagucaaucccagaccagcacaguaggaaaaccaauguugaugagguguggguggacaaccauguguauuuauuuaaugaaagggauuaagcaaucuguugugauaauuuugggaaaugugauagagaacagucaucuucaugcccguguucaauguacaggaaaugaauuugugccagaccaguagucagacaggagcucagugagccacagccacugugacuguacuguuuugucccgcugagggugcaugcgcuaagcuugaauucguggauuucucacuuguucacauguucugggcccuggcucuuucuaaguuuuaggacauuuuuccuccucucuauaaguaaggaauuugagaugggcccauacuggaaguguuuagguaaaugagggucagaccauucucuuaguguuucucuucaaagaaagaugccaaacugaugccaaaaacauuguugucaauccugagaaaugaauuucagagauaaaaugagaagcuggagcuggacacauuccaugugccuuuaauucaggauuuaauaauaauaauaauaauaauaauaauaauaauaauaaauaaauaaauuauuuggcuuuacauucuucaagggggcaguccugauccuacaguuuuuuuuuucccaacuaggguauuuugcccuagaguauuuugguuaguuagagugccacuuaacccucuuguguacucuccaucuucugcugcuuauuuuucuguacucagcuuaacacaccugcauuuuauuuccauuuguguguacuacucuuacuucaaggccaacaugcuuaauacuaaugcuuauucaagaagagucucaacucauuuauaucaccaaagucaccugugcagcucauaaaagcacacccagacaguggucugucagccagguuauacaauccucaugguugcugucuuuuccucccaaaugauucuuucccucucucugucagucaggggugugaugagcagguagcaaauggccugaggugcucucuggcugaaugcacagcaagcagaaccaaucgaugacuauuggcuuguacagggaauaguuccaggcaugcguuaccuaggcaaauucuuuccaauuuauuuggauugguagguugagguaugaacaguuuagauugauaaauugaguuagaaguauuuuuagauagagaauucuaaaagcuaugagcuugcccaugcuuauguuuggcugcacguaggaauagucugauccugcuauuuugaucagcagguucuuauagaaaacaaguuuuguuaugaagauacuucuaaguaagaggguuacuuauuuauguaauuaaguauuguguuacuaguucuuuucugucacuacucuauucugcacaguugacaaaucagaucaaaaugaacacauagucuucuagguuuguucuuggaaccauaagccuuucuaguuuuaacuauauaaugcugcuagguuaauuuuccauaaaugucuccaugaccaccuucaaggcguucguaauaauuccagucaaaccucuuaccaucacauauuccuucacuaucacagcgucaucuucuauuuuuuggagaaaauacagacugacaagaaccugucucaagcauccugccccaguaugacuucuucaugcuaauuuucuuaucuccauuuccuaccacucagacuuugcacucuuccuuuccgaucuguuuucuaccauuuguguuucuagaaucuagucuuuuccagggcuuggcaccauuaguaaucccauuuuauuuguccauuuaauuguuugucuugcuaaaacagguucccuagguagcucaggcuggccucucuacuuuaagucuccuuacuacugaauggccacuuccauuaaaagaguuaaagaacuguaucucuuguguccccuuugcucuuggcuccuuuggaugacaucuuucagcgguucuucccucagugaugccgcaauccuuacuuugacuugaccuccuggcaucucuauuuuucuuugaaaagaaggggggaaaaggaaaacuugucucuuguuuucaauaggccacuuuccugaguuguuucugcagcuuugauggccccuucucagacagcaguggugagcacuccuaaacagccauuuauuuauagaccuuucucauuccucuucuuacuccagccccaucucuaugaaucuucauccugucucaguuuccaauagauguugcagauuccauuauccauguuaacaaaguccucugauccuacuuccuacuggcauagucaacugcugccuagacugccuccuuuaggugcugaagcaguauaguuacaaaugagcuucaagaguccuucccuuccuuggaugacuuuauuccuacucauggugccaccauucagucacggauugagguguccucuuuguuuuuuccuuuauugugguccaucguuccauccagugcagcucagacacacuccaccuaccccucugugcuuccuuccuggaucugguugcuaccuggugagcuccagugacacaguccauucucucuccccaucuguguuaacaauauagcaauguagacuagccuuugguuucugguuuuauucuauuugauccauuuucucuugacuauuguaauuauuuuuugaaacaaaucugauuguuaucuuccuacuucaaugucuucauucaucauuccuccgcccuugggauuauacgaaucuaugaucuggcccaugccuaucuucauguuuauauuuaucauuucccuguucucauccaucauuucugggcaagcaaacaaagcagaccgagacucucuguuuuugaguugguauguugucugucuggagucuacaucccaccuaccugcuacuugcugaucauuccgcucacugcuaacuuaaauauugccugggcaucaugccaaaugaaacccagaacuggucaccugcugcacauucccagcaccccuugcuccccugugauagcccucauaacacucaaucacagguauccccgucucugauuauauacugcaugcucugcucuguaggucuuuggaguuaauaaaugcucagguacuuuccaugguuccccauggcuuaucucauauuccuagagucagcuacguuauaccugaaaugagggcaggcauugccuucuguggcaucauuucggacuuuagucugggacccuagaggugcuucagguuagucuccuugguauaauagaauagcagaauaugacugaaaagguaagcaccuuuucauagguuucucuaauuaaggccagaaucaaaaugugaaauuucuauuccuaaugugagccaauucaacuucaucuccauguccuccccaguguguaccguuuucuuauguaccacagcauaugacauaaucaucaauucaguucuuguuuuuuaguuuuguuuuaauuuugucgauuaucuaguacauuauguugccaggcuuaucuccuggcacuggaaauaaagcagugaauccaauucagagacuuuuuuuuuuuaaagcugacaauauuuccagugggaaagcauguaaagaaauaaugaaaacauauugauacuaaaaagugcuguggagaaaaaauaaagcuaagaaggguaaaagaggugucacaggauugggaagguaguuuuccauagccguccagagauggcucacugaugauaagacugggcugcuggcgacaacgcacaaaguguuaagaaggcaaacugguggcccaugucuuuaaucccagcacucaggaggcagaggcaggcggauuucugaguucaaggccagccuggucuacagagugaguuccaggacagccagggcuacacagagaaacccugucucaaaaacaaacaaaaagaaaagaaagaagaaggcggcggcaaacuaaacaccagcugcugugccuggagaccuggacaguaaaggcagauuuguggcuggggucagcgagcaaaguuaggguggugaaagaucguauugcugaaguagggaaagaagauagcagaaaacccaaauuuuauaugccacuaaagcuacuuggguggacuuuugacuugcaaugcuuuucuucuaauucuuuuaaguucaaauucuauugauguuuuaaaaaccugauuuguaguaauuacagauggauuuuaaaaagcauugagagcagucgcugugcauuccaugugcccuucacucauuuucugcuaguggcucuaucucauauaguacuaaaaauaggaauugggcauuaauauuuauauacuuacauuuauguuuuggugccauuuauuauacagugagguaaaagaagaaaauuauucagucaucauaaugaucucccuguguugccuccuguauucuuuccccucccaucauuccugacucuaguuuugcuucucaucuucauaacuuuaaggccuguauguaaaugaaacaguacauuagauaucaucuucuaagguaggccuuuucauuuaagguaaggcucuugaaauccgucuaagccauggcuggcauuaguaugauuuccuguucaccuuuucugaucuguauguaugauuuuaggauccgagacccaaauuguaguccagauugucacucaaguguguguguguguaugugugugugauugugugucuucauuucuguuuagccaaauaaaaggauagcgguugaacugccuauaucuguuuaguuaguaggaaacugauuuuuccuggcuauguuaaaguuguccugcuuguagucucuccuguugucccuaguguauuguggggcuagucaucacugcagaagcauugugugaugguucugggcacauacugcugcuacuuacaguuuucaauauaaaguaauaggccaaauugccaguugacaagcugugugaauaugaagcuugauuuucagcauccucagugcugagauauaaguaagcauccuaguuggcauaguacacagagcugguacaugaaugagggacagcugaacagaaugucagcuguucaagucagcucucccuuuucuaauccauuccuugaacacauuuuuguuaaugagcuugaaaugcagaugaaaaaaaggcccuuagccaagguaaaacugaguuaucacaaaaggaguccugaagucugagaaucuguuucccuagugagaaacaauauuuuaucccuuccccacgcgcucauuuucucuccucuuuauugugcuacagcguguuugggagauauagccuaucuuagcaaggagugcauauuaagacgugaugcuggggaucucaugacuuugcugggcauucuaaccuccacagcagauagggcccgcagcgucucuaaugggaggccuaaagggaaguuuuaauacuucuacaguauucuauaaccuauguuauguuaaauacccauugacacgaugcugucugguuauuuuugaauguuauugccaacuauuauaagauagcuacuugaauguauauuccaugacugcucaucaguaaguccuaguucauguggauaaaaagucaacaauaugugagguacaauguguuucauagacuuucucaucuuagggguguggaaaccugcacaagcuuaaacacccagagcuggaguaaguggguguaagcaccuccagaucucugugcuucacugauguccugauggcccuggaaggugccagguagggagccuaacaggcuucuggggaagacaagugucccugcuggguggcuucucuuuugucaggauaauaggccacuuuuauuccagaaauuccuguuucaccauaugcaacuguuucucuguguucucucuccaagugucuguauaagacugaccuuuaaaagaagucugccacacuguaaaaugucuuuaaggaaguugguuucuugcauggcuuuagaaaacaagugaaguagacaaagcugcaauccaauaucuuuucagugcccacggcuauggaacuguuuaacugguaaggcguguguggccugugauuuguuuauccauucugagugaguguaguugggguauaaauuguguuuguaaacuagcagcagaccuucacgcccuacccaguccuucuuauagacuccuguaaaugacccauugccuaaauagaguagcuuucuuuuuuaccuuguauguauuguacacauuaauacauuguucauggauguggcuacacuacacuuacacugcuuaccucugaguuggugucucuaagccgucugccuuucuuuguuucccauuugcuuuuccuuagcagaguggccgaagcuguuggguucuggggccguuaaugccccacauagcauuucacauuuagauggagagcacacaugagaaggacucaaguggcaagacaacacaaucccucuuucuucuccaagaaggcuaaagauuaagugcuguccagcuaccugcccuggaccauggcacugcaguaggaauuggggaucauuggagcagauacagcacuccuggcagaugucacuugccuuugucaucuuagaggaaagugugguccauguaccaugcuacuuaguuacuuggauaguugugcuaaggcagugguucugagccuuccuaaugcugugauccuuuaacucaguuccuuaugaugugcugacccccaaccauaaaauuauuuucauugcuacuccauaaugguaauuuugcugcuauuucgaaucauaauauaaaugucuguguuuuagugacacacacaccccuccuuccaaaggggucaagagcugcuguacuaaaccuugaaccuugaagucucauacuaggcaaacacccuacucuauagcucaaguagacugggaauaugucaucuuccugaaucagccccuugaguggcaaguaucugggaucauggccuuugccaccaggcuuggcaagaacuuuuguuuuaaacucuuacgaaugagucuucaugaugucagcgucuguuaaaucuauuaagaugauuuuggaugcaaagaacaguaacaauucugacuguacuaguaagggaguuauuagugugagagaauuauggaaagauagaacuaaguagccgggagcaacacaaugccaagagucaggaagcguuaguuaugguugcuuuaacuaguaguuuggccuaagcacccuuaccagcuucacuggauguugcugcaggggccagguaccauuguaaaauucuaacuguccugucaaccugucugugucagaaugacuuaucugccaggaaugagaacaucaguguccagugaugaugugcaugggauguggagcuuuacugcgucccauugagaccauggcugugagcuguguguaaggaacauggcauuugguagcuuucacacauuucuaugccauauuguacccaaguagucagaauccucuucguuuagugacuugucagagaauagugugguggucagcaaaagagugagccugcagucagacugaacaagcccagagcagucuacauggucaguaagagagagaaggcaagaauuuuuucccucaucugaaaguccacacucaucacacuacagcuuuucuucuuuuucuuuaaagcaaucucaguuccuaaugccuucugagcauuuaaguaaguguucuaucaguaaggugcacucucaaagucaacaaggugauguauugugaaauacuauuucucaaaggauagaagggcagagaaagagaugaagaaaauguugcucuguuuccagugaaugguucugcuuuauguuggaauauauguugaggggaaagggaagacauuggucauuuucaaaucauucauuucucaaauagguccacugaaucuccuuuguuggcagacaaaccauuuaguuaaaugucuaauguguauuuuagcaaguuuauuaguauuagaguggucaaacuuauaaucuaauaugaauagauuauuuuuaaugugcugauauauuuuuaauguauuaaaggcaucuuagauaauucaugagcacauuauauuuauuccuguuuuauagaaauuuuaaaggacagcaguauaagggaaauggucugagauucagagggcucuugggugccuguugugauggugucugucucuguuuucccuuaaacaucugcuuacaauuuaucucuggaucugucuucaucucuauauggaagcauuuagauuaguuuaucucugcggacucuuuuugcucaaaaauucugugacucagucaguuauuacuuuguuuucaucugacagcccacagaacccccugggaacucugugagaaaucaaucugcuagccaauaaauauuuauugaaugccuacuaagugugugacucuucauagaccaggagggaauacagucuagguguucaacaagauacacucagaaaggaagacgauaauacauagcgucaacagacaccugcuaauuuugugugccaccacagagcacaaugggugggugccaggucugggagcccccaggaagugcacugccugggugagcacaguaaagcuggaagggacuuccucaggcagggcuagagaggucuccagggcuagacuguacauaauauucuugcuuauugugugacacugcuuagugagaaagacacuagauucagaauggaaaaacuuggcuucugguugcagcucugccacuuacaguaggauaucaugcugcaaaucugaaaggauuuacucuuuggggaaacaaaaggcaugucugccucuguauugauaaaaagauuagguaagauauuguguguuaaaaugacaguccuuuaguagcccccacaaaugucugcuacagcuacaacagucuuucagugacuguaaguaagcugugccaucagacauugauagauuggguguuggaucaggcaaagucucugucauacuaaaaugcugccucucuauucccagccuuuugguuauaccaugacucuugcucauaagaggugccacaaguuucaugugcugaucaaaugagauaacuauuuuaaaguauuuaaaaaaggacucaguaaagaccagucuuccuagccucccuuaaucuuauauccuuucuccuuaucugucucuucacuguuccucuccccaucccccguugauguccucucacaccuccuuccccuccccaacaucauuucagacauaggaaguccaugcuugucucuauauugaaaccuuccaagcguguauucucuggugguagagcuggugcuggugacuggaagaaguaggacuauuuggcaucuaaguguuuuugaaaugauugagcuggcaguguuaaggaucagguaggggaugcuguauagaccauagaagacacaguggacgucucagcaagaguggggaggaagaauagagaaagaaagcauggagguuugaguccugccgggauguuguucugcaaucaacauggcuggccugugggacugcaggauggaggaggugauugguacaauucagcaaaauuuuuaaucuaggaaacugcauuuuauuuuugaaaugcugaguuuuaugugaggaugacucacacaaauucacauguccugcaaauaguuggaaaugugaaugcauggcauauuuagcuaugaguagaccaauuuggcuggguuggaagcacguguuuguuagaccaauuacuuuuuuuuuuuuuuaagcuagaucuaggggcuggugagauggcugaaccauuaagaacauuugcuacucuuccagaggauccccaguucuguuuccaccaccuacuucaagagguucacauaaaucugucucugugaucugagaccucugaccccugcaggcacccaccaucacaugcacauacccauccacaggcgcacacauguauguacacauaauaauuuuaaaagggcacauaucauaucuuuuccucuaguucuuuuuauuuuauuuuauuauuuauuuauuuauuuauucuugauuuuucaagacaggguuucucuguauagcccuggcuguccuggaacucacuuuguagaccaggcugaccucggacucagaaauccaccugccucugccucccaagugcugggauuaaaggcgugcgccaccaugcccggcauuugcucucguucuuuaugaggcaccuauugucuccauuucuuccauagaauaacuuugguggucacugucauauccucugucauagaagaagauucaaaccagcccaugcuuuguuauucuuuaguuuuauugugcuugacugggauaguuguagacuggggaagaaugcuaacuguuugaaggugggugguaucuguguuauugcuauuuauuuaauaugcuccuccuuccucaauagccucacuuccucaaguauuuggucaccuuggcaguacccugguauuuggaggggaagugucaucaugagcagaaugcuaguuauacucgucucauaaagccuuaaacaugauauugcugaauacuaagacuaucaaauaagagguggcaauaagauucuagcacugcagaaauccuggggcgaaguaaaauugucuguuuacugagcagaacuaucugauguuguguuuccucccuucuuuugcuaaagcauuuucagccauauuuucagaacuauacccuccacuagccagauguaugauguggcuuuagggguuucauucuauggcuuccagccauaguguuugacuccugcuuucccugucaguugcuccuucaggaaaucaacgaaaguaugccuagugcaguaauagaacauaaguggaccagguaucucugugguucauagaugcguuggcaggcgaaugugaaggaacaccuccucaguacccagcguuuaaaagccagggcccuggaccucuuugauuuuuccuguuuuuuuuucccccacccagucugaagaaugcuguuggaguugaguggagcauggccucugugucugggggcauugauuagugcucaaauguaaggcuaguuuugaaguguaaucaucauuaagugauugauaaagacauuuccguggcugugagcuagaucagguuaguggcugccuguguguaaggcagcgguggucauggaggccuuguccuccucuuuuccauccugcacuuccugccuucauucccaauguggccuacagucagacugagucuacucacaucggucugcaucccacucuuguugcuuaucuuucccuuucugggauccuuuccuuuugcuacgaugguuaaagagcagagaaaauacuagcucuuugaagaugggugcucucucauuacagcugcauuccaauuuuauuguucuuccuugcccagaugguuugcugcuuugcaagugugcucuucucuccccucucccacccccuggaacacaguaacacacauaaucguugcuucuaagaguuuuccuuuuuucuugauugguugguucacgucuuuuuguuguuuguuuguuuaacaauaaaccauuuauggccccaccucccccaguccucccuccauucuugagaugggcucucaguauguagcucuggcugaccaggagcauuagucccuuccugccucugucuccugagugcugcugguacaggaaugcaucucacaccuggccauaauaaugacauuuuaauuuuuagguuacaguguauguauacuuugauagcccuuggcagugaagacaagcucuuccucuaucgucucugcuggccucaaacuuagcauugccucagccuccaagugguuagaaacggggccgauaggcccaggaguuguaaucuauuacacuggccuguugauguguugagggguuugggaccaggcucuuuucugguggguugucacagaaccuccagugugcaugcuuugcugcaggccucgcucuaccuuaauucuacccuuaauaguuuaugauuucccuuccacuucaccugaccucaucacuaaagcugacgaggaacacagaaacauuaaaaucuucuaguuuguugucaguuuguauugugaaugcugagagagucaccuagcacugucaagauuuuuuuuuuuuuuuuuuugguuuuucgagacaggguuucucuguguagcccuggcuguccuggaacucacucuguagaccuugaacucagaaaucagccugccucugccucccaaauucugggauuaaaggcgugcaccaccacugccuggcucugaugauauuuguuaaaaagaaaagguuuagaaaucaauuugaaucaauuuuagaaccagcuaaguuuaagaggaaguuuuaaaagaagguagguaagauggagguagagaauuuagaaaaucuguagaagauauguauuuccaauuauugaugcuucagaaacaaauauccugugugcacgugcugcuggguuguaagagaagugcuuggcugucugggugggaaagggguagagcugggacccuuucagucaguagaaaccaggagaccaaagacaccguuauggaaaugugugaugugagucuugggaaaggugauccuauuagcuuuuaaaagcuauccuucgcuuagugggauuuuuuuccuucuuuugaggucuacucugguuagaaaauacucagaguaagguuuucuuccuggcccauugucucucucagucugucuugugcugaauuuuuguucuuacccuuuauagaugcauuuuuuuuccagcuuuaagaagccaagucugucaccagccugaagugcuggguuccugccucuaagaauaugagugcuagaggucuuagugggaacagaggaucuuuguggagccuccuuugaggaacugugagcauuaagcauuucgaaugguaucagaauuaaucuucauuaccaacccuguggaacuuaggguagccauggaaggacaucucuggcaauaucuaugaggaugcuucaguaagguuugacaucaggaaagaugcacgaauguggacagcacccuggcaugaaccuggggcugaauaaaauggagaaagcaagcugagcaucaucgcucucugcuuccugacuuuuggauguagugugaccagccaccucaccuuccugcugcuguggcuucccuaccacagaggccuauguguccucacauugucagccugaaguagcuguugucgguauuuucuccuagccucaagaaaaguagcugauauggaccaaaagcucacauucuccauauguuccgaagaaucuucugaucuauuuguugagucuuucauugaauuucuuuauugaaccuuugcuuucuuacugccucaacugaguugcaaagacagacauaagcucuagauucuguuguccaucagcuccacuguagcauuugucugaacagcugaugagaaagaaauugagccauuauaauagaguucugggccucuaggccagcgcugugagaaugcccacacuuaaagcaaaagcuuagccaguguacaaaaaggaaguagccgaacccuuccagcaucauacuguuguagccuuugggaaucauagcugcccauccuaagccuaugccucaaugucucacagaauacaaacauggaguguguguugucuguggcauuugaccuucaagucuugaaauuacaauaauauuuacaauaaaguuguauggugaguguguaaaugcauauauauauauauaucuauauacauauauauauauauauauauauauauauauauauauauauauacacacacauacacacacacacacacacucgagauacauuucuucccacagacaaggugacugcugaauauacugagcuuuuaauuaccauucaguccuucccuuuaaguuucauuaagauauauugcaaaaguauuucuuuggguuugcuuuauuuuaaauaugugcccacauguguuugccuuaaggaaaauauucuccuuuuguaaucuuccuaggcaccucaguggcugauaaaaugaagauggcucuuaaguggaaaauguuaagcucaaagggccuagauagaaaucugggcgccuggagcacugagcuaucuauuauccuuuucagauggagaguggcgggggugggccugcagaggugugagcuauuauuauuccccugccugcucuguagguccuuauccauuuagcccaguuucuauuuaucauguuacauauuuuaguuagcucuucuucuaggcaccaaaucauggaagucacauagugugugagugagagaaguauucucccuguugcauaugcaugagcuuugucuguauugauagccagacaucuaaaugcaucaugucuaaucaguuaagucaugaauuaacauucuugagaaacaggcuuuucauaauuuagcucugaaaaguuaguaugguuaguguuuguagacaaauggaaauaauuucaucugaagguacauagaacucuaaggaggcauaucugcucagagaauaguccaacuugagguaucaaggccccaggaggaggcuauagaacuugcacagggcagagucuguggcagaugcacacaucuaucuaggaauguggcucugaggcaacucaggaggaagugacagcagugauacagcuuggcucuggacaggcauguggauccugcagggaagcacacuaaggauaacccucuuccuuggauggagagaguuaaagguagggaagggagcaacacugugcaggacuuguguuacauccugcugguuuugguacagcuuccccaagaaggggaaauugaugcuuuuauuuacugguccuuuaaguuggaaaucuucgaucucuucuauaccuauuauccuuagguuuggucuucucauuguguccuggauuucuggauguuuuguguuaggagcuuguugcauuuugcaguuucuuugacuguugugucaauguuuucugugauaucugcugcaccugagguucucucuucuaucucuuggauuauguuggugaugcuugcaucugugacuucugaucucuuuccuagguuuucuaucuccaggguugucucccugugugauuucuuuauugauucuauuuucauuuuuagauccuugaugguuuuguucaauuccuucaccuauuuguuuguguuuuccugaaauucuuuaaggaauuuuuguguuuccucuuuaagggauucuguuuacauguguucucuuguauuucuccuuaaggggaguuauuuauguccuuuuuaaaguccucuaucaucaucaugcaaugugauuuuaaaucagagucuugauuuuccuguguguugggguauccagggcucgcuguggugggagaacucaauucugaugaugccaaguagccuugguuucuguugcuuauguucuugcccuugccucucaccaucugguuaucucugguguuagcuggucuugcugucucugacuguagcuugucccuccugcaagccugugugucagcaguccugggagaacaguucucuccaggagacauuaguguaacucaaggcuggcaccaugagaacccugauuuacagccaguugaugugucuguguacugauguagugauauuuuuguuaauaacuugauuuuucuuucuugugaauguaggaaaauuaccucauuuauaggaauuacacacuuaagaacugggagaugauaacaaaacaggucaggcacuuguucucagaugguucuucuuuguacaguaugugcaacuuuucuggaacacuguagacuugugaauuauacacauauauuauaaagcaauccaaacaauuguagccaauuaacuuacucauuaauauauuuuucuguuacuuucaauauuaagauguagggaggcaaugggaaagguagacaaaaauaugcuccaaugcuuagagucuuguguacuuaaaauacuacuuuuuaaauauuuuuauucucuuucaugggcuuaauggaccuuguucacauuuguagaaucugggaccugaugguuugaaauugucuuccagauggaacuugggcuugcuauaaccugcaugcaguguggauugaagugggugaggacgaugcccagaauuguagacacuucgaaaaaaaccugcaugugaccccaugccauucguuucuaugaauaucugacucugccuuaugacaauaguuuuuguuuaauagggagagcccuuaaugucuccuuuaguuuggaaaagcauuucaaucccaguauuaauucucuuucuagccaauucagagaaaggugauguaauguugagcauccaaggcuugguuaggucucuuuuuaugugcugauuaugaauuauccauuguaccagacauguaauugugguggaauuacugacacacucaagaaugcaauauaauguuauggaauaugcuuuaacguuuucucugauuagugcacucacauuagguucuaaaccaucuuuugccacaacaucuuccuagcccuuucuuagcagccaggagacugagacaguccaauacuagaacuagacuaauucuauuugugcucucuuccauuuguuuuuuccaguuguauuuucagaucauggaaaagagacaggagaagguagagagagcuuguaaaaccucuugucuuuuuuucuauucuaggcaaacuuugcuaagagaauccuuucagaauuccagcacuguuuacaaaaugauuaguucuucuuaugcuucaaagaguaucuucauuuucuggauguuuuaaaacuaacuuuaaaaacuagcuauaauuuuuuuacuuuaauuuuuuuaaaaaauucuaaauaugauaauuccaucagaaaaaaaaauuacucuccaucuuguacaaaggggugugcaagacagccaggaacccugcucacucagaucccaaagucaggacaguuaagcagugcguuaauaggugaacuguaauugcaugauguuucaucacuaagaggaaacacaugugacucucacaugccuggaauguaguaaguaaauacucaguaaugagacuguuaucauuucccgugucuuccucuccuguugcugagcacuggcaacugucccuucaggggacgucuguaacuaggaaaagaagcuaagagcugcagagcguuaggggaaggaaaagggugagcagaguguggagugaaucgggaauccgaggccucagaaagucuguggcaggcuuaaaucagucuguaaauguuugcugaugggacgaagagggcaaggauggcaaguagggaaggaugguggucucuguugcccuagcagguacgcaauaauucugggaauuaauuugagugcuguaauggaacugaaucguuuguacuguuuugcuuaguauucucuagauuuucauacugggucuuguucuuaggaaaauuuccuuacuugcucugccguuccaguuuucuccucuagaccucaugcauugacuguaaaaugucaaugcucaguaauucaaaaugcaguaacaaacauuucuuuauucuccuggcauuuaaaaucaccacgacaucucagccugucaaaaguggaguugucuugcaagccacucccagccuucuagcuugacagcucuucgguggguguagccacucuccugcccuaguaggguuccuuggugacaaccuuaguuaaaauccucaccaugaaucaacaucuacaucugcugauuugggacuguugcuuucucugugcugccaaacacaacucugugauaaugacagcauuugccagcacgcuuacgcagugacucaggagacaggguggccagcagagcagccuauuugugggaguggauuuuaagaagugcuaauuccauggcaguuuggagauauuaauaucgugcuggcaguagauaaacaggcagcagaggggcagauaauagaacagaaucagccacggcaucuuuccuccuuucuuaaacaccguauuuugugcugcuucuuugagaagucuguucuccuagguuuagauuaauagaauccuuacugguuuaaacagauacugcuuaggugagcugccagugaccucauacucuuacuugcugaggaucaccagugugcuaagaguuaacuacauuuucaagcaguacuaaaucacagcauauggcacaguagccuauugcuuacuguacccucucccuaaagggcagcaaaccagauggugugaguggggccuuugguguaauuauggcagacacagagaaagacaaccaccacucucccucaauaauaucauaucucuuccuuuccaaaaaugauauuguuaaauuuuuuucgguuggcuuugcauaucaaaguucucuuuccaggcugggaggaaccaugaaaagagcagcauuagucauuugaguacucuuccccauguacuuaggggggagucgggcacggucaaagagggugugucucauucuauagugggcauaguguguauaagaauaacuugaagggagauucucaucugaggccuguagucagucagaaugguguugaauauagucaguuggaccaguugaaaacugguuaccucugguuuuacuccuccuccuuuguuuguuccugguggguuuguuuugaaggggggcaggggauuuuuucccccuaccaaaaugacuuuuuucugccuuuccuucuccccaguucauuccuggcucuucuccaagcccacuuaaagugggaaaucuacuguguggagcuucgugagaagagaggcguguugaauauuguguuacaccaguguuuguaacgcuggaaguacaaauaggcaucuucuagcucucauauaggcugggaaggagccugagaaauuuaggucaugcuuuuaugugcucauuuuuuaucuugugugucuuuuuagagcagacuuuucuugaggguaguagcuuguuuauaacauucuguaaauagcccggccuaaugugggcuucuuacagauaguuucugcugguuguguguguggacugauguagcaucugaugcugcuaacaagaaaaaugcugaguuggggauuuuugucguuccagguuuuugguuuuuuguuuuguuuuguuuugauuccagcuuaacauccccagccucucccuccuccugccagaaagcauugugaccuccaggugcaaacaguugucauuucuguugacugagugccaucugaagccccaguguuaaccgaccuaccuccucuguugcagaaacauugcugaggcccucgucagcaaaggccuggccacagugaucagauaccggcaggaugacgaccagaggucuucacacuacgaugagcugcuagcugcagaggccagguacguugugaaacggcuaaaccuaaugggacacauaguaguacuuccuucugugucacuguugcaucucuaccugagcagaguagauuggaaauaauaugcagauuaagucuggaucauuuuucucuucagcuuucaccaguggacauccuuugaaguuucugccagaccgugauuaagcauacuuagccucccccaccccaaucagcagcacacagaauguggccacccuguguugacauuauacaaggaaagagccaugggugugagccuaucaugucugauaaccaugcacgaucgucgccaccauuccuggcacuacccgggaagccuggcuuaugugugcagugcauuuggcucugugccuugccuucagaggccucucccaccuuucccuccuuuucccuccuuucacauuuaucaccucuagaccuuuuguuguguucaaaggaaaugaaaacauuuauuaggaaaugaguuuugguugaaaacacuucugagagcuggcacgaaagcauuugagaagcccugugacauuuuccuuuuguccuucaucccuguggcugguuaccccgaguaaagcauaguggucagcuggguuucuugccauugacauccucccggcucauauucugagacuuugagcauuggugcugguaguccuggaguuuuccaaauucuugggaagcuguaagaacugacuaauucugaacugaugcucaacaguccauguagacccacagaauaucuccauuggaucagagugauugcugucuuuguggccauuaggaccuguuaguucuagaaguuuggucauugugagauugugcauuccauuagagaaggcuugaguugggcacguaguaccuaauuuugguuucauaucuugacacagacaucauuucucuuacucuuuggcucugagcauugcuguaauauccaacauguaccuguaauacuacaucauauccugauugauagagcaccuaucgaaugucacacauaaugucaguggagaggacagccuaucagguucuuuccuauggguuuuucucaguuguccuaucuaggaauggguuguuucagaccuuugauauaaugcuuauuaguauccauuaaaaaacaaggcccccaggccuauuauuucagcacaugguagguugacugaggcaagagaaucuugaguuccagccuaggcuuaacagcaacuuccaggccagacuuggcuauaaguagacucugucucaaauaacaguaauacaguaacgaugugauauagauuuaaaauagguaguuaugaaagagagauggccuucucuuccuucugguguuauauggagacagugagcucaaaucccccaugaugggaaaauguggauacacuuuucuuaacaccuuacagguugcccuccaggaaacaacuucaccaguugauggaauucguggggugggccuaugggcagcuuggucauucugauuugaugcaauuugaagaacaaguaaagcauucagugucaggaucacacagcagagcaguggaauguauaaccccugucuccaggucuggguccaucauaacuacacagaaacacuucauuuuaacaggcaggugugcauggacauaaucugcuaaagagcucaggaaaagaaugcccgaguugguuuuuauuacauuguuagaaauaggcauaguaugaagauugucaugaguguuguuuaaugaguaugcauauauaaagaaaucuggagaagauuugggguuuagggaagaaaacaagccucuuuagugcagauuuugugcugaagaaauggaacaauaugcuugcuugcuaaaguagugaguugccuugcccagagauaauugugguaagccauugcuuuuagacugaugguggaaaaauuggcuucuggguccuugaacuguugcuaguaaauggagagaaaugaaccacuucgccagggccaggaggcaugcccgaaggcaauacaggcccgguaaaggauuaugaggaacagccaagaugagcuagaguaggguuuccuuuggagccccauugucagugaucccugggauaauagcccaaggcuaacuccuagaugcuagccccuagucaggugaagugagaguuaagagagaccaggauuccugcuagguaguaauggugguuuuauagcuauuugaaaagauuucucauguagagaaggcuuguuuugcaaauaaucaagccagucucuguccccaucuauguaccugcuggcucuguuuucuuuuaguuugccuacaguucauccucugucguccuugcacagcuugucuugugcaugcugucucuguccugcauccugccugucuauugaauaugacccagguuuagagcuguuucccccgauggaccagcuuuacacuuccacagcaguugcacucugcugugugauuuggugcccaguuuguuagguuucuucaccucccagcuuaauguccucugcggauuucauuagugaguuguuuacuccuuuucugggacaugaauagaaccccuuaacaagaaaggcuuugguguugaccccaagucucucacaacauggacugucuuuuguuuaucauuccuucagccacuuuuuaaucuucaaugauuguguacugaaccaagccaauuugaauuaauuucccaaggaaauuuucuugagcuacuauagcuaaggcuuuagcaaaggccagauuaguaacaucugcugcaucccugccagucacucaugcugaagcuccucaggucuguacaggcugugcuugugauuagucucucccuacaauggugucauugccaccgaugucccagccccugaccuugguuaccugcuuuucucugcuuaucgcugcuccaaucgccaguggcacaguugugcucuuccauugacucugcuuuccagugcacugcuuggccauuaauccuuuuagagaaacguuguaagcuuugguaaaagggcagccuguuaacuugucugacuucuugggucagcacagcugccugccuaggaguugaugagcuuucucuuagcucugcagcuccuacaggcuggguuaucugauaggaguggagauacuuaggcacucccugggugucccagcaagaggaggggcaaggauggaugcuccucugcagucagccagccaucacucgccugaguggaacaagagaacuuugauuucucuucaguuugcuggcccuuugaggaaccuuuauuuagcugccugucugcuuaugggcaacccccauaaaaccucaaaugccugggcuaucuagagaaagccacaacucuuuguuuaaagacuaaauaagccuguuaauuccccaaaggcagccuuccuuucuagcucagguguccgucaucagccaccuccucccccaguaccuuguguccuggcaagauaagguuuggcauuuccuaggguucucucaggccuugucccugggcuccauugaaaagcccaugauuuuuguucuagggucugacagauccaaguugcuuguccuuggaauuuuuuacaaaaagaauuuaggugaaccugaccugugguucacugugacauccugaauuuuaucccacccccacccccccaugggcccuuaggaagcagcccauaucaguucuuaucugcaugguucaaauguuuaguccucagguugguuugcuuugcuagucuggaggagacguuagccagaacaucugacuccuggaggagaugacccuuaccugcuuuugaaguauuuccaagucccuuccucaacauauuuuuuuaucugaaaaugcuauaaaaugucacauauucuagccccuauauuugcuauaauucauccaguuugauuuuagaaaggccaacauggaauuuuaaucccagugguagacuccacuacuaugggcuuuucuuguuaaccuuguaacgcuucagacucccgauggcagccagaagucagccugcuuucgucuguagaaugcugguuauggaugugggccaccacaccuaccuucccaauggguuuuuguugaacuuguuacuuacauugaaguaauaucuggagucugagcaaagccuggcuagugcccugcuuccuuuggucuguacaaacggggaaugauauugauguguguucucuguccuguagcuauccaacucuuuguuuagaacuauaauauuauaaacuguaaaauaccuguagucccagcaguugacuguauuaagcagggggaauaggaguucaaagccaggcuggucuacauaagacccuagcuuacaaaaaaaauaacaacaaaagacaaagcucucucuuuuuguuaaaugucccacuauggaguccuggcugacuuggaacucauuguguagcccaaacugguuucaaauucaugcacaugugcccgcuucugucuuugagaugcugggacugaaggugugcacuacuauacauggcuuacaauguaccguuuuaauuauuucuggaaucucuuagaauuuguagcuuauugcagaaaaccacagaagugcgggcuuuuuacucauuuaaggcacuuuuucaucucagcuuuugugauuucaggauaggauuuauauacuggaaaaaaagaaauugaugccccagccugacugugggaaacauuuguacugaguagucuagcaccugagcagauuuaaaugaguuuagauucauucuggacaugaaaugaaguuaguguuaucucuagagaaaagggcaggcaucucuucccuuuucauguuuauucugucucuuuguggcacacugcaagcuuggaaaacuggugcuuuccuuagucucugagacgcaagcacaaaccugcccucuucucugcguugcauagcucccccaagaacucauuuuucugauugagcaaacucucucuuuagaacaccaaaaaacaagugcuccugccuugcugaguucuguaucuccagucuccaaaccccacaggcaucagccucacuuuuuuuuuaguaugauuggcaguacuuccauugucggcuucucuacccgaaacucuaggaaacuguacuagcauuucuaugagagucugaucaauggcuauaugcuuguugaugacucuuguugauuuugcuaagccaauaucagugggcauuauuagaauggauacagcucucaucaggugacuccugaguugggggucauguuggucuugccaguauccacgcauugguagcuaucacuuaguagaugcauauuucaaaucuucugaaguguuuucggggccacugggagagaaaugcccuuguucuacacaugcucagucagagcugcucuccugguguucuuacucaucaggauguuuucuguaaacucucaaggaauagggaaaacaaaaagaaaagaaauggugacgccuuccaugcugaaucuucaguuguccuggcauccauuugcuggauucaugaacagaauaggaggacgaaccuuucggcucagaaaaugagcccgugucuaguaugcacaccaugaccaaaagcagguugaagaggaaaggcuuuauugggcuuacacuuccaggucaucauccaucauuagaggaagucaggacaggaacucaagucaggaccaguccucagcagcauaaaaccagauaaaacagcauaaaaccagauaaaacaaugacucagagguuuuuuuguuugguugguugguugguugguuuuuuugguuuuucugagacaggguuucucugaguagccuccgcuguccugggucucacucuguagaccaggcuggucucgaucucagaaaucugccugccucugccucccaaguacaaggauuaaaggcgugcgccaccaugccuggcaacucagaggguuaaacucuugcugggccacccugaagaccugaauugcguacuuggaacccaaauuuuaaaagccugaugugauggagauaucuguaaucccaucucuccugcuuagaugggagaugggagauggaaacaggggaaucacccaaaagcccacaggccguggagccuggaguaugcagcuacgccacacaaaaauagcaaauacccugccacaacagagcaaagaagcaaauuccccaagggcuggccucugaucccuccccacccccacccccaccccaccccacuccaccccacacacaauguaaauaagcaguagcaauguagcacauuaugacuuaguaaaugaaagaagucaguguacuuguaugacauauuuccaacuuguuggaagaucuuaaacagaaaaagcagcaaguuucaucacuguauacuguggaauuaaaauguguguucccugcaaauauuuguguacuuuggaaugagucaggacugcuauguuguaucacaaguugcuauguuguaucacaaguuuucucuguuaggguuucuauuacugcaacaaaaacaccaugaccaaaagcaaguuggagaggaauagguuuauugggcuuacacuuacaaaucauaguccaucuuuggaggaagucaugacaggaagucaugacaggaacucaagcagggcuggaacuuggaggcaggagcggaugcagaggccauacuuacuggcuugcuuccccuggcuuucucagccuacuuucuuauagaacccagggugaccagcccagggauagcacuacccacaaugggcuggacucuucccccauugaucacuaauugaaaacuugccuuacaauuggaucucaagaaggcauuucaucaacugauaaggcuccuuucucuugugauggcucuagcuugugucuaguugacacacaaaccagccagcacacaagguauagaugacauggguuuauccaaacucccagaaagcagaucuuacuguuaggaucaauuguuucagcucuguuuuauuuugcaugcaaugguuuagcguccauuucuacucuuuauauucauucucucucucucucucucucucucucucucucucucucucucuuauaucuuggaucacaggcaguaagaauaauaguggugaacaaaaaaagagaauagguauagguugaacucuuacaaaguaugcagucccaaaaggaugggcauuaaauaauuaaauaucuagagugguaccuccuauuucuuugcuuuucucacuuguuuucuucgcucuuccuuuuucauccuacuuauuauuaacacugcuugcuuuacaucuuuuucuauuccaucucucauuucuauuaaauuuucccaugagaguaucuccuugaaacucuucauuuuuguuuggccucuguucuuaccgucucaauaguuuagugggacagcuuuaaagaaaccaagauuucucacuuugaaucuaaugaccucaacaaguaaaaauucucucugaauaaaacuggaacuacugaacaguguuaaaaagagcuuuucucucccugauuauucuggcuuuucgcuugagcaucauagaaaguggaaguagaugaaugcuugucuggccucuucaccagguauauuaccucaugccagagcagguuggaaaccagcacugggaauggaaaguagccuuucucugaaauagccucuuggcuuccuuucauuuuaacucuggagauggcaaccccccccccccaaccuauuuuuggauugcaguuugguguuacagucaugagguuguuaauuggcuucaacauguggugggguuucgggggaggguucaguguuggggaguaggguagaucagcuauugcaaguggauaugauaacaggaaaaugcauuaaaagagcugguguggggaagugauuugaagacacagcugaguguggggaaauuuagcuuuuucccuuucuucagaaaagaugaugcacucaacauccaaauagcaguaaucaaugugcauuuaaggcagcacaaauggccacuucuggagagcuguauaaugccuccauucccagugaguuuucuccuuuaggauauuaagaggaucugcucacucccuccauccucuuuuccuccuuccccuccccugguuuugauguaagcuaugagagcugacuggugaccaaggggaauggggcuaagcuagagcccauuugcucugugugcuccccuggguccuagguuuguagagaguuccggcagucauggucagauaauaagcugcuaauaauaauaaguacaucuuacauaauauuuccugcagucauuagucugugcugacuguauuccuucagaggacauugguccagacuugccuuucuggaccaucugaucacggucacuauucuucagugcaugcagcugguccauucagagcuugugcauuguuugccuucuuacugucuucugagcucacuucuugguccuuccagaaaauguucaugcauuugaagaccaacauauagugaauauauuuuaaucugaaguaaacuguagcagugaagugauaacugauugaggaacacggcuguaaacaacuccuaacuacuguaaagcaaaucccauuaugugaccuuuuauggcagauuuaaucuucauuacuuuagcaauuguaaccaugguuauaagcaaagagaacaagcaugaagcagacaagcuuaaauuucucugcaugcuugacuuuuuucuugcucuugacucuggucuccuucauacacaguuguuggcuccauaguucuauugcuucugcauagccgccaccugacuaaagugaaaauaauuaggaugcaaggaugcucgcuugauugagccccucugcaauggcaggugccagagugguucugcaagcugagauuguauuagcuauaucccuagccuucuugguuauaauccuuagaaaucucuuagagggcugauaaugugaguaauuaaacacugauccaucagugcccaguuuuauagcuguuguagaauccacuucauagcugucuuuccuuugccagccucuuugcuucucacuuuuaguagacucccuugugcauuucucuuuuaucuuaagcugccucuguucccccuccugcuuuggacccagaaauugagaaggauuacuucccauuccuccugcuuuugcaucaaguucagagagcugaaucuccagaggaugccagccaguucaagucagcauugcuuacacuggaaaagaauuuucuaaaaaaccugugcuaaauauguguggcuuuucacucgacucaaaagacacauugcauuuuccuauaacugggcuggugagauggcucaguggcuaaagaugcuugcuaccaaggcuguucagcuaaauuugauucccugggacccacauguuggaaagaaggaauagaacuagcuguaaauuccccuacauaauaaauaagucaauguauuuuuaaaaaguaauguaaacaauucuguaacugccuuaugucuguugagcaacauaccauaucaaguuuauugugauaaauucaguaauucaaaauauauagaugauuuaaacggauaaauaaauaguugcaaaggcuaagauacauuugaagcaugagcuccauguaaaaccaccugaaucuaagaguauucacaagcaguguccaugggagcccgcgugcuuggucuggcugaccuuggaagggagguacaaaaaacaaggaauuucuuccucugugcaauagcagucuuuccaugccucugaaucuuuaggacguaauuuacaaacugcccaccaguucguuuaagaguuguuccuuauagcauuauuuauaauaauguaaguauccgacucguggaaauaucuaguaauaagggauugauuaaauggauccauaggauggauuugcuguagagccauuaaaaaugaaguaaagaaccagcgacacggggaauuguucauuuagccauuuguuacuggggaaaaaaugauaaggccacaaaacuuuaucuacagugguaccauuuuuuaaauguauaagugggaagauacguguguuggcacuuagaaagcacuaagaacuuuuauauuagaauagaauuaugagucaguguuuccuuuuuuuaaaugauggaguuuguaaaucaggauuaaaaaaaaaaaaacuauagagccagcgacacuaagacaauuuuaagucugcuuuguugguccuuuuuuacuccugaugaccacuuauuucuaccuaacaccaguacuccuuuguccugauuugagaccaguagcauuuacuuaucugcacaacugcucccuccuucugcugugagcgcaucccucccuccucuccuccuuucucaucacugcucacuguugucaugcuucacucaauagcgugugccuucaucucuaucuuauauuaguuuuagaugagagaaugaccuggaguucuuuguuauuugcuucacugccucauaauaccuacugacucauuaguccacccaccucccuagacuggagcacucaauuuccucauuuccagucugugugcucuccaucaguucuguccuuaucagccacgcucacuuuuguugaaagugcagcugcauaaucuuagcugguccccacgcaccugcaccugcaccugugucugcucugggccucauuuucugaauagcagagcccuguugcuuucuccagcugcccaggaaccgguagagagaucaaaggaauuguugauugcaucuauguuugguucaugcugaagccccgcauucaucaguguggccaacccugagaggugucuagacuuagcaggucuccucucuuuguucugauuuguaaccuuuuguugagauuauuuucgcuucuucuaagucaucugucagaacugucagcacaaucagguaguucuguguauuguuuacaguggucuggacucugugacuccucccuggcacguuucugcucuugcagaguccugggaugugagaaggagaugaauucuugguccucugcccuagggcuuggaucaugacguggugcuuccagaggaaccggcaagcagcaaauaguugccuuucaguaacuuuggcauucuccaugacucuaauuugaguauuuuaacauucuacaaaggcacuuauuugcucauuuuuaugaggaacacuuuaacugaacuagauggccuuuugcuuauauaacaaugaaagcacagaucuguguuaaaugauauaauagacauuaagaacauuauccuaacuaauccucaaagagccugcaguuuaacuguagaaaggaagacuagaacaugaagcaaugcggauugagcuguugccgucuauaguucauacuaaacuaaacuaacacacaaauaugcauacacaggaccucacacacuguauuucugaggaauuuauagauucuucugaauauaaaacacgguucaccaaacccagcuugaucuuuaggauuaauggugcaucagcuuuuuuccuuccuucuuuuuuuuaagcaggauuuuuuguuuguuuguguuuucauuguuguaauuuguagcauaguuuuauguagcccaggcugaccucugacuuaaguguugaacucuggucuuccucaagagcaguaagugggcuuaaccacugaaccaccuccuggcucucaaguauauaccugcucuuuucauuuuguagugaagagccuugaagggcagaugagauagaagcaaaucucuagggauaggaauaauucaaaauguauauguagagugcaccaauguuguguuuguguguguguguguguguguguguguguguggagagagagagagagagagagagagugccaaccauauguuuuguagagcgcaggcagguaugguggggugggaugggugccucaguggggcccaugcugaggcaucccuucccccugagguaucagccuuagguuuaguauagaguuuauuuggggcauggaaagggggaauugaaaagggaauagaggcagagagcugggggaaaggagaggagaggccauccaggaacacauggaaagaggggauaagggaagggaagagagggagaaacagguuagggagucagggaaaguaagagggcaaggaggagccaaacagacccuguuauaguaagccaggacuaccuggcuauugccagguaacuguuggguggagccuagaggaagugcuaguagcauaagaguacauaagaaaaauggacuuaauucuguuaaaggcugugguuuugaaaccaaaggaaaauauaaacugggaccacaugguaguuacuuaugaaaguaaauuguaagaaauaaaaauuuucuuuguaugguaaagauacauuaacuuagcguacacuacuucccuagcacacaugaaguccuagguuugauugcuacugccauccaucaucaucaacaacaacagaauucccauucacucucuuuucgggagcuaagugggggacggaaugaugaaguagaggucauggugguaauaugcaguaagaaaucaguacgcagcaucuaaaguggcugauaaauucauuuuaaauuuuugugucguuaucuugggcuacacucugaauccagagaguuauaaaaggacaaagugggcaccgugaagaaagaagaaaguacugccuguagcagaugaaacaagcagaacugagggcauuugguacccaaugacagagguagaagauguaggugcugagacagucaaguguucuuuaucaucaucuccccgcuacugguccccucuauuauauacaguuuuuacuuuccacuagaguauugucuuuugaucuuuuuauguaugaaagcagccucuuuacaaaucuacaaaaugcuacugcucgcuaggaaaauucauagacauacucaguuuuuggucccccagcuaauuaauagauauuucugguauccuugcugcagcuccuauauguaccuaaaguaagaauucauugugugccaguuaucugauuucaagaaauacuuuguuuauugaaaaaauauauaaauuaacaaaaauguuuguucagaguaacaaucugcugucccuuaacugauauagcaauuacuuuaggauugaccuguugauuggcccaguuuagagcaauucuguaauccaacuucugccuuaguaauagcucauucuuggaaaauguuauugugcacuauagcacacaaaaucuaagaguagucuugguucuugugcauugaaggcagguaagguccugucucuggugugcccagacacuguggcugaucuuagggucacagcugucaucuguuuuugcaaaaagacuuguuuuccuucggagugggguggggggggaccauagcacuaaugcauguggaguccauaucuguaacacggagacgauuccagugcccugcauggaaauuaucuucuacacuguagccgcaaacagucugaccaggccagggagaaccccagaaagcuguuuucaucccucuucugcucaucacccugucuuguaucuggcucuacaccaacucuuucuggccagcggcagcuuuuguccauucuugacacugcuggcuuuucuggcuucauacugcugcaucucagagaagaaagcuucugagaguaacaggauguguucugccccccaucucccccugggucgucucaacaccagcuuuccauggugaugcuguagcauggugaggggaggcagcagaacuucagaaggcaagaguucaucccuugccuaaugaagagggacauaaagcugugccuauauaagccuguagggcaagccccugugggacagugucagugugcccuguggcacucagguauuugugcaugcagucgugccguugaccugccuaccaguauccuggcgauaacuggggagagcaacucugagaugugccaucuggauagcacacauggcuuucagccgagcauggcucuucuugacuucauauauacaaugcccuauaguuaguugguccuggaguguguucuuauagacaugaaguaaggauguuuacagcuuggcaaagaauguagguuuagccccaacucagaccaauccccacagauucacaaaucucucuugcuuuuuggcuugcaucccauguacuuucugaugacaccugagugacuaucuacugugaacugucaguuucuuauucauuguuaagaacuaacaaaaggaacaauuucagguuguucaaguuuaaguguguguguguguguguguguguguguguguguguguuaucaugcuggccaaguuagucuugagcuccugggcuucaccucccugguagcuggaaguaccagccccagucuuugauauuacaaaugaagaggaaucuagaauuugguguucuaccucaagaaguucuugcuuugauggaugcauaguguaauguuguuauuggucuucaguguuaguaaaaauauucacaugaauaauaauuuggaaacugguuaugcuguuaacuguggaaaaaagaauuucaguuuacuaugcuuagcugacaccaaacagaaaaugacaaccauauuggucuggaaacauuuagcuugagguuuuucuguuugugcagggauagcacagugacacguaaagguauauggucuuguaugggcuugauuacagaaaguaauauuuucuaaauaaugaaaagcaggcccaguguuacaguguaccuucacuguuagcuuuugaacguccuaaacuugaucuaauuuaaccaucauagcuuaaguauaaaacaaccugucuaaagauuuuucauaggaaugccuggaugcaaggcagugccugagauucacuuuuaggagcaaagcagaacacaucuuguuauuaggacuugguuuuaaagaacugccuugucgucaauguuauuuguacaauguuguucacauuuucuauuuucacacugguagcugcuuguuucuccugguuaaauuccgggucuagggccacauaaagaaaucaucauuggagcuaacuauguaccucacuaccuuuuuccugacuuuguaauuuacuuuucaagcucuuugugguucucuucauguauaugaguuguuuucuaguccaggaaugucuaccaguucaguagcccuuuaacaugaaccuacuguccagagggcauuuuuauuuauuuugaugguucuucagacaccuggugcccuggugaacauugugaaaguucagaacccucaucuugucuugccuuuuauggugaggagcacccagguaggagucgguuugucaggccuucuaaugucugauucacugaauucauaguggccaaaucaggagucuguuguugguagggaagguuguggaaauuggggcuuuaggaaauagaaaagacucauuuaugucuugauguucuauuaguugcaaaucuuaagaacuaggcacagaccuuccuugguagucaguccuagucaguagccaucaauagaauccugaacaguacaaacucauuguggugggucccacuauccauugcaauugaauccaacugaagaguaaccuuggcauucaaggaacuuugaaaugccuucugaguuguaugucauaucaguguguguguaugauucuuuuuuucuugcuguguauuauccuuaguguagaguaggaaguagacuguuguauggcuuuccagaggguauaaggaacagucuagaggaaucuagaggauagugugauggaucuacugaugaaggucuauagcaacacacuugcuuucuccaccaacuaaaagaugucauugaaggaagaaaguaguaagagaaaucuugggaaguuccaauugaacaauauggaggaaguucgaugucuacucuuggguucuuagccucuuuaauuaaaaacuuaagaacaggcucaaauagaaaugcaagaagaauuuaugaggguuuaaaagaaaaaccacacaguaggcagacuuuaauucuugcaucugcccagaggaggugaauggaaaaaguaagcaaagaggucagcccaguggcagagaguugagcccuaaaaaaagaauaaggaagcucaaagcauuagggaguuucaaagcauacuugggcucuggacaguauccaaaagcaaacgaaaggagaaaagaaaaaaaaaauaguuaaguccuucugagacaggacucgguagguuaaacagacccugccaaacccuucaagcaguuccugaggacuacacuagaggaugggaauacuagaaaggggaagugcuuuaucuuagggugaaccugccucucuugggguggcucccuagccaggagcuugaccugcccaacugagugaagucuugggaggaaguggggcagcuuuccuagagggagaucccauucaucacugugacaugugcucuaaccuguaacugaguucucuuccuuguggagaaaaccugcuacccauguugccauuugaccucugaaggcguacaugcacaugcucacacuaacauuaaauacauacgcauaauuuuuuuaaauagguaucuguuuaccccaaauagggaggcuacccacaaaccacagaaagacuguugccugaguccagcuugguaaaccugucagggguuguuuacaggaaccauuuaaaaacagcuacaccaccaagaacuccccugugcagacuuacaggcacuguaccacucucucacucaagaguccuuccuuagaaacggcucgccgguggaaacagccauaccaaaaaaggaaaccuuugguguguuuuugaaaagcauuucaagucagacaggugagugacaggugaccuggaauggcaaaggagaucacugaauugucagagcaccagcugcauguaaaagguguggcuauucuaagugggacugagcagugccucccugacuugguuuguugagguuagauuaaagacuugugacacugagaauaaccucuuuagaaguuccugccaacacaguauaggcccaaggaugaagugugaccaaggguccaugcauaccucugguccuguucuaccaacuuucuugagaacccagaaacccuacaaaggcuagaguuagggaccuuuacugugcugaggccugaagguaacaguacccacaugggcuuucucuaguaguggaagagcuuaauaacuuaaccaaccagcucugcaccauggcucuuccuguaucaccagugaccaugcccuguagugcugguaguugagagguaagagauugguaccaaccaacucauggucaaauauauuaauucaagaguuaccugugaaauccuguuguugccaccccaaaacuaauuggaaugaagcuuaauaucgguuauauaguauucccuaaucacgccccccccccccacgcccguggcuuuucuguacaauauugcuucauuccaggcaguuuaucuuuuuuaccugggaggaaguuauuuccauuagaauuggaacacuagcuacauaguuugcauuuaaaaugguucaugugauuaagcacugaaacauuauuacuugugcuucuuaggagugugagcuuccaacugauucuuccuuuguguccugaacaaugccuuuaauuuggaaacaaguaaggggguucucugauuaccaggcacacaguuagcugagaguggcagccaaguccuggugacugggcuggacagcagcacagcuaacacucgccccuucagccgcugcuccucacagucuggcuucucagugguauacacccgggcuuguguaguggagcaucccaugucaacagucugcgcuccuuuccccacaccccagccccagacucuucccugguauggcuuuuaucuucauagguuuuucucuucugcccuuacagagcuauuaagaauggcaaaggauuacacagcaagaaggaggugcccauccaccgaguugcagacauuucuggggugaguuguggccuugaauccaacuguuggcucagccuccaagagccuguguguuuguuacucacuaaaggacucugcuuaucuguuuucuguagcucugugcuuuucaagccauaaaugugaauuuugcaggguacguuuaagacauguguaguaacucugguuuacauuguggaaaagcguaauuuaaaguacccauuguguuucuuuaccugagcugucucuauguugcuucuucguuauuaacuguuaugaauuuagaagauauuuuauacuuccucauuguacugaaguaaaauuagcucucuggguuuuuuaauaccuauuuuauucugugaaugaaaagucuucauguuaaaaggucaaguguagguuauaggagaaagucuaagaauuacuugugacuucuuaaugaguuuuuugcagcuugucuauuccuggaacagaauggaggaauaagugaccauccuuaaagauaauaaagacaauauauagaagaaucaguuacaaacaauucugagcucccaaccggcucugucccuagcaacauuuugcaguaaagacuugcccuugcuaagaucucuucugacugagcaguguccugcuuguagaggauuucuuguagaaagacuaagugacugccuacuauguguagguucuguucuagguacugugucuauaacaguggagcgggagaaggagagaaagagagagagacccuacauucaagggagaaagagaaagccgugcuaugaagagaagcacugccagcuaagaggaggcaaauggugccaguguugauuugauuucgcucuggugaccagggacagcaccuagggugcacaguccuuuucaacuccuaccgugugugccgugggugaggaggagcacauugcaucagaaacugaaggagaaaggacccaugauucugagcauagacacacaagggaugugccuuggacuucaagaugacaauaccaguguaaacagaucuuccauuucucagccugggcccaagcaggacagaacuggaguauaaugccuucuccuuaugccauguuuacaugucuggucacucuuguuacuaguguagcuuaugaaaauuugucuagccagaucucccaugcguggguguccucauacugcagugagcuuuucuuugaauauagcuaguuagcuuaggcagcagauuaaacaggguugccuacuucccuugagcuaagucagucucaagguuggggucuguuguacuuaggugagauguagugauacacauauuuuugugacuuagaaucuugagaagaugaaacuuccugguguuggccguucagcccuuaguguccgcagugcaucugcuaagacuauuguugccagggauggugcguccagcauguggcucuucagcccguuuucucuguggcuuagccugcugaguuauucuggcauacauguuauuaauuucuauagguaugugcuaugguauugucaacaauguuuuccauaauguucuuuugcugaagagguugguauaaucauaaggcaauuuggggacuguucagcuccagggaaagaaaauauuauaaaugcuuguuuuguaaaacacaauggaggaccaucugccuauggaaaugcuuuuguaaaaccgacacucuagggccuuucuagagcucagugaaaccuugggaaacuaugucauuuaagauugaaaacaaauuuuaaacagauuaguaaaucacacuaguaugagcugcacugcaccgugccuccaccccccaaguaaaagaacagcuugacauaggcuuucaugguagcccgaggucacauuuggcucccaguuugcccuggcagugaaguccuaaggaagcuagcagggcagaggucugaugccaugguuuuccucuuaggaccccagaggacagggucaggaaaucuuuggugcugccucucccuauuacaugcuucucuaacccugcugcucccugguguuucuuaacccuuuaguugcuguuguagaugucaguagugcuugugcaaacuugccuuccuuuuuaucauuaucaugauugauaaguauuauuccuaacccacugacucacccuuaaacuguggcucguuuuuggaccuauuuuuagucucuuuuuuuguuuggaaaaaaugguuugcucuuaaguuauuuagaaauaaaugccaguuaaaugucccucagugaccacauaaauaaaagagggaagcuugagcagguggaagacuggaagugaaaagcuauucaauuuaaaucgaugucagauaugaccuugucugccuggaucacaaauuagucagcuaagacugcaauuuuuugugcccuguauaauagaagagguuugucuuuccccuucucaccucccagucccuccaucacaguauuaagugugaguauggguugggugcccuugugccauuuaagugagauguauggguuuucugcuaccuagagcaugcuggcaauuuuacugucugagggacagauaggcauguagggucauaggcaagcagugugcagcugauggaaaauagaccccugaguaaugacaguguaauaauguacaguuauauaauagcuucacgaaagaaucuuaaucucuuuuaaauuuucaguuguguccccccauugccccauacugacucucccuauaguuucaggucaugauaaauggaagauuuuguugaguugacaauguaugcacuaugaugccaaaauaauuuacugugaacuguuauuucugcauaauucuucccucuauucuccucccaccauaaugcauaucuuuggagagaaaaaaaaaaagauaggaauaaguacauacucugucuccuaaagauauuccagagauguccucugcagaagauguccugucaaugacugugaggcaaacagccuaugggguuugucucagaguugacggcaucuugcguuagaaguuaagucuguacccauucuuccuaucuucucuugguuuuaguuuccccaagccaaggauaggaugcauuagaauacuuucauauggagauuuagcaaaagcaguaucuucuuggcuaaauugcuggugggaaguaagaucuaggcaugugucuuagucaggguuucuauuucugcacaaacaucaugaccgagaagcaaguuggggaggaaaggguuuauucggcuuacacuuccaugcugcuguucaucaccaaagaagucaggacuggaacucaaacaggucaggaagcaggagcugaugcagaggccauggagggauguuccuugcuggcuugccuccccuggcuugcucagccugcucucuuauagaaccaagacuaccagcccagagauggucccacccacaaggagccuuucccccuugaucauuaauugagaaaaugcccuacaguuggaucucauggaggcauuuccucaacugaagcuccuuucgcugugucaaguugacacaaaacuagccaggacagcaugggagugaacgauuaacagggcuucuuaggacgugagacucuagccugguguauucuaagaagcagaucuuguuuacgaauggcagguauguuuagcauuaaguugagucuuuuguaagaucaguagauuaccuaugucauaucaauuaguuggacacuuuuuaccaagcaguaaaaaguugacccaaguguaucuuuugcauuuauuuucagaguggcuucuaaggaagaaaagugcuuauuguugggcuagaaauguaggcucuaaagaaaugauugaacuggcagaggcaagaggaccacccagugaguuccagggcagccagggcuacauaguaaggcacugucucauauacaagaaguggcaagcuucuguacuuucucauuuucuuauuuucuguauuuuccagguauagagaguagacuuuaugagcuuaagccauuuacuuuccuguaaucugguuuucuuucagggcaagaucccuuugaagggaaguccuuaggaugagcgcucuguuuccuaaacuagucugccuguccuccuucccuugcuacuauagaaaaguugggcuuuacauauccauagaauauacugcuguuccauaucuuaaguauauuauugccucagccuguucugcaauaaauacaguauucuauagauagaguauaaaacagaaaaucaaauggggcuggugcauggcuaacuguuguucugguagaugagacaaaucaauuaugauucaaaagccgagagagugcaaguuucccacuccuccagggcagccagcgcuucaaguacacauugcuuccucugccuccaucucuuccucucccaucugugcauuaggaguuguaaugagucggguguguauuugagacuuccucuccugucagcucuggucucuuuguucugaugcucaaggaauuuuaaugaucauguguuguugauugcugacacaaagacugguccgagccugugcccaaacccucuucagcaauguuuccucuagcuauacugcugagcuccuuguuugcuguccugaguuacuuuacugucuaguccauguucucucaggcaagcauguuguguuccauaaacaaagguggaaucuuggucagagcugugguggugacaguguucaggucucuuggcuuucugauaucuaugcuccguuugacaguucaaguucuuccucacuuaagagaagacacugcuuuuuccguucuccucuguuuagaaacgguuggccugcaguaugcagcuaauugucuugcauucucuccacacaaaaaacaugccccacagcucugcagcacucugaaucucuaauggcaggaggacugcuagauuagcagucucucccaggcugcagaggucugagguauucaguuuuguuuugucuuguuuugaaauggaagcuccucacuguguagcccagucugcccuugccaucucuugcuucaccaagacugcugagauuauaugugugugcucccauguguaauuucuuugucuuugcuguuuccuugaucuuuccuuuucuccccuucuacuuccucuuuuauuuuccuuccucuaaccccgcccccaccaucucuagaaaaguuggaugucaucaagaagacauugauuguggcagaaaguuggaguuagucaguugcccucacacuuguggaaggcagugcucuauugguuugaaggaggagggaggguucagcucuagagccacaugaggccuguguggcucauccucccccacccccucauauagcucuccagaauugcaggagcaucacucuuccaaauaaaucagaaagcauuuaugguuuccgugagaacuuugccaggauuauauuucagcauugacuacagucaguggugguuguguuuaaguacuucuuagagaguuuuaauacauuuuuugacugaguuguauuucuuuuguguucuuuguacaauguagggcaccaaauuuaggacacagucucuggcuuuuauuuaguuuugaguaucaggaaaauuguucaagacucugaaauaagcaggaagauuacugaguguacuuucuauagaauguggacacagccuuauaagcucuuuuguguggaugcaauucugggaguuuugcuuuguggauuucccuggucuguuuugcaccuuuguggcucgagaagauggcuugugaagggcugaucaugaugcauguaaguccugaagacauguccuuuagagacacagcugaucucugcugugagagaaauguguucagauuugacauuuucacucuauauuuucauaaaguaagacuuagaagauuuuauucagcauuccuaguaaccuauauaugucuguuccuuacuucccucucaaucuuucccucaucaauaaaugggucaaaaugaagcucuaaacugucugacuccauaauacuuguuuggacugccauuuuauucacugggagauuuaccaggugggggucugagaucaaagacaaagccaaguguucugccacugagcuaagucaauugaaguuccuucuuuggagauggcuccggcuugugucaaguugacaagaaacuugccagcacaggguccuagaucccauuucaauaaacaaagcuauaaccauucuuuuguccaaagaaaguagcaaggauauugauaguccagaggcauuuuuccugaaccagauguucuuucuuuccaaagaaaagugcuucugcacauggacucugcugucacugguucauguccucucauucucccauucccugaacacauggauauuacucuccgauucuacuucaggaaucaagauugguuaaaugagcccaacauugcaaaaacaaaugaaaguaaggguauuuugaagguguucacuaguguuacugguuccugaguugccacgugacuggguugucuggugcguguaucccaagcccacagugaugugguaagcccugaaguauucccguacugcccuggcuccacucucugcugugccaucguaacugcuuagcccuagacugaacccaguuuuguccuguggcuauugcuuauguaaacauuucaaaguaagucauuuacuaacauagacauucugcuugcuuguauuuuaagccuuuauuuagcauguuucuaacauucccuacagacugugucgcacagaauuuuggaaacucugcaauguugacaugcagauauucuugacuuagagcucgggguaccuuugaagugcccaguagguaaggucucuucuucaggaagugauauucucaggaggaaauuauagaauuccuuccugacacauauuggauuuggaagguccugacaacauaagcuguuagcgagguuucuaacuuggagaaagcccugugcucucugugcacugcucaggguguguggaugccucgcucagagacgcucaguccugguuccuugcuguuggcucauauuuacccaguccacagcuuaguggucucauguaaggacuuugccugcauucccucuuuaucacaucaagagggcaaguucuuuuuugagcgcugucuccucccccucaggaccagucuuucugcccccuuuuguuuauguccccuugcauccagccuguccuuugaucaugcccccuuuagcauugacaaaucauauuacagugaucuuguaucuguugauaaguaaguaacuuuucaacuuguuuagagguauucuccuuauuagcuucuaaaucccuaaggggaaugaauugcuuuuauauuuauuuacaguuccuuauuuagauuugauaugucaaguaaugcaccuuaggggguaaacuuauauuugaaaaaaauuaaugcuggcucuguaaguucagaguuacuacugguuauccaacuaggcaggcuuguaaagagaugcacagaagugugugcuguagaauggagucaguacgggcagcauaggcucuuaguucaguucauugaaauucaagucaggauuccauuacuuacuacugugucacccugaagaagaaguuauuaauguuuuuguuagcuuuccagucuauaaaaugggugcaaugguggcgcuugcuuucuuugguuguggaguaguuguuaaaauuaauacauacauauauucugaacaguuggcagaacaagagcuaagcugagaucagugguuaguaccuuguguugauuguuacuaaguugcuuugcauucuauauagcacacaggaaguccucugugagugacaugucaucaucuguaauauuucuaucaaacuccuuuuccgauuccaguucaaaaaucacuccuccucaaacucuuuuaccauugccuuaucucucucuugauguuaaauguguucauccugggcuuuuucccccaugcauuucucauguaaaaucaaugaaugaacaauuaaacuguauguauuugguaagagcuuuuuaagugccagauacagugcuggauauugaggauuggaccagaccaauguauucuuuauggaucuacauaguuaguuauauaauuauugugaggauuggagcagagucccaggaguauauacuaaugaccacaauuuguucacgauggccugacagggagaaauggcuggagcucgaguugugccauggaggcagcaagacaaguggaucuagaucaggaaagggaugaagagaacuggguaggagaugaggggacaggguggaagacuuaagcgaggaacugccaugcaugaacaguauugacaaggucacaaagaacucucuguggaaguauauuuguuucauauacgauagacuuccacagaguagauuuuagaaugaaauuaggaauuucugaacauguuaauaguaagcaugcaugaaccauucugugguuucuaagccagugguuugaaagcuguuggaugcauagauauccaugugcauaauugccucaaauccuuuuuaaauuaaauuuuauuguaccauuauuaugaugcacguaugauaagcaugaguguaaaugggugcuacauaaauguagaagucaacggacaacauuuuggaguuacuucucuccuauaauagauucugggaauuaaauuacccacuaagucaucacaucauuuccauauauguguaagaaauaucuauuuuuauuugagucagggucucaaauauguagcccuguuuggccuggaacaugcuggccuggaauuacagaauucugccugccugccucugccuccaaagcucuaggauuaaagauaugcaauaucauaauuuuauuuaaauuaauuuuuaaauuguaauguaucugagauaucuguguauguauaggugcacacccagcauagccuacaugggguggucagagggccugguccaggaguuggagcucucuuuccaugaauuccaagaaucuugcucaauagagacaaacaucucugcccucaaaccauccuacaaguuccacagagcacaugaagaggaaucccuaggccuuggccuuuuuucucaaauauaaaggucauauagcaguaugagggacuugcuggcaaaggaaauugaaaagccuguugcccaagauugccaauguuuaaaaagucucacuacacaaacucugcuguuucacuguuacuugagauaaagaucuaagaauugcucaacagguaguuuggcaccauguucuuaguuuguguaggguagcagaagcaggguagucgggguggggguuggggagguggagguggugguggcagaaguuagacucaacccaccuggauuagcagaagagcuacuauacuuuccagcagugugcacaugugauaaugggaccugcauagugccugaaaacuccgagagcgccuacaaguguaaaugccccaauggagggagagaacaauggaagugagauuagagcuccuuaguugaacacaccaauugugaccucaccaaaaugcauuucaguugcaucacucugucacugaggauuucacucauagcagaucaucaauguaguccacauguaguuuacuuaaacugaaagcuaccgggugaggcuaggagugagugcuacauaacagcuucagaagaguguguaaccuccaguacaaacgaucuacagcaaacuaccauaaagaugguuuuucuguagggguugcucucugcuuuguaagcuucuuaucaauuguucccacuguguagaauccuggguacacuuuauuaaucuguugcugagcauggcuuugaggcauuuuuacagcguacugcugccuuacuaagaacacauuuuauuuuaacuucucaaaccagucugauaugugagcuuuguuuauuuuguaccuuucugacuuugaaccauaauuaucuauguaaagucuuccuuucuuugaagaaggacuccuaaguuuguugucuguacugggaagcacucugcguacagcccuuugauugagucagaacaaauuucauaucagcucccagugauguuuuccacaucauuuacagacuagucaacaucaaaaguauuugucucaaaagauaacaaauuuauugcagagggcuccagagcuagagggaugguuaucugaccuaacugauuuguaaguuuauuuguaaguagaauuagucuugaauguuaauaauaaauaagaaaaccucuuuuccuuccauagaaaaacuuuguuuuuaacuaagucuacuauaaguaggugacagaaggaaguaaaaaucaccugugccucugcgcugggaagagauuaguuaagcagaggcgccguccccgcuucuuuucccuuuugauaaaguucuuuuccgagacuggaugucgcugcuugaaggagucugcucuuuccuuccaccuugugggccccagggguugaagucagacauucgugcgguauccacugagucaccucaccagcuuuuauuuguuuucuuaaugauagcuguucugacuggcgugagaucuggacucuugaugcagaguuaguuugcauuuaccugauaggaacauuuaucaguuuuuuuuguguguuuaaaggccauuucuuuuuuauauuuugaccacuguuugaaggacuccaauugcucagaaaauaaaaccgagaguuaauaaaaugaaguuauaaauuucugcuuaccaguggaaauaacugaguggccagauugauauuaaaaugggaggaaaucuugacuaacccuccuacaggauuaauagcuaagauguauuuuaucucagcuguacaaucagcuccuagaugaggacauaggugguauuuaguaccauuggguagguggguggcuucaagugucauauuguaauugccuuaaucuaccuguucaaguuguauuuaaggauaguaugagagagagggggggagagaaaucacagucugugauuuuuaaggcaauaccacaaaaacagaaagcuaggucaaagaauaacauuuuaucauucuggaaggcuauugaguaaaauagguggguuuuuaauuugauacauuuugagucauucaaaguauuaccuucuguuuuccuuaauaaguuucuaccauaaugguugucauuugucugcauauugaggaaacuagaacuucuucuuccaaauuguauaauuaucuauuuuuuauuaacucuaaaacaccagucuuugaaacgucuuaauuaaauauaauaaaagugcuuugcuuaauauuauaguaccauugaccacuuuauguuugaccucaguauuuaggauucugcaucucuucuaucagucaucuucaugaagaaaauauuuaggaaaaaaugcauuugucuccaucuaauagcuaguugacacuuauuuaagguuuuugaauuuuguguuguagauuacugacugacauuuuuucuuuuucugaaguugucuucuuuucuggaguagaguuuugcaugacaucaauuuucuugccccugaguucuggauuugcccaugaaaugaaaaugugugcuucaucaggccauuuuaaauucuuuucucugcacauuucauuuuaauuaucucuugagccauuuucugguucuguaauacauucuuaccucuaaccuauagagacauuggagguaauaaaaaucugucugaaacuuuuaaagaaaaauaauguuucacaccuguaaguuauuuuuaauccagucuuguaauagauacccuucuauagccucuggcccacgcacuuuguucugcagccuagugccacacacuguggcuaccguguuucuaggucacacucaugccgcacuccugaagacauuacugugucgucguaaagcuuacuugugcaggccgggugggccuuaaaucucagcacugggagacagagguaggcagaucucuaugauuuuuaggucagccuggucaacagaaaagcuccaggccaacaaaggcagcauauugacaucacgcugaguaaauaacuaaugcccauugcuccaugcuuagaaaagaagcaaaagaguugucagaaguugucagaagccuuugcauuuccccguuggcugugcuugcugcuuuucagugcagccucaucaguuuagaggugugcuuggauaaaugaggcauuuacacuaagaagcugcaugucugggcagaauauuuaaucaaaaaauaauugaaagguguuucuccuaguuuguuacgcucugcauauagacauuguuccccauauauguugguauuucugaaccagaaaacaaauugccaugucuccugccuguuuuuagagcaauuaccauuguuuuauaauaaaauaacuuuccuguacaucacagcuaaaacauucagcacuaucaaaaguauaauguguuacuacacuguugaauuaugaaagggauuuauuacugauucgaggcuauccaaauaggauagucuuucuccugaauagaaauauaaaagcaaaucuguauuuauuuaccugaccuuagagagauacguuucaccugugaaguuuguagagaaauuuuuuuuuuuuuuuuuaaggaaaagaaaguagaacaaaaaaguagaagauauggaucugagagaaaaucacauuccaggaaaaggcaugaaggaguuucuagggucuugaugagggaaaggcuggugaccccaugcggaggcccauggcuaaaggcucuccaaagagacagcuaucuugugugguuucauaggacaaaagcaugacaaucaagcaaguacuucuuaccuuuuguaacuuuuuuuuguuuguuuugguuaagacagguccauguagcuuaggcuggccucaaacucccuaugaagauaaagcuggccuugaauuccuugguucaccucccaugugcugggauuacagcauggacagugauuggcugaaacauuguuccuauguccucucuaguuagcugagccuggcauuuauucuccugcuuucuuuuagcuguugccuaagagcuaacauuuuguuaugcaacuuuggaaacacugauaagauuguuuccccuagucuucuaaccuacguuucauccauuuucugguuaaaaguuuuaaagugcuauaguacagucaauuuuuuauuauauuaaagcaauucauauaaaaaauaacuacugaacuaaaaguuucgaacuugucauuuuuuccuacuuaaugguaaguuaguuggcuaggguaaaaguugucuugaauuuuaaauuauguaaugcauucuucauagucugguuauuuuuaucuuuuaaaauuuaaaauauauacagcuaaaacacacuaucuucauauaauucugugagcuuugacaaauaggccccguccuauuuucccuuuugagaaagggucuccuguaucccagguuggccuugagcucaagagugcuauuuuagcuacaaaccaugacuacuucuaugugguccugggcauggaacccauagccuuguguguauuagacaagcauucuacuaaccuggcucaauucucagguucaguccuggcuagguuuaugucggcuugacacaagcuagaaucaucagaaagaaaugagccucaauugagaaaugccuccaucauauuuagcuguaggcaagccuuuacagcauuuucuuaauuggugguuguuguaagaggguccagcccauuguggaugauaucaccccggguugauaguucugaguucuauaaguaagcagguugagcaagccaguaagcaccaccccuucauggguacacugcacccuuauuagaaccugccuccagguccugccuuguuugaguuccucuccugacucccuucauugauggacuauauaagcccauaaacccuuuccuccccaacuugcuuuuuggucauaguauuucagcacagcaaugauagcccuaagaaagugcccacugugcuuacauuccuacugcguagaacuauuacauguugugcuguguacaaguuaguuaucccaagcuggugaauguuaggccauucuacauuuuaugugguuauucaguccaggacauacccugugccuguugccuggccagucugagaccauuaugcuugucaguuagcaugccacuugguauguuuuuauccugaacgcaaaaugagccuuaucuuccuaguauucaccaaguccucauuucuuuccuuggaauuguacaugggagagagagaacccaugucagcuggaucaaccaaauagaaucauuuguagaugccuguuauuuguggcacuucuaaaauaguugugucuacaaagccacagaggauuuaguuccuccuuauuuggaagagcagucaugcuggaucuaagguaucugccuucuccuuguuccagugguuagcacucaauucagacuguccuuagcuugcagguuccauuuggaaguuugguuuagcuaauugggauguauucagaugaagguagagaauuuuuuaacuaugagagaaccacaaauaagaauccagcccgugucucuacuaauguacagagguagaacccaggcccagacaaccaguucucugcucugacuuaugggacaccugagugaugugaugugccaucuaagccaacagcaugaggugauguaagccagacgucacuuaaugagagauuauugauggccuacauucagcagcuuuauaaaaacaugguagaaugcuguuuuguucugauuguuuuucugugugacucucuucuauguuuccuuuauucuaguuaaauaugcagcuaacuaaaguuugcguacacauaccagaccccucacacacucuuacugugaaauauuaauaacuagccgggagauggcuaguuggcuucagcauuguacgugcuuucuggaagcacuagagcuugaguucguucccagguguucucccuaccagagucccguuuacuuccagagaauagcaugcuguacaguugacuccucacagacaaaccagaagcucauuccaagaauuaacccacuguguggaauggaggaagaguguggagugaugagugugguugugauuugucuucuaugccauggcagaaguaauucgccuauucuguacagcccuacgaagauugcuaacuacggcagugaacaaucacaauaguuuuuaacgugcaaaaacauguuugcuucaauguccuuagcuauuaguucugaucuccauucuuaucugugucugcccccuuguuucacugauuaugcauuaugauuaguuggcccuaaggggccagcaacacagccaguucaugccggggaacagacauucuaauguagggaaaauaucuguggugcuuccaagaagucuccuugggcccgacgguuucuucaucauugagcuucccuucccagugcugauagaguaugucuguauuaacagggucaccuauguguguaauuugucuaccucaagguuauucuuugauguuaauggaagagugauuguggugaugggaauucauuggugagcuuccuucuuaacaguucccauuugaggcuugcacaugauaauccugaguguuaccugguagcuaacaggcuuacccucuucccauuucccugugcucuuuugagagggaagaugauaggauuucuuuuugcuaaggucaggagcaugugaacagcuucaugaacuuaucauuucugugaguuguauucucuaugaccagugcccugacuguccaagaaccucugucacagccccugucgcagccccuguccugugccuguucucuaggauucuguuucaucaccccucuuacuuccaaccaacguuauaacuuuuccaaaccuguuaauuguaaaaaucauuuaaaaaagagaaaaacuaguuguuuucacaggaagguacuuuguuggguuugguuugcuuuaguguuacauguuuuuuuaaggcaguuugauuucuccaggacuguucuccaacucacugaguagcugaggauaaccucaaacuucugcccuccugcuucagcuuccccagugccagaauggaugacaggcaugcauugccacucccucguccuggggacugagaaccaacuacagagauguccuuugguucucccaugaaugugacacauaacuauaguaaauaaauguuuuuuaaaauguguuuuaggggcuggugagguggcucacugguuaagagcaaccgacugcucuucuggaggucaugaguucaaaucccagcaaccacaugacggcuuauaaccaccaauaaugagaaaacaaaaaauguguuuuaaagaaagaugugauguuuccauauuugaaagauugggccuaagccagaacaggacagaaugggaaucaauaauuaagauguguuuauauccuuugauucucucuaaggagaaucuuucuugggggucauucuaaauccuguugcucuaaaucugagguauagauacuaacugcuuugaaaugaagucaccccuagagcauuuguugcaucguuacuuucucaaauucaagguguauugaggaggcagaaacauuccuuaaagagaugccaucugcaguagcagguuaaauguggcuaaugcaaccucaaauuagcucuuccaagaggacagaaaaaugccugugcaugguuuguugugacgcaccaguaaugugagcacuaggagugcaaccagaaggaaaagcuucugcccacaacuguagcugcugcuguauugcucacaccaauggaggagcauuguuguagauaacagaggaccgugccgaaucuaucugcuuggauuuuuuggauucucuugcgccuguauaggaccagggaacuauggcaguagaucccaguucuuuccugaguaagcuaucucauggaauaccugaggaugacucucuacccaucuaagcucaaguagaugacguugccuucaaaugagcauuugaugcaaugcaucucaauaguauccugagaucuuuaaugucugcuuuaaaaaacaaacucuggcaguuguggugcacgccuuuaaucccagcacuugggaggcagaggcagguggauuucugaguucgaggccagccuggucuacaaagugaguuucaggacagccaggacuauacagaaaaacaaaaacaaacaaacaaaaaaccaaaacaaacaaacaaacgcagggcuacauuuuuuccuacagaaaucauugauuauuaccgaauuuuaguguguugugcuucuguguuauugggaaggaacugaaccugucauguuaguggcaucucugaaccuuaacacuguggguugguuuuuuguuuuuuuuggggggagggguuguuuguuuguuuggguuuuugguuuguuuguuuggguuuuugguuuguuuguuuguuuguuuggguuuuugguuuguuuguuuguuuguuuuugaugguuuguuuuuuuguuguuuuuuuguuuguuuguuuguuuguuuguuuuugguuuucccagacaggguuucucuauauagcccuugcuauccuggaacucacuuuguagaccaggcuguccuugaacucagaaauccgccugccucuggcuccggaguacugggauuaaaggcgugcaccaccacccccggcaacacuguguuaaccuaaagaucaccuguguuagcuguuuguguuuugaccuucacuagagaguagaaacuggccucugcuauugcuuauuacuuguaaucaaauuuuaucuuguuuaccuuuucuuuaucuuucucugguuaacccuaaacaucacugugaggcucaaauacuuuuccaugcuugccuaagcuccuugaaaggaaacuuaccuagccacauucaguccauuuuuuuuguaauauacucugaauuccuaagauaaauaauuuuuacacuaaauuaucuagggugauuuauagguacaucaccugaggaaaguuauucuuuucaucugagccacagaaauaagcagucugaagacuuuuccuguugaaaggagcaugcuaagcaaagauacgcuugccauaacaaggaaagacagacaccguccuguagcugugacugcgaugcgaaagagcugacaucucuuggcuauuacagacaauuuaauugacuucauaagaucccuucauuguuaaaaugcugucagcguggaugaagucuccagucuuccucuuaguggguguuccauguuauuucauccccuaagccuuugaauccuugccucaagaacaugggugccccaugucuuaguuuacaaucuuacaugguaagcuguagaaguuucaugccuucaacuuucauugcugaccuccucuucuaaucucuaccaucgucaguggcaugccuuucucugucaucuucccacggcucauuucuggaggcggccugguagauugugagcugagacauaagugaagugaaggucgucuguggauuucauugcauugagaccagucagguuuccugaaucuccuugauuguucugaggaagcaaguuccugauaaagcagggaauguuuuuccugcucuuuagccggagggagaauaaggacacagcuuccuugucaguauuaacauuaaagacaugugugugugucugucugucugucuuucugucuccuauaagcaucuuuauuuuucuuucucucccauauagaaacaaaagauaggggugagcaaaagucuauuucuggcaaauuuagaauuccuucacagugauauugggcugccucaugauuugcaauaaucaauuugguaauuguuguugacuuacuggcucagcucaugaauaaugccccagauuuagacuaguauggcaaaaggauuugagucagguagugcuuuuguucacuuggagcauuugucuugcuugacuguccuggacuucagccaacuaccagaaaggcauuuuccugcuguauguguauaguagaauaugugucgcuuaaguguucacugggggaguuuccagcccacugcagcucauuguuaacuuacccucuaccaaugugccauuaggaagccugagaauggaugacugucucuccuuuucucuaagaaucccuuugaaaggaggauggaucuuauuccuguaaauauuguuuucaucacaggcuaccucacagauuugaauaagaggagcaucuuuggcuucuauggaaaugcuguaauacuugauggcuuguuaaauuuucauuguuguauguacauuaauuuagauacaauagcuguguuccuaggagaagcaucagaauggaagagccuggcugagugcagauugccuaugucgcagaagucaggaaaguccaaagaacuugcuguccucagagggaguuugcacuucugcuggcugggcugaaaaccucagaaauucucaaauccagcaacuauucccccagcauaugugaugugauauuuugaugcuugcuuacucuaucaucuguuuaauuagcuugagagacugagaggauuugaaagcccucagcgacuauguggucaagagcucugagacucuaaaugcucacacuugguacucuugagagcagaaugcaugggcuugugccgaugcauuaaagauguuuggaaagugcuagauggguguguguguguguguguguguguguguguuuauuuccauaaguauuugagcuggugugauauggucuuugucuuuauggaacauauccugcucuuacagauuucccuggauaggagaacauccccggcacacauacacccccauccucaaaaugcauaugaaacagggauaauuggauugauguccagaaaaggccagguucuacacaagguuaagccagagcuuggagucuuaugcagugugucauggcuuccugagcaaggacuauacguguuauguaacauggccugaacaccauuuuuuuuuuuucaaaaaaaaaaaaaaagaaaauuaaaguuagcugccaugggaaaaugguauuaguuuucugaccucaguguuagcugaagagaaaaugaacucuucauccugccccagagcaggaauaagcucaguucgcaagcacucaccuaacuuacauacacacuuagugugaggcugcugugcagaggaagcauuuggucaacgaggucacaugaguagcacaucugggccaugccuucaaaaauuaccgauucuuaggugguuaacuugcauaguuuccuuccucugaacuuuuuaucccaaacugaagacaaaugagcaccuaucugugcccacugcuccgaagacaaaggagcguguguccugucauggucacugcucuccagugauugucuccuccuuuucuccaucaggacacccagaaagcaaagcaguuccugcccuuucuucagcgggcaggccguucugaggcugugguggaguaugucuucaguggcucucgccucaagcucuauuuaccuaaggagaccugccucaucaccuuccugcuggccggugaguuccaugucacuuauguccucauaggaaguugacccuggucuucucccuguagccucaagcccuccuguuuuuccuucauuccgccaagcauaugacuuuggaaaauaguuugaaagacagcacugaaccucauccugcauagauggagggaauucuaagcccagaaaacaaauaauaggaucuccguacuuggcauuagccauuuaaggucaccugccccugccgugucaguaguaagcagccucaggaucugagcugcccugcccgugguguuccccaggcagugccucuuggcccuuuuuuucuuuucuuccaaugucaucagguucccaguccuuuaggaaagucucgcagugacaccacuuucacuggcuccuccaucaguaguguuccauguugacugagaaugacgugcuagggcaagccuuccuccuuccuugucgccugaacaugcaccucucguagccugccuuucuagguagcuuaauguuucccuagacagcaagacuguaugaacugugcucuuugaacaacuuacauuuauguauucagaguauaaaccgcuucauuucuucgcugcuggcaaauaauaaagauauuuauuuccagucagcccuuacagaaacugcggucuuugaaggaaggcugucccuucauccuccuacugcucauacacauucauccacucacaaaggacacacgcuuuugugcucccagauggcggugccguuucuguuacuguccuguugccucagcacuucuguugaauucuugaauagaauuugcugugguugaagggagcaagagcuuugcuuucuauucguccacagccagaaucccuuggccccuuuuuccuggaaggcacugagaacuucuugucuagauaagagaaauaaagccaggccccaacuggaaggguugaguuauguacgguaaaccacucccugaccaccuggccgugagcucacugcugcugagugacuguccucucuugacaaggcaccgguuugauggucccuacggagcucugcaggguuccugcaaggacuccauccucagagacaguuggagaaagaaggcucgaaucaaauccacaccuugcuggagggccaaauuuguguuucuguugguggcaguuguaguagaggaaggcuacagggcagugcgagucucuuccuguggauauuugugcccuguucuuaagcuuucuguaggugagagguuucuuggcuguggauucuuguucugggguuugagguauauauucagcucauucuucuaucuacacaaaaaacuaaagcagcaucuuggcagcguggaguuuaguccaggauggaaaacagaaaaggucugauuguuucucagaaaccuggcuucagauccauagaggaccaaagacacugucuucuaaacucagcuccuucaacagagccagcucauggagguucugcaggaugcugcucauuccaccucaauuagaaggaagccaugauacugcuugaguaugucaaucauuucuucuguagacuuagcauucuccuaagugucauaguuccaagacauugccuaaguuaacuuccagucugaaagauagauuacauagcagcaaauacaugcuacaaagcauaaccacaagucuuugggagguagacuucccuuguguguaggauggguguaggggaggaagucaggcauccuaaacuggagccuaggaguagauaugaaggccauagucaaagcuaaaacagugagagaagcucguuagagaaauggguaauugguuuggccuuggauguauaauauuuauaguuuccauggcaauguugcggcucaucagaagagccugggcagaugcucagaucauggaguacuccgcaugugugcagugccugcagaacagcuuuaggagugguguauuccaccccauaugugaagugaacacccaagaacuccagcauaaggcuacgaauuccuaugcagacaggagcugcuacccugugaauaacagaaccauugagagugguucugggaggcuaaggagauggagaacucggaggagccagcacagucagaguuaaaacaucaagugugcaaagcacugacaugaucuuauacuguuuaaucagucagaaagucauaggugaccuuuguagauauauuuucaucaguuaucaaccaaaggcagauuccaggugacuagaaaauacccauggcugcugguaaggagcagacuuaccagauaaagacugcuuagcucaaagucuaucagagaauggaaaauagcacauaugaaugagaguugacuggguaacauggcaaaaggaugccggcaucuacuguacuucuaaaauugacacaugcugucaagucaugagguuguauguuagaguuagaaagcuaucuaguauagcuauuuguuuuucuuaaaacaauccucgauuguuagcuaaaacucaacaaaaucuucauaucaaaaagauagacuagccaaggcuggugguagaagccuauaaucacaguacugaggaaauggaggcuagaugaucgagaguucgaggcuauauaucuagacuaaccugagcuacaugagacccugucuuccaaagagguugugcagagauagggaggauggagaaaaaucuuagggaacaugcaguuuaaagagaugaggggcccugaugcaaauucgagaauucaaggagauugugaguggacaaggcaaagcugaccuggggaugaaaguucgcuggaacauggguggugugagucugcuaagagagaccuuugugaccucaaggugaaugagcauaagcauaggccuggagaccugagcugugacuguugggacagucuauucucauggcacaacucacuccacaccauaugaaacuaacugcaaaaauggucucuaucacaacucgaucgcaguucgcaaggggaaagucaagacauuuguugaacuccaucccuccuugccgcucucauuaauccuggccuuuuggagagcucucuguacuugaaggugggguggauacuuugcauuuuuauguggccuuuuuugggcagacggccccacagcuugauagggaguggcauuuggccggagccagcuggucucucugucacgguuccugcaccccuguacgugaagugauuguuuagucagaugggauagcagguggggcugggaaagucagcugcagcuaacaggucagugccuccugacagcucgugcccuuuaguccuuucagcaccuggccuagguuuggucagcgagcagacgaccuuagccgaucagagcugagagugcugaaggucccuaagccugcugcugugccuccugugcacacuuauuuugcucuuggaggcaaaucacaguuggugauccugagaacccaaggcagcuuauguuuguuuuuaaggcaucaguuuuccuccagcagcauuuaguaagccacacacguuuccuuccauuagaacaaaagcagcaaaccuuagucuuugaauucacguuagcucagucacucaccgugugugugcagcuuuauuuugguaucuugucuaagaaagacugaagcauauauuugcagcucaugugccucuugauucuuauuuuuuaugagcauggagugugugcccuacuauuaccaugaccuuugugugaagguuuuuuguuguaaauuacaugauaccccuugggcaucagggccaugcugagggcacaguucaggaaguugucauacugacuaagcauagcagguaucaagguaauguccuguaaacaaaaugccuucuccagaacuaaaagagaagaguaauuugaaccuucaggguaaaguaacguaaggaaucuuaaaucaggucuuugggaucuuuugccaaccuagguugaaacacauacaaauuguuugcacuucuaugccuuaaaguuggugcagucuggugaguuacaagccaaggugagcagggugaggggcugggcuagauagcacucaccuuacauagaacugacucuugggacaaacugucuagauggcagcagccacuuggcagggguuccauguggaccacagcaggugacuuacacuuaaccauuuacuuagacacaugagcuaggacgagaaaauggggcuucccuuugccugcccuuuggcaucucuuuuacuuuuuugugucuuucugauuauagcucccugccccacccccuggugaugcaaucugacaagcuaggcaauaaggcucuaggugucuacguuuuaaugacugguaguggauuuguucacgaugcacaaaagguguggcuaugugucuguccuuccaucuugaaugccuuugaaugguguuucauuucauuuccuuccuucacuucaaagucucuuccagccugucguaauuggaauaucaacugcuuguuucaauagaccaaaaacuuguaaugagagcaagggagggaagguaaacaggagcauccuucucaucuccgggccccaggaaugguagauccccauugauuaccagugccuaaccaaauuacacaauuaaagccaauguauguuuaagugagaaaccccauucugcuaucagagaggugcuaaugaaucagacuguuacugugguuguguuugcugggcuucuauccuuaauuaagcaauuacagggucugcugauacuuaugaauuccuuucagauguuuuaauugaauugcaacuuaauggauauuuguaaagugggauauucuuucucuugggacuucccaguuuggaugucuccucugccuguguguuuucaguugggacccgucaccugaaauaggcaguuugacaagagaccuuccggagauucuguagcuauuuauuuauuuuuaugaugaagagcaucccaaaaugucacuuacaggaaauuauugccacaacagguuugggcagcauuugugacaaggcccagaguucucacaaauuuauuacaagguagguacauaaauuaacaagauaguuuaugcucucaaauuaacuuuuaauuuaguaauauacacagccauauaaaaccaaguaauaauaaaauuagaauuaucauaaaugaaagcagcacaucguaagaauugucuuaguuccuuuuguguuguggccaugacccagcuaagcugagacugguaaugcguauggggaagaaguggauucuggcucucaguucuggaagccgugucaucuaaaucccgagugguaccagcaucugcuugcuucugugggaaccccugcugcuucaacucaagguagaaaguugaagggcaaguguauaacuaaaagagaaaaauuccgaagagcagggucacuuccuaacuccuacuccuccaguaaauaauccaucccuuaaagucccugccugccaacacugccauuguaccaguuguauuucacugggauggaggggugugggggaggguaauacaggauggcaaacccagaugcaaagcacagcaaaagagcagaggaaagaacaaguaauugagggaugaaaaaccuuccagggaagguagcagaagauguggagcuuuucuuuuggcagauuggcuaucuaggcagaacauuuuugccugucucaguucucagaagaauugccuuacgaaaaggaugcaguccucaucgcugugucugcuucugugggacuuucucaacaaacuucuucucaaaggacuuuccucccauugagcuucagugcuguggccucagcgugaagucucugccugcucacgggcaggugaaagagcaaagccucuaacuguaggcugauugucuaccuucucaaucaugaaccagccccagaaugcacugccucauaacuuaugagacauucauuggcaugguuauuuaauaauguuuucuguccucugggcaccaucuuaaggaagauagaaaugcaugauaaaguuggagccuucuagcaggaaggaauguauagacauaaaggggaacaaauauuuuaaggauaggguagcugggcuguucagaucagucaucccgacacaugagcggcuaaggcaggaagauuggcauaguuccaggccagccuggaguacagucucaaaacaguaauaauagcaaacaaaacaugagguaggagaaagagaaacacaaccuuaaauuacaaacagaugagacucacuuggagauucugaaacaguaaauaagcauugugauacucuuagagagcuaaccguccugcucugaaacccagaaguucuagauucagagaccagugggacagacugcuaguuugggccaaggcaggguacccuguuccauaguauuuuaaugguaugucaucuucagugagaauggaaaugcccguaucugggaguggaccauagggcucaaaggauaaaauaguguuucaggagacaagagggagggcuucaauuaguucaauagccacuucaaauauuuuucugaacaaggcaaaguaauaaagucaucaguaaaaauaaaauuuguucagcauaguuuaagggagccacagaccuuguagcugaaacacuuaaggauucugauuuucagauuccucaacaauuguuucauucagacaagccaaauuaucuugguaugaugauggugaccagggguugaaggaaacagcaaggcccuauggcaauucugugucagccugugucagccaggggcuuuucauuguggaacccucuguggagugugucagacuucuguggccuccaagucaaacuguucaauugauccugucucacuuggguucugugugccaaagaaacauuguauaauccuccacuuggaaugccuuuggcugaucgcugggaagauuccuucugaacucuucgacuucgcagaaggcugccagugcuuuuuguggucuuauuaguucagagucuugguuuaggugagauaagggugauccuugguagaaacaaaaccugucauucacagagaguacgagcccugagaaggagccagaagcagggcugugugcuuuuuccuuuacaguuccuccuccucuuccuuuucuacuucaacaaggguuccuugcugaaucuucuuagggcagggaauggugaagaggaaguuuccagggaucugagagguccauuggcauguguucaguuauagcacagucucucugguugugcccauugcauuccauggcauuuucagaauacauuuugguagaggguuguuuguuguaguuuucucucagcaccauuacaucagcuugcuggcauuuucuauuuaccaacuagcacuggugaaaaggcauccuagauuaggcuacucuccacuagccuagcuuuaugagggagucugcuuggccagaaagauuauagaagcagacccuggaugaaagacaggaaacauaaaaaauaauuugaugauuuaaaacuaaaaggaggaaauaauuugaugauuuaaaauuaaaaggaggaauggacggauggcucagcagcuaagugcacuuguuugcagauuugguucuagcacccacauggcagcucacaacucucuguaacaccagucccaggggaucugacacccccuuuuggucuccacaggcaccaagcaaacacauguauguagaccuacaugcaagcaaagcauauauauaacaguuaauaauuauuuuuuaagagaaauguuaugacauuucuuguagugaguagccucagcaugaacaguacacacuacuuguaagaaguaucuugguugcuaugagaacugccucucaauuuacaucauuuaaccuguucauuauugaacaaugaaauaaauggucuuggcccuucucuucugcccuaggucauugcuccccuugcagcuuguucauaaaguugcuggggucucuccaacugaugucuggauuugcaugaaauuguacaguuuguaugggagcuacacacuugaaaguugccuggugugggccaccaugcgcauucccucaguuggccuuuacaaggccucacagacuuugacucaccacgcaugaggccaccgaagcccugggagcugugccucauaggaacauuccuauucugacggagaggugccaggcaucgccccauaugugcagaaaugaggcacagaagucccugucauaugugggaagcaucugagacaaaugcagucacuacugaagcuuuuuuccauuuauuucaauuacuuagagguuuuggaaagguuuaaccaggguuucuuuucucuuugccuaugaaaaaauaaaugagaaguacaucuucuauggcucccugcuaacaggguucuaaaaugggcuguggaagaacuugacauuggcgcucucaggcuucccuguguguaguccucccuucuguguagucuaauguugcuuuacauagaauucccggauaaacacugggacuccugugcacaccuuuacuguggaugaagguggcuaagucuaccagucagcagacuagcagagaagucccuguuucccugcccuugugugccuccuuuuccugagcuuguacaucugcuagugauuuuucuaggguuaauuuggguguuuuuauuuuuaaauuggaacauggugucugucucuucucgguguguguuuuggaugcagccccugugcuaggcaugcgguuauuaacuccacugauacgccaguucacucauuagcauuugcauuuuaaauuacaagcuagagcagacgacauuuaugcuauauuuguaccauugccuucuucaugaaugauguuguaugugcagggaaugcagaaauaacucuaaggcccugauauauuuuagucuguuuuucagcaaacugcuauuucuuuuuacucuugauucucauuguuuaacagggaauuuuuuuuauucuuuuccaaguuuagauaugcucgugagugcuacugauugggaaaugguaacaacaacaacccuucguaucaaaauaggcauauugcguagaguggccaucuuucucacucaugugguauuccuuguaagcagccugcuuugauuugaagagagcagaguuuucuccuucccagagcaguggguggaagacaugguaacagauacuuguucuugccuguaucugugcucccauccccccuuguaaaagccagugguuacuuacaccugcuauugcucagcacugcaggggaagaaaagaagaugguggaggccuucgaaggguuagcauuuggacuucacugcccugcauacuagaucgugaauugccagcacagaaguagccccuuaagaugagaggugccagcaguuaaauccucuugcccagccccugcucaugguagauagcaacuucaucauaaagaucucgagaaccaaaugaaaacugcacagucauggacugggaccagagccuucccagccucucccagcucuuccuaaccuggagcuugcugauuaagggcagaaagcuugcauuggcugaucagcacacauguagugcuuuuucuauaauucaauaucugauuuuguuucuuuaaguucugacuuacagggaccuuuuuugguaaaagaccaguucuuuuacaccccccccacacacacacacacacacucacuauacacuuuuaaaauaguguaaaagggucucaaaugcauauugcaaaucaaggugcauucuggguagacaaccaaaauucugcaguugauauaaguaauuucccuuauuucuuucuaaagcaagcuugcucagucucucucucucucucucucucucucucucucucucucucucucucucucucucucucucuccucugcuaacuaauuccugaguaaauaagauauaagcaccuacgaggcuggugagguacaagcuuguaauucacuaacucagagccugaugccugcagcugggcaugugcucucuggcugaacauugccugcuaugugcagggcuuugagccuagaccuuagcacuaauuuucaaaaauacaauaaaaucugucuuauugcugcacauaauaugucauacacuaaguaauaaaagacauuacauggccuggacagauguaauucuaagccuccuuucaugaugguaugccuccugcuaugaguuugaacuugcgguaaguacuaucacaucauauuuaucaguuauugagaggauaggccuaguaaaacgaaggucuagacuagacuuggcuccuuugguuucuucaucauaguagcauuugagccguauuacuucccuaacuuccacuucacauaucugauacaggcuucugugugucuucuaauuguaucaguuggucuuauacacaucuuaccugggcugggcugaaucagaguuuccccuaggaaauucacacccagcaugacagauacuuagguucaccaagggacuccaaaguccagugaguccuuccauguccauuucacaguccaaguucugcugacucugccacaugccuuugcaucaguucaucuucugugaacaaaacacacaugaaguucucuaagaccuuguagacagugugcagcagcuugggugauaagugcuaaccuaacaggacacucugaauucaauccccagcccucuguaagugaaggcagaaagaucuaagauugguaugauccauggcuacauagcaaguuuuaaaauggccagccuggacccaacccugucucaacgccugaacaaaauaaaaagguaauggaccagauaaaauuaauagaaaauugcuccauaccucugcaucucuucuauggaaagucccuuuuggguacauucaguguuuaccaccugugagcacaugcauucugugcucagucuuuggcuucuuugguuucuaggccuguuucuuggugaaccuguucucugaaaacaaaacuguaccuuauaggauagccugcauggcaaggaguugguaagugguccccagagacaucaggugguaaggcaggacagaagaccuuugcaguccacuugguugguauagcagugggcauuaguaacauuuacagaugcuacuuaagggugcugaugaaagcaagacagauagcucucuaaagagcccagaaucccauagccugccuuaguucucuuacauuggcuauccauuugaaaugcuggcuacugccagccacuccccuuccugcugagcagguucucuacgaaaaggagaugugccauaacugcgucccggcauccuaccucguggcucucugucccugccuccaauauauccuggcuucugacagaaaccuugaauuaaguggguuaggaauaaacugcuugacugcgugugugcagauagcuucucucaccagcuaucugaagugcuuuuugaaauacacgggagcccuuuguaagcugcuuuauaagcugugaaguccauuguugcugcucacugcagccagcuuggcucuacccuaaguaaugucuccuuggcuccuggccagggcuggguauugcaaacucuaguaagcaggaaagucgcccaccagagucacuagcagcuguugcagguuggaggauuugcagaaauugagauugcuguucccagauauuggcacuugccuggugaugaaugaccgacucugugcaaggggacucuguaugcuuuccuucagccuuuuauucucagccaucuauuguggcacccacucaauggccccguuguggaggaggaccgcuaaaugcuggagugaguagccugccucugccuccauucccuccuucaguuggccucaacugagacauuaagaauagcucuuugauccccugaucugauucuggaggcaggaauuucuugggcccuaacacaaaugcuaagggcaaagaauugaaccucaagagagaugagaaaugaccuucaccugauagaaucugaagugaauuccacuuucauuaccccguguucuuaccuuaaccccuuaaccccucuacaccgggauagccugggaggggagaccaaagaccugcaggggucuguucuuauaaaaagucauuagugguaguguauuggucucuauuaugguaacccaagaaugaaauucauagagggcacuguaauuucuuauuacauguauucaugaauauucauggaugcauaugcugaaacuaguguuuaccaucuuucuggagaccagcgcaagcaugagugaccucaguuaaggcaugucuaacucauugcuccagucccugccaucuccuuaucauguuacuauggcuuaagucuguaagaugcuugaagacagggcuguuacuggucuugucaccacuuaauuccuuguagcaguacauggauggaguagugcuugaaccugagugagugaaugaaugaaugaaugaaugaaugaaugaaugaacugauuaaccuuuuugggcuagagggggcagguauaacauuuuaauuauuuaaaauuucagaaaaacaauccccacaguguucccacagacugguaaagccauagcaguucugacaucuaagagaccaaacugggugucuuaagagaaucagaauaaugcuggcaucugcccagaguuacagaacccugaacagguacauuagcuucuguggccucuguuuuuccauagacuaaauggguuggauuuguuuucucugguucauuacuguucugaucuucuaauacuagcuuuugcuuaguggguauuuacuguacuuguagauuuagcuccaaccacagcuuucugagguaauuaacaguacaaucccuauuuuacaaaugagaaaauugagguauagaaaaguauauuaaccugcuaaauaacagcacguuuucuuaaucuugcuuuaugugcccucuuuuagaauguagcacccauauuagcaaugaguuacccagcucucaccucuuauauuucuggaggcaguaagggggguuccagccuuugcucauucauuguaucugccugugcccuugcuggcuagaaaccaauccaauagugccuuucuugugguauaaccaaaaacaaagcucaaaaagacgauaacagccaccccucuugggagauauagucauggagauacacguuguagucaucauuuggggguuggauuuguuuucuuggcccacaaggugacaccaauaagaacauacguaccuaagagagcauggcuaggacaugugauuguggaaagagcaggucagaccugugggauggguuuaugagcuggguguuuacugacaaauuaaacuuuagcccugaguaagcaaaguccuaagccagcuauuacugccaggacacuucuaaugggcccugugcaaccuuuauaaauuauucagcugcucugcuaauaaaaggccaagcagcuugccugguccuggugguacuuacguauagcugagaacagguuagaggaacagaggaucugcuguccaccagggagcccuccuuucugguuuggugguaaagggguuaaacagagggccuugagaagugguauagacagagaugguguaaaaauguuaacaguguugauuaacaauacugcuaagcagucccagaagcuuacacacaguacaugguuauaaccugacauagaagauacaguuuuaaaucauccagagauuuguuuucccuacaagcucuuguaccuuuuuauuuugauauaauuuuaaaagaaaaguuagaaaacaaaacagaguuucuucauuuguucauuguauuguuaauauacugguccguuugccaucuguguuuguaaagaucagaagauuuggugugagugcugcucagaucaauaagaaaugguuugguuugguuucguucauggucccuacuucacaauugucaugcacaggcuucucuuagcccuggguguuuguucacaagggugcaagaucuggaaauaauaacaugaagaauguaguuacuggccugucuggaagccugugaauugagugugcauguccuagaugucaacauguuugcugucuaaguuauuuuaugcuaccacuagauaugguaggguauauauagucuuuauauuucaauuaacagugaguuagaaaugugcaaaaugauucuuuuaccugcaagggaguuuggagccuauuguuuaaugguauuccaaaaaugccugggauuacuugaugaucauaaacagcuagacucuaaacugcugacagcuagcuuaccagagaaagaggacucuaucaagccugaugcuuucaauaccacuaaaaagcaugacuagaagccagcacauuggcuccaguaaagugcuugggguccaagccugacccaaguccuauccucagaacucaugauauugaaggagagaagcaacuccacaaagccgucuucuggccgccacuuguacacuuuggcgugugcaugcacauauacacacagugauaaucuuuuaaaggcacagauggcagcuaauagucuaggacuccuugucuggaauuucaugguacaagguauuaagcagauuuuuuuucagcuuugcacauucaugucauuuuugcucuuccaacccacuucaugguacaucguccagaauuuuugcugagaugaauaccguauuggaauguauacucaucuucuucauugauuauguuuauuucuuuaaauaucuucauauuucuucaacuauuccuuuuucucauuucucagaaugaucuugguuucauaccagcaaauaguggaaacacuauuaacaucugccuccaggagcaaugauguaauaauggggcagagguguauaccacacaugugaggggcaggggcagcucucagaagucaguucuuucuugccaccuuacaguauccaagaacucaaagucagguugucagccugugugaaaaugccuuuguuggcugagccgucucacagccuagucacaucccuccgcgcccauugcucacugucccugugggguacagggagguuguugcuuugcauugcagcagggguauuucuuguggcagagcugguagacgcuuguucugagguaugaaaugugugagagaugaacuagagcuaauuuaaaggacaguucagcggaagauuguucggauuccacugcuuccucuuagccgcauagggcaggaaugagcugagucucauugucugcacuucuguaggcuccaccccaaaaaucuuggagugcaaguuauagcucuagcugugucgcuuuggauugaaguaaguaguagcugcuguuccuucaaggccuugaucuuauaaacucuucuuacucuuacauuuugaguuuggaaucaagucagcugaucagcaaauugaguugauuaaaucuucgcccuggcauaaauguaauccauaugaguaggagaugacagcuuagaagacagcuugugucuucccuugauucaucagauaaacacucuaauuagaugacagagcucaguuuuaaaguguccugagcucaaaggugagcuagccaagggcuaaugcuaaugucaucgauccagcuccucagaagagcaauuagggccuaaugagcugaggaccaugagcuucugugcuggcaucuagagcugagaagcuguguugacuuuucuuaccagcaucucccaggcaagcuggcuguugagguacauacagucuuugauccugccuccaccauagcccacccuucuuaucuuccuccuuuguugccugggauuauagcuuuguuauguuaacuauuugguuuuauuuguauuagaagcaaggcaagaauaaucucagcagugaaacaaagcaaaagaaguuaaacaagccacuuaaguggggggucggggguggugcugagaaccuugcccaccaagccaucacuugguuuugaugcuaaugcauguggugacugugguuuuccuccuuugccuguguccauccuccaaggcuuuccaggcuuuucaagcucugaggaggcagaggcaagugcaucucugugaguucaaggccagcugaggcuaugcuguuuucuuuuguauuguuuuguuuuguuuuguuuuaaaaaggcaaagggagagagagguuggcugcuccaugccuucaaguugcuguaggugggaggugagcaaaagcuccaccaggaagguuuguggagcacuggcccuuaccaagccaacuucacuugcuaggacaaaagcugacauuucucacaacugagacuagguuucucuauguagucuuggcuguccuggaacucugaccuauuucucacucucccucccuccuuccaucucucuccccauucucucucucucacuguguguguauacaugucugugugugucugugugucucugucccuuucaacuaggcuggccucaaacucagagccucugccuccugaguccugggauuaauaacaugugccacaaccacccagcugaguuuggauuuaucuuuaaggcuuuagauuuuaaaacauaagaaagguuuaaaauucuguuaggaugcuauuucacccacuucacgcaugcaguaucuuaaggauuaagguuucaccuuuagcaacagcccaauuaguaauugccaauacugcuaugugcaucuugggacuaccaguugccaugagaaccuuaacuuuggaauucccugacugauuugacaugaacagugcaauugugaaguggggggaggagaagacagggagcuggugaugaaauaaaucccuguugucucguaaaucaccuggaguguuaaacucuguucauucagcucucccaccuccugcgaguuuguuuccucuaaauccuucugaaggaaggaaaauaguuugaccuuuauuugcaucuaacuuaaaagcaguucaaguucaauacuuagcugggagauugccuuuaaugagccaaguuuaaaggaggagcguuuuaaucucuuaauguuugcauggagaugagaugugcauacacaguaagaaaguacguucccagcuuaaacuauugcauuauacguuuaaaauggaaucaccccucccagcagcauggcagagcaauuaacaacccagggagaaagcuggggguggggguggcaaaaaggcaccucacccccagcaugcgccccuaugugaaagccugauuuagaaagacacuccucacuggguaucacagaaggcaucugcacuugcuuuacacagcauccugagaaggcaauccuuguucuguucccagcuccuucucuucugaccucccuauugugucaggaucuggccccagcacuggguuaaaugcagguuagauccucagaaggaggacaaggugcuucucucagccuuugucagcgcuaaugccagcuguguuuggugcuccaucacuuuguuuuuucugucccuuguuauuuaauggguugccuuuuaugcugaauagaagauaaagaggcugccuccccuucuccaauucuucuagcugugcuugaaagacaaauggagugcugaguggggacuucuugguuuauauugugaggugaaagcuuagagggacugguuaccaggcccccagagaguucugguauccugugaggccccacauuggggccucauaguuaggcuugucuucccuguaugugaggacuagggcauuucuaacauauuuccaguaauaugaacauucauggcucaggucacuuuugaguagaaagggucuaaccuucccucccuugcccuucuuucuucuucuagauuugaaauuuaggacauagacacacauagacacacuagugagccugccuacucacaguaguuggagguuggaccuucccauuuaucaugugaagaauuuccauauuaaauuuuauauggaaaucucaaugcucauauuaaagaaauggacacacuuuguagggcucauugcaaagcauucugggcuggugugucauucuauccagaccuugcugagcugugauagauguuuucucccuugaugccuguagucagguagucugugaacaacaacagaagggccaauuagcuugcuaccccaaaguguauacagguagugcugucuguagcaguggucugaugauucaaucucagauauagauaagauuacaaacuuaaaagaauuugaccaguuaugguggaugcucucaaagaaaccaaagauaaugauguuggcaaagauguagagagacuggaacccggacccuucugaauuguugguagaacuguaaaauguucuagcuacuguggaugacaauauggagauucuucaaacuauggauauuuuuuuaaaguagggucucauacuacuagcacaggcucacuguguagccuaagaugacauucaaauuguaacaggucaaaguauguacuaccaccuccaucagcuuccucagaaacuugaaaaauugagcugucaucuauguagucuaucauuuagacuucuggguauauacccaagaaauaaaaucagaaucucaaaaaguaucugcaccuccauauccauguagagccguccauaguagccguccauguaguaggaauauggggugcuucagguuguccacagcggcugguuaugauuugccugaugcucuagcaggacaugauuuuuccagcuacagauaauuucuuugauugugugacauuuggaauucuggagauuuuucagaugguauauaagugcuagggccccaaggauuggugaguaggugguuguuggugaugcuggucacaguuuguuaaguggucguccacagugaagaaagaagaaacuagauauacugacacaaaagaucaaacugaucccaaggaacacaaacaccacuaaucagcaggaaauaaguaacaauaacauugcccccuuucagaugccugcuauccuuuuuucuuuccuagcuaguguuaggggauuggaaggauggaagaaaaaagaacccacaaaguagccaaaguccaccuacauauggauaaauaaaacaugauagaggcauguaaaggaauguaaaaggaaugcuccuuuuaagggagcgggggaguccugucauugucuacagcuagaugagccaacuuugggguccuugugcuaggugaaauauggcagucaguugccagaggaggaacacuauaugguuacacagauaaguagguaaaauagcccaacacaugacaaauaaagugaguggugacugccaagugcuuaaagaaggguaaaauguaguugcauucaccagcucucaaguuucaguuauuuguggugaguagaguucuggguuucgacugcacguccaaauaugagaguagaguucaugauacauuuucuuaccuuauuaagagaggagucugcagccagacauggugaucccuauaauccugccaugcuagaggcugaagcagaaugaccauacgcucaaggccagccuaugccuuguagagagauguugucucaaaacggggcauuggaugagcuggacaggcuggaggauuccuucuaggacauaaagaucaucuguuuggaacagaaucuguuggcuaaaagccggagaugagaaugugggacugaaugggucaaagcuuccugagguaaggucuucuuauaauccuagucccaguucuucuaagauaggauaggaucuucccauggccccagguacuaauggauaagcaaagggcuacuuccucuagccaacuagccuuccuuucuuuuccuaguccuacuugaguuuauguguuaaagaaucuacuuuugcuacauugaaggaaugcuccuguugaaacuucagucuccacuuaagugcccuuucucguguggauucuucugacucuuaaugaauacuaacccuuucccauugucuauuuguccaguguucccugacauucuccuauacauuauuaaaguaggccuuuuccaacagaccuucgauuccuggucuguugcuuauauuugcuccaagccuaauagucccugacuuguuaucauuauuuaauaguuauguugccaaauaaguacaaauuugccuacuuuuuaaauuguuuaaagugagaguccuacugcauagccaaagcuagccaggaacuuaaugauuucucugacuagccuuacagaucucaggcauguaucacaguucuuugaagauagccauuuucuuucaacaggaaauagaaaaacagggucuagagagagauagcucaccaauaaaggcuaagcucuaaaccaaccaaaaagaaaauaagaagcaaaaaauuucuuaccugcugauucauugcuugaccgcuuuggucuuggugucuuguuuugcaucagggucuuacugugaaacccugacugugguuuuagguauauagaccaggcuggucucaaacucagaggcagucuaccugccucugccuauccaagaccaagaccaaagccuuguuuucuguugguuauccuuuccugaguauuuugguucugaaguuguauuuguggcacugacaugaauuucuaagucuccagagacuguuguaccugcaggagugaagacuaaacauaaaaaucgucacugacuuccagagagcacacagcagccacucagggugcaaauugauggaaccagcuugggaacaggagcaagcaaacuugugugaaacuaucagcuuuaggcagacaauuaagaacucuuagcucucuuguaguuuucuugccccauggccuuaacugccuccagagaucccuaaacagaucugucagccauggaggaaagcagcuauguuacauuuuauggauguuuguguagcuuucugugcuaguaacucauuuuugacaugacagcuuacaaagauguagauuuguuuucugaaguugcuuaucaaaauugaaagugucagauacccgauauuuugaggccaguaauuagcugggacauuuuuacuuauguagaugccuguaaaacaucuuuucuguauuaacagccucuugacuguuuucccaaggcugggugucuguagcaugcuuuaagaaaagcaaacuauugguagagaaggaugucacuggagaaaggaguuggcugccugccugacaaccaaggugugcgagugggagcagaggcccugugcuggaggccuuuccuccccugacugcacucaggcuccuacuucuccuccagaucuucuaguuuaaggcauauuucuucuuuauuucuucuugcuuuuauuuaccccuauuccccccccccccacacacacacacacacccaguugaaaagagagauaguaggaagugacuuugaggagguucuaggaaucagaaucauggcccugugcauacuuggcacuuccucuacacugaguaccucagccucagucaguggacaucuuuguaugugugcugagcccuucaucucacuuaacucacacugcgcccuuaguugauugauugucagaauauuaauugagcaguaagaagaaaaguccaauggaacgugcuucugaugaaccccugucccauccacagguucucuuuccuugaguuggaagcuauuagaaaacaacucguaugaaguuucauuucuucagcaacugcuuaucuaauuuggcagugaucauuuccuccucuguucucuccugcugcugcuccaggcucagccuuuucaguguuacccgcugccaccagggggggaggaggggcagacacagauuuaauuuuaucagucaaugauuaugaagcaauuuauaaguuuggaauaggcaacauuagguucaggaacaguauuagcuuugccuggaguuguagcugaguagcagagcaacugcuuggcuuuuuaagucaacucuccuauaagugcucuauagaccaaaauggacuagccaaauaaugcauacuggaagauacuugagguggugggacaaguauuccaguagcaagaccuaguagagacccaccuuuccuucuccuugguauuuauugacuauacaccauccuggagaccacacuacacaagacagcaccuacaguaaguuaacagugggacugucuauagagguagacacugaagaccuuagcuguugauagacaaaccucuccagaaugcugaguguaaacuuccugaugcagaagccuuugaaauaccuacuuagguaagauggugccucccucccauuccuaucugauuauguuucucugguuaaacauggagcugcaggucucugaagcaggauuaacagagacuugggcaaagccaucugcuccuuuucuuucuuagguccucauccuugaauguuguggccaggucucucucccuguagaaucucagacuucuuccacaugaccacucuccaagaguuuugaauuuguguuggcagaaguuaggaccuggagaguaauauuucuuguggauuaauugucuguaauuauauuguaaaauaauaugcaugauugauacuuaauauauauccaucuccagggaggugaagagcuucauugaucugaagagaugagccaguugauuucuuaggagcagagcuugguacuguccugaucauaaaggcaaagaguaggcaaagguguacaaacaaacuggauuguuaaggaugcuguaccaagaagucuuccacuggacagaccucaggaaguugccggucucuaggauguucagggcagcagguggcaacuggcacacauccucuuguuucaacaacacugauugagaaugcaucucccuagacuacacaggggcaugcugauggagacacuccuugcccucuugccaaacccacugggaccuguuugaaggucacuggcucaagagcagacucuggcaguucuguaacguccccuccccucccuacugcugcguguagccucucagugugggugguguccacagaaggaggaugccuuauuuauuuuggguccaugagcuugcguaaugugccuauuuaacacucuccuaaaagcgcuuuuucagcacaugagcaaguaacaaagcccacuaaauccugccucuucugggcacagugggcuguuuaagguuguucccgccgcugaguauuuauggacaggggcuggaguuaugacauuuaucucuguugcuuagggcacugauauauaucugccugcaucucccacagagagcugcaccuuaucuugagagagagagaugagagugcacccauaacucaucuuggcaucagacugccaauguaggaaaccacuucaccuccuguucacccccuggccagagucucugggugggaguagggacagaggugcacauggcuguacacaauggagucuuugguaguaaaauuaucuaggacuuaaaaucguagggcacaaaaacuacagcucuuaauagacucaccgucagguacccugucugaacuaucucuggcauauucucaagaauccacauguuugucaaaucuuuucguuccaaccgugcuucacagucaugagugucacuggccuguuuguccauugcaccuuuucuauauguucagccacucacagugugugccucacuguaaacccugcauuugugagugcuagcugaagagaaacccaggggcaaccccugccagcucucuaccccaucucccccuauguggcucuuuauccuuucugagaugggauuuucacaccguauguagcuugauaucucagaaggaugcauccaacaacaugagcaauacugaauaaguaccuucuguaggagcaaguauuuguuaggaggaugcuugucacaucacauuaguuggcauaaugaacaucugaauacagguggggaugagguauagccuaucuccagaacuucaugugugaaguaagugaaaagauagccacgagagcuguuggugggucuaccagcacuuacugcugacugcugcagagcuccaaggauaaccacaaagcacaguaaagagcagauuaccccuccucacuccaggcaugagcacugugguucaagcuuuguggacucacagguguaauuaucagugugccagcauggcuguuuuugacuuguuuguuuguugguuuguuaggauacaaauccuuauuucugucacauuguaccacauuuggcuuaguauguuuuccuccucagaauccuaggccuguggaggcagagucuuaucucaugcauggcuuaggauguaauggucauuuacucuauagugaccauuucucugaacagggaaaucuugggaggccucauagaaaccuugcaucucucagccuguucuucaaaguucaggggcaguggaacaacagagacuggauccacaaugguccuguagcuuuauaccuagcuuccuucaauuaaguccaaaguaauuuuucuucaaagguaucuugccaaguugucccuguugcuucuaagcugugugaagagaaauggcagugugaaauccauucaacguccgguagaggcagcagaauagcccuuacuccugguaacccuucaggagccucagcuuccuaaggaacaccugcccugugggaaucuugaccaguugaauggccagacuauugggagagugccuuuguugaauaaaucucuuucccucuucuuguuccuaagaagcaaaaacugcccugccauccugaugauucaaaauagggacugaugacauggccucuagucaugcucuuuagcgggcauucugggaaguguuagacuagaaaucccuuucucugagaguuuacaucuuaauccacagcaacaaggcagagagagagagagagagagagagagagagagagagaacacugagacucucagaaggccuugagugacacaccuacuccaacaaggccacaccuccuaauccuuccugaacaguuccaccaacuggggaccaaacauucaaauauaugagccuaugggagccauucucauguaagccaccacaguagaaucucuugaaagaacaaaaauuaaagauccaagcaaauucaagcuucaguucagccacuacaaacgucaucccuuucuagucauguggucuuucagcucagcaguuuagcaugaaagucuucugaauauuucaguagauacucaguguucacuaaugcuuuuacauucuuugcagugaguaauuuuauauauguaauaguucuguuuucauuuuaacuuucauucuuauuuuacugaggaaacagcccagcucuagucaugcaugguggcccugaagcacaaaacuaggauagacccugacacuuugcauuugaguacaaagguagcagggauauuaauaguacagucuugcagaacugugguucggguucccaguagaggucuagucuugugugugaagguaucugaggccucuggauaguauggcgucagcgucucuucuuugcuugaugcucugccuuguuuuuggcugugcuucugcucagaguauuggcucauucucuguggagcucugccugcugcaucuggaaaaaaaaucaagcagagcucucccugacagcaagaucucauuccuucccuggagccccuugcggaaugcaaaaauaagggcgagccacaaaagaguaaaccuccagacaacauguuagaggcauuagguaugaggauagaguagagcuagugacaucuguggccccagauucuccacauacaugggaaauguagccugaaaugaaaugagagugaauguucacagacaguaagagagggcauguagccugcuagcguguucacgcauuaccacccucagugcaguucuagagcagugcucaauuagccaauuaauaaaaaugaauaugccaucggaagccacauuuguguggggcuuuuuguugcuguuguuaaauuggcuaauuuaacaccaaccuaggaugguagugauguuaauagcagcagcccacgaguucaggagaagguggagugauucuuagcagcgcuuuuccaggcauugcuguaugcccuguguccucacucugaucaaguggaauaagguuuaggcauagcuagauaccuggugguuguagcccucaggacucugcaguauggcccgacaaauagagaucugccuggguccuggggaugccacucaggcauuguccucacacacucuaucaaaaucauuuuucugccauccacauagcuguuuauuauuuaucccagaaugcccugcuaacaguggcuuucuguccacagcacaggacaagcugguucuugcucuggccuuccuauccuucccuguguugcccucucuuguagccuucuguuccucccacucagaguacuccugaguugagaccuuugcauuuugcaggauuuucccuggguaacucaguucccccguuuuuuggucagguauucucuuucccauagucuuccuaauuccucuuuaggauugcaaaacaagccucagcacccugccgugacuaauccccugcuccugucuccaggacugccaccaccuaacacagcauguaagaaagcaaauguaguauuagaaccuaaguucuguugaacauaaaaaaaaaaaguauugauccauaauagguagaaccuauuaaauauuugcugaaugaguacucagugcuaauuuacuaauuaauaugcaguauaauccccuaugguaugaaaauaugggaaaguauguccuaaguauaggcuuuuauuucuuucuuuacuaccugcuaagcaucaagaguccauuuguguuuucugcuccuacccuuuuguguuuguacccuuucuuucccaucugaagcuguggcaugggaaagucuuuacccuagaaugucagucuucuguccuccugaugagaaugagccuuccuuggagcauggaagcccgcauguguguacagacacacuauugacuuuuucagguaguuuaguaaaucuguagguaaugcaagauacguauuaucuacuucacacaauuaaaaccucuugguuacuauagugaauaauguucugauaugcacugaucucccuugguccacaagcaguauguaugcucuaaggccuagaguggagaaaugaaaguggagaaaguaccaaauccuguguacucacucuugucuuuauaacuacugagggcaagguuuauuauacaccagguagaaaaagagaauaacagcaauaagcagucacaaaauagaaugccaacaugcugcacuuuccuaaaugugcugacugcggacucaccucuaauccucccucccccuuucucucaaugucuuauuguacuuugacuuuuucaucuagagguacuucacuucaucucugugacauagcugaguugccaacguuaauauucuugcacuuugaagccauuauuuuuuaaauuuauuuauuuuuuauuagauauuuucuuuauauacauuucuuuuuuuuuuguuuguuuuuuuauuuuggguuuuuuuuuguuuguuuguuuguuuguuuuuuauuuuggguuuuuuuuuuuuuuuuuugagaaaggauuucucuguguagcccuggcuguccuggaacucacuguagaccaggcuggccucgaacucagaaaucugccugucucugccucccgagugcugggaugcgccaccaagccccggcuauauacauuucaaaugcuauccuauacccuaccccccauccccccgcccugcuccccuacccacccacucccacuucuuggcccuggcauuccacuguauuggggcauauaaaguuugcaacaccaaggggccucucuucccagugaugguaaagaagagcuacuugaacacagugcugcaaucccauggcagucagagcugaucaccacgguggcugcuacggacagggcagcacacuccuagacugcugugcugcaugaaacuuagaggaguuauuucugcacauuuucagcuaauauauuuggcuaagcagggaguauugcuaccuaaauauauuuuuaaauaacuaguugcaaguuuuucguacagugaaagcaauggcauuuacuuauacuguacaaaugaagcuacgugauaacagggucuagauuuagacugcuucacucagcuacaugaaaagcaagcuuggaaaaugaagaaaccucaagaugauacaaaacaaauacauuaaauucuugauuuuuuuuuuuuuuuuuuuuuugcuacuguuaaaaaguaccaggcucucauuuuugagaaaggagaaaacaaaaucuagagccaaaacaagcagugugugaauccccucugccuuaggagaccuucucaucagccuccuucucugcuccugccaucgccagccccuguguguucugaugcuucaguucuagagucuucauagguuuaugaaagcagaaagagugccugaguuggaacaggcucccccccccuuuuuuuuuuuuuaaccagaauaauucagcagcacgaaugcccggauccacucucagcaggccuuugagaccuaccuggaagcauagagguagauuuuaucaagugaggugagccagcugcccaucaagucaaaggcagcccuuucaaagcuggucagccugaccagucuuagcagcugcuuugauggguagaaacugauccuauaagcauauuaauagaauacugcauaacucagaaaaaaaaaaaaaaacaugauaccuacauuagugcacauaaggugugcccuuucuuguuguuauuaagaaguaaagguaauuccagagagugcuggcauagcccugaaaagcucuuugcauaaggaaaugauggauucucucauuccuuagaauugcucuacuggaaggaagauggggagcgggaguggauagaaucgaauaaauuaagccuugaaaccuaaauugugcuggguaacugagcugacuacaaaucagagaaguguuugcuaaagaauacguggacuuaguugaagcugaacgaaaugagacucuuuguacauauguguguauuucucuugacaagcgcagagaguuguugcauuucccuugguugcagacuucuuuggcaaagagcagcauccuuccgugaagaaaaaaaaaacugaagaguauguuguaccaaauggcaaaggguaaccuucaucagauguagacagaacuauuaaaaacaaggagcauagauauguggggguuuuuauuuucuuuuuuccugucaauuuauuuauucauuuuacauccuaauuucagacacacacacaccuccuccaaggcccacccucagacucccacucccccucuccuuuuccuuagagaagguagcaccccucccauuggguaccagcuugcccuggcacaucaagucaaagcuauguccaucuucugccacuaaggccagacaaggcagcccagguaggggaaagggaucuaaaggcaugcaacagacucagaaucagccccaacccccuccaguuguuaggggguccacaugaagaucaagcugcaccacuaucuucugaggcuucauacagaaguuaauggaaacagaugcagaaacccauagccaaacagaggcagagcuuagggagccuuguggaagaguugaaagaaagaucgagugagccggacgggucaaggacaucacaagaagaccuacagagucaacuaacuuggacccuuggggcucacagaaacugaaccaccaacuaaagagcauguauggccaggaccuaaguccccuacauguaugcuuuucuaguuucuacuuuuaaagauuugugugugugugugucugugugugucuguguguguguguacucguguauuuguguucauguuuguuuaugcacgugaggggucugugagagagcuguguuucuuuuuccucuuucauauuaauccuggaagguuagguaguauuauggagcauaagaaacuagcccagugucuuuauucuauagagcaacacugacaaccuucuugauauaaguucugaaguccuuuuagcaauuuuguaagugaggaagcagacacagugaaaagaaguggccuuaucucaguauaagcuguaagcaucauaagcagagacuuuauccacuaaagcuucucacccuucccauugcugcgacccuuuaauacaguuccucauguugugcugacccccaaucauaaaaucauuucauugcuacuuuauaacuauaauuuugcuacuauuaugaauuguaauauaaauauauuuuugaggauagagguuugcaagaggggucaugacccacagguuuaaaacugcuacacuggaguuuucagcgcuacguuuuguacccuagcauaaaguguucuuaacaugccuuaguugaacugauggcucucaccucagaagcaaagcuauauagagcaucaguucaacaccacuaucaucucuuaagagucuguagaaaacuggaguaaaauauauuugaccucaagucaaaacugccacuguuuucucauuuauuuugauagugcucuaccaggucuguuuuuccuuaaguuguuaaauagccuuaagacaaaaggauuaacaaagagauuggaacaacuuacuuuaaguuuuauuuuguuuuguuuuuuuuaaagaagggggggauauguugguccuggggaagccaaaggcaagguguccauuuggagcagugcagaugguuacuguguaagagaaguuaagccuagaguuacagauuucucaaaggagaccauggugacauugggggauuaaacaguucuaucuuaugagggaugucccaugagcugcaggauccuucuacccucugaaacauagagagcaucaguugguuagucucacagcuucucccugacuugugcaucagaucuguugggagucgggaagauuggagaagagaggggaucuaaacuugaggguaugcugcgaagcugaugcccagguuagggagguagcacuccuguuuucaauguaauccaauuuccugaggauggcugcuuccugagaaaacugucacauugaugccgccagggaggguauggcaagaaacaugggguuugccaagugaugauggaguagaucagcucagaaugggauuugugcuuucacaucacugucauuuauugucaucccugcuauccacuuccaggaucaggaagcacugcagcuugacucagucccuucccggguccccagcuguggucugguccucgagcuuugcaggccucggccaagagcacauccugggaucuggguagaggcccuaccuucuuucuggucuucacccuaucaucacugaucugugauauucuugccacacccuuuaggaucaagcuuucucuuccuguuucauacacauccauacuuacuucuuggugugguccacuuuuauaucagaaugugauuacucuucauuucccaagaaaugaaucuuaaaaauacuuccacgaggaagcucuagugaaaucaugagcucacccaucacuacuguggccauuugcagacuauggcuuggacucugauucaguaaguaaguaaguaaguaagcuaaaacuuacgggcaagcuucuccuccuuggggguucauuuauguaauguugcuuucuauucagcugguuuucauguccccuuccucauccauuuggguguuuauuaugaugccuuucaggagggccagggucauacacuucauuacugcuggagcccacgcuuccuacuccagcacuucccgccuuccucuauggggacaaaaggaggagaccaguuuguccuuuuugggugucaaaacaguguuucuuuucuuuuuuuuuuuuuuuuuuugguuuuugguuuuugguuuuuucaagacaggguuccuggcuguccuggaacucacucuguagaccaggcuggccuugaacucagaaauccgccugccucugccucccgagugcugggauuaaaggccuacaccaccacgccuggcucacaguauuucuuuuuuuaagaaaacauuuuaagcuuuucaauugcaaucuuccauugagagauguucuuuauucugccgacaaguugugaccuccugucaaucaaauaucuccaucucucuuuaacccuuaacuuuuagaaguuaucacaacaaaaacuaugguccauguuauuugauaugcauauguauuauaguaaaagccauuuucauaagauuuugaaauuaaagaucauuguaagaugugacugauuauaaaauaacccacuuuaaaguuuuuuuuuuuuuuuuuuaaucuuauauguauuggugucuuaccuacauguaaguccgggggcaaggggaagguguuagaaccccuggagcuagaguguuuuugagugccaugaaagugcuggaacugagccuggguccucugaaagaacagccauugagcugucucuccaggccaagauagcccccuuuaacccuuaguuuccuuugaauuuccuuucagaagcuuugaugauuagacaugcugugauaaugguucugagauaacucacaauuuuaauuaaaacuaaaucugauugauaacaugaaaaucuguguuuaaauauguuauaaagauuugaaguaaucuuuuguuuaucugaaaucauaacaaaauauauugggaagaacaugcagauguuuguuuguuuguuuguuuguuuguucugggaacagggccuuucuaaaccuuagaaguaagagaauaacagacauacucuugugcuuucccaaagggagcagaguagaaauugagagugauuuauugguacuacaaauguuuuuauggcauuugagagcagcuaaggugccaagcgucaagcauuucaccggacaccuuccacauugcuccaaccccaaaggccacuucaauaguucuuagagggagacucuugagacuuucuuagguuugccuuucaucccaaaaugccagacugucuucuguuauuggauacauuacuaacauccacaaaccucugccauguuccucugguuuccugcuuccccugagcucauaugcuguggucauggcagcuugagcuggcuacauuguaaaggccgcaguuggaacacaguaaaggcuuaagcaaauugaucauccuccacaugcaugagacccaaggauucagaagaucaugguaggauagcauuccucaagcuuucucguguguagcuggacagcuaaccugcuuuguguucuccugagcacucacucgcacagagaccugcccuguaggaggaagcagguacuauauaggacgcucuguuugcuccuaguuccauuauccaacaugaauaagaaagcuagaauaaaauaacugucucuuaagaauuccagcuuuggaaguucaauacuguaucacaugcaggcacuucaguacuauucuuaaaaaacaugagcuuuagaguaaccagaauaagcuagacuuuauuuuccucaugugcaaauuauaauagcccuaagcauuaaauggcaaggugcaugguuuucaaaaauacuugauccagugccuaacacaagggaagcuagcauucacaguguuguagcauuguuaugcuaaucucuuaaacaugccaacuggucucuucuugcacuuuggaacccuuuuaauuauaugugagccuaacuguuuguagccuaaaaaaaaauuuuuuuuaaguccacaauaucagauuaucuguuaauucaggaaaggguacccaaagucagaauucugcaagaugaaucaggauuccauucaaccuaaauaagaugaagugcauucggcuggaacugacaggauccaguggaaacacgugccugucaaaagauaggacuuauaaucuguacuuaauugcaaggugaacuuguguaggucauugaacugcucucauuucuaauacccaccucuauuaaaauaagaaauuuuaacuaaagcauuucucaggcccuuugcagccauagaauucugugauucugugaauguuuauuugguguguggugauaccauugcugaccuuuauuuaauagucuaggaaaucuggaaagagaccuaagcacugcugguuucuugggcugaccucuaggaucugagugucauggaccuacagucaggugcaggagcuuccagguccuuuccacgugagcuugcaugaacauuguugacauuugcucuucuaacuuuucaacuguauaugaacuuugucuugauuuuaccuuucucuuuguguuuacaaucucacuguuacacauuugaaagcaggccuucaaauccuugacccaaguguagacuaucacucacauuuuuaaggaacaguugaucccagugcuuaaauucauuucuucaacaacuggguuuuuugggagguggguauugugcuuugucugaguauacagguugacaccugaccugauauccuccucaguuauuucuccacuucuuuuuuuuucuggagacagucuauuaaugcgcuaccuuuugggcuaggcuagguucccguaagcccccucugacaaugggauuucaaagaauauagccaugccuggcuguuauguccaugcucaagaacugaacccugaacucucaaauguauagcaaacaugugcucucugagccauguccccaggucuuccuuuugcaagcugauuguuuugcuguuucuuugcaguucagguuguuugcuaauguuaaaucuuaaauaguuguaggcuuucucccuugauuuuaaagaggaaaagauggcuaccauaaauggacagaaaaaaacccugagaaaacauuguuauucaaaagcacaaaaaguuuaguauggcagugucagggacaggcucagaacggcguaugugggugcuagguugguuggauuguaccccagaccaauuauugugacuuuaacuuaugaccauucucagggacuaauaggaaggcacuccaucuuugcuucaagaaauugaugcacauaugaagauuuuuauccagguuuauuggguucacaaaugcuaguccccucuccccccaccaguccauccuuggcuuguaagauaggaacugauaagaaaagguaagugaaacaguggaagacagcuaaggcauuguauaauauuuuauuugauucuuuagguaucacauaaaaguuguaaguaugcugcuuguugaauuuucaucuguguacaaacccccaaguaauacuccuaugaaaauagaaacuauuucuaguauccuaguaugcucccuuggggcccuccuuucagacauagccaguguucagaccucuuuaaucauggcuuaguuuucucuguuuugaacuucaaaacugaaaucaguuuaaacacuuaccaguuugaccguaauggcgguccauguuaccagauaaauuaagguucuccuguuucauuacaauguccaguuuuagaucacuuuaacuacaguguggagaguagauuugaacagcccugaaccaacacgagcauguguagcuggcauaugacugccauugacuggagaagaguugaggaagccugacuaagugugcagugaccgaguagagcugacuggagaauugccaaguaauguuugaaucucuggaacuuuguuaguuguuugguaaugaaugauggcaacaaggacagcaauuuccugaguuauaaauaauaaaagguucccuuugauuacuuuggaaaccuuuucuguuagaugcuuguagacauuuguagguacagguaaauucagaaaugaauauuagcucuuagaucuccuucaauuuauggugaaauugaagcccagcuguacaacugugauugcucagugauggcagagauugggaaaaaauguagccaaagaugagcugccaugaagcucccccucuugagaaacagucaggagaaaggaugagaaagcagaggagaccuaggaaucacugaggugggaagaccaggagaaaugaguaacagagcagccuguguggacuucacacaugcccuuaagacagcgcauuugucucuagccuugagaagugagggcuuugaagcgaccuguguuuccccuaagacacuucugaggaaaguaggguaaccuuucccacagccccuaggcuuggcuagaaucgacacuggauaagauggaaacuucagagcgucaccaagcuugagccugaucaaggcuaucaggacagaagggccugaggccuaccugggcgucuggcagugcagauccaucacccagccucuauaaagugauuauuuggggcuugagcacacugacugugccagggagagggugcuguugaugcaaacuacuuguaagugggagaucucagucauaggugcccccugauuggcugggaucuagcaaauaggccaacuaucuugggccuucuccuucagccauccacauacaugcgggccagaugaauguggucuggagaccgguacuauuuuauguaccuguggagagguauugagaggcucugcagugcccccauuugcugcccauguuucuucuuuggguuccucaaaucugugccaucuuccacugcaaacuguguggauucuaaggagagguacauuagcuucuuuccucauuacuuucccaaaucuagcugaguagacuuucucugugguaagaggucaauaaguggcugaguugcauuuauuuacagacaguugugaacugggcagcccucuggccucaaccuccuuggauauccucucacugaguaagcuugagcuuagccucuagacugcggcugccucucuaggagugccacugucuuccagcaagcuggguggcuucuucccuuacauaagaugugugugugugugcuagcagaagagagcugccugcgugaguguuuagcaaagaugauuuguguggaguuauuuugagaccccaggggagggaauggcagccaagccugcaguauuuuaaaccguaucacucaacuacaaagauuaauauguuacaacaucccugccagagcauugguaaaaaggaaauaagaauguuaggggccuacaaauuauaaaugucagcucugucugaacacacaaggucacuucaguggucuccaucuauccugagcccuuggaguuucuccugcugucuccucacuccugccggccugaagaucccuagcagacuucugggaugcucaccaggcugccucuggaagaggaaucugcuuuucuguucccuagauauggacugguaauugucugaguauucagagaaguaaagaagucuauauucuggcaacccagaacuucuaucauuauugacugagcuugaagcuccaggcagacuagaagauaccagacaucccuaccgaacauccaccuguccuccuggcuccaaccugaacaacuguuggcuaaggcugaaucacaaaacaaaggauguuuuuguuuaguggccugacucuguaugaaacauugaucuugguuuucuuuuccuuguggcuguuaugcuguggaauuugcuucacggggcagcccucuauagacagcuguccucuuugccauucagcagcuaguaccucccagagagguugccugggauggaaaugccaacacaaacgugcuuauauggcccuagcacuagcauuucauuuuuagagaucuuauugccuucugaucuugagagaucuguuuuugggccaaaggacauccccaguaacuuauaaauuguggaaggcaaagcacagaaagauaccuguccagggcuggccacuuuuauuuuguuuguuuuacauucaaaggguacacacaaugaauucuuuuaaugaccaaaccuaugggcacaaauaguaguuguuauuaucaaauauguuauuucaucaaauagauaauuacaaggacuuauagcccuauauucucuuuauaauuuucuugucaccagccucuugcauauacucaggcauuuagcauaguacaaaugacaugguucaugacacagcucagaagaagcagugagcuugcuugcuugcuugcuugcuugcuugcuugcuugcuugcuugcuugcuugcaaguauguaugagagaaguggagagaaaaccaucuacugaggugugcaggaugguaaaaagaaccaggcauacuguauggaacaggaagggugugccuaaaagaaaguaacccuucuuccaggaaugguggccagauagaagcaagauugaaagguuccgcuauggcuguccugcuccacuguccugcaggcacucucacugugucugugauagacacagccuguucucaagccuucugagugacuggagcuauuguuaacagucacagucacucuuguuagacuccugcauucuucccucacucuccuucccagucuuuguccucuuuccuuggguaaaugagcacauagauaugugaacucacacaugcucuugcauccuagccuuccccacuccacccccauauuaucagggacugugccagacugagcuuugugcaggaaguuuuacucucccuaccauucuaagcacuagacuaccacuuuuuccugcccaccgccccuccccugccucauacguacuuugcuuguguguccugauguggggaagaugucuacccaguaauacggugguguacauguuaaagcagucuucugacccuggagagacagccuguugucccagguauaucuagggaagcuggucuuucugggaucugaguuuccuccuacugacuuugccucccuccaguuuuccaguggaagcuuucuguccaguguuaaaguaaaaauccuggaacuuuugugcccuauuguuccuaugugaugggagcuuaaagcuuuacuaaguacacacugccuucccugagcacuggccucaguggugcccgagacagucucugcugcagugcuguggcaucagugacaacuaaaaaagauccuuuuugucccccuucaggucuuccaaacgggauauaauuacuucaguagaccaguuuuucccugaauucugcaagguggauucugggcagugguuuagauuugcuguuccuuuucauccccagagcgcucgacugagagaaggaaaugaauaggcugcuugucacaccaccaccggggucuccacugugccuuugggcugcugcugaguugagaauggaaaugggcuggaaagggggccaguggaggccagaagccucuaagaggacaguccccauucuggggauggcuuuuccucaacuggcuaaguccugcucugucacuguagcuuccugccagcgaagaauucugaaggcccagucacagggugagacucauacaccauuccaccccaccucacucuaaaucuucccuaaggcaaaacaccucuaagcuccugaacuugauucucaguagugaaaaaugaaacuacucccuacuguauacuccacaccccuuuagaucuuuuuuaauuaaaucaaccaaaaagguauuuucagagacacgacucuucauauuauguagguuuaaagagggaaaagacugagauaguaggaaaucaaaacucuugucucaugagggucuugaguguuuagccuagagaaaauaagacauaggaugagaaaaaauagauguuguaucuucaaauauuugaaggcugucagauggguaguagagguuuuauauggucccaaggaauuacacaagucuuauagggccuggaaugucagauugccgaauucugauauuacuuggugaaauacagguugccacucaaggguuuugagcaaaaugugugcuuuagaagauuauucugguagcgguguguauuuaaaaaaaucucuauaaaggaaaauggauggcaggcagggaaaucagaagauccuuggcuagaauucaggggucugaaugaggaauguucuguugaguagagagggcaagagcuauggagauuaaguaaaaagaauuguuaggacagagcaugcacuggcucauguggguagagaaggaaagaagcaacaaguaaugagugauauuuuccagcaugggaagagggagguuaagccagaagcagaaggcacaggaugagaaacagacaaagaagaguuuagcuuagguacacugaauuugagguauuauuaauuggacacccaaggagaaaucucugucagaggaaggcaacuuuauggaacguaugcucauguuugaucuucuggggugcacguuuuugcauggggaaaucugaauuaugaauaagggagcagugaugguggauacagggccgaugcugucuaggagcgagccaugagaggcaugcacguugccugacaguguguguccuccgagcuguggguccuucucucuuucugacuagugguauaagguauacaguucuuaugcuguuuguugccccuauuguguguggauuuccuguuuauauuguuucuaaagcaaaugacauccuugagaaugaguguuggcaaacguuucuguaaagggccagacaauaaauacuuuauaggcuacuuggggcuuaugguuucugucacacuacucaacacuuuguaccaugaaaauagacauagauggccauuuucugccagaauuucccucauggacacugaaaucugaaucucaugauucucaaauaccccaggauauuauuuugauuuauuuuucucucagccacacaaaaauaugaaaaguguauauuaauuugugagcuauacaaaaugauauauguugcaaguuguaggccaguuggggcuacauaguaagaauguaucugggggaaaaauggaugcugggagacagucucaggacugucuguugcccccuguuucagagugugguaacccagaaaggaagggggaacagacacaacgcccgugauaagacacuugggcggucagggagauagugagugcuggcuacagaaggagacucucccaagagaaaagcaaagcugaaaagaaagggaaaagaaugucauucucuacccacacuccagagcucaggcugcuucacuuaucagagcguguguguguguguguguguguguguguguguccgagacgagccuguccucuugagagcacugucucuucagacgccucugcucucugcuuccuggcuggcgugcuucauuuucuuuucuuuuuuuuuuuuuuuaaagauuuauuuauuuauuauguaaguacaccguagcugucuucagacacuccagaagagggugaccccucuccucuucuggaucucguuauggaugguuguaagccaccaugugguugcugggauuugaacucaggaccuucggaagaacagucagugcucuuaaucgcugagccaucucuccagcccgcuucauuuucuucuuucccuuguuucucuaaaguuaguaagagaaaggagucucagcucucugagguuuggccauucucucuauuccugggccuuaguguuucugacacuagcuggguugguuuuuuuuuuuuuuuuuccuuucuucugcuagcugaguguaccaauuucuaggcauuuggaauucauuuugucaggaggaggagccuagagcauugucagugagugcaagcucaagaaggcaguaguugaaaggacacugagcacaucucaaaccauuugguucaaauaacacaacacagcuugguuuagaaguugcucuaaauuuaugcauguaaguagcuuuuacauuugccugccaggugugugccagaagaccuucuggaagcuuguacuugcaagguccacgcagguauuuccuguggcuucuucccuauccugaagauaagcucuuuuggagucucagugauagguucaaauuguucucuuuauucauuaacauagaauaaaacaaaccaaaaccaggaacguuuuggguaccaggugaaaaggaggaaaauauaaauuuaaguucccuuugauucauagauaaauuuccaaguucaaaauaagucauaaaagcaaaguggagauuuucauagaaaccagcucccauccuggcucaggcacagggugguuguucuggugagaugcugucuccacagugaguuacagaaaagccagugccuuauaggagccuucuugucauuuaaaagcucuacuuuuuuaccacaagauucuucuuuuucugccuauugauacaaagauagguggcuguuugguaugacagugaggagaaacuccagaaaggacacaccggagggcaccaaggccgcuggucuagucugcuacucuguuaacagggcugucagugcagcugccacucagggcagcuccccaaaugagcaugggaggcccacaccccagacacagcacggcacucagcuaucacaggaagggaaaggccauguuguucggggaggacuuuugucucuuuaaagcucaguguuuucugacuugcugggcaguagguagacuuauauaaaagguugucccagugcaggcuugaucgcuauccacucugccagcuccaucugaaggccuuucucccucuggcgagugguucuucccugucuaaagcugcuuguaaaucagguuuggaggagcagguucugcaugcugccagcucgacugagagugagaaaguccaugucaagccucuaagccaccccuuccuugucucuuccacuuaccauagucagcgauuugcauuuagcacacacacacucaccuugagguccugaaaguaaguguccccggaauuucucuuuaauucuccaaguguuaacucugaugcguccuaaacucaggaauggauguugauguaacagguuugucacauuauuuccacuagauucucccuggcauuccucuucauaaucacugagaaucuaccaugugccaugcacuaggggaggaagggcuccuuuccucaacugacagcaaaacggggacauaguaacagacuaauggugcugauuacagcuucuaucagagaaaccuaaaguguauaacagcccugcuaugcaccacagacuggaacuuccuucagaguuagcugcaauucucacugcgucgugaagacucagcccuauuguuccuguacccaauuaacuucaggcccuagucuugucuugucuuuuuuuuuuuuuuuuuuuuuuuuuuuugguuuuuugagacaggguuucucuguguagcccuggcuguccuggaacucacuuuguagaccaggcuggccucgaacucagaaauccaccugccucugccucccgagugcugggauuaaaggcaugcgccaccaugcccggcagcagaugcaucaaacaucacaaaaccagaacaacguaauaaaauccauccuuaaaaaacucuaaacuaaaaguauucauuuuuagcuccugcccaguucuggcucccuugacuacaguuuucugagauaugugauccuuuaguuagggucccuucccucuucucugaucccuuuauucugaucauugagaaagcuuuagcaguugcaugccccaaaguugcuugcaagauucgagcuuccccugaggaaacaaaguagagcuuuagagaacaagggagagaauaaagacccugagacaaugugaaauccugauuuuauuucugaacuuuuaauuauaaaucgaggucucauaccacauagaaguagcucuuaaggccagcuagacuuccaccuugccauucucucuggaccauccuaggaauagaaaacugagaggcaagugugucaucucuuguuccucaauuuuuagcugauccauuggcagcauugcagaucucuauuacaccugugagcagaacuugagaacaaacuuuuggugcgugagauacagaacauuguugagaaccagcaacuuuucaagugauaagcacguuccuuaagacguaagcaggugccugccuccugccugccugccugccugccugccugcugccucugcuuuuccuauugaugauggaggguugcucuuggcacuuaggaagggucuauguacaguggggucuuuucaguuuuguuuguuggcagggagaaagguagcaaggaagguagagaaauggaacuaauugaaucugggggaaaaacucugcagagagccuguggauuauaaauugaguagcugcagcagcaggaacucagacaaagguauuggagugcagucagugugacaggaagcuuauuuugccguucucucuugccuugccuuguccuugacaauuccuccaggggggcuguauauauaaaaggaagggagagggagccacacuuccccaccuggaaaacucaacaacauuccugccuggggucuuagaaacuagagaggucuacucucccugccccuugcaucugucccuugugucugugacuguacccaaaccuacuuuaacuacuugccaggcauguuggaagcagauaaaaccuuuuuguugcuguucuaaaacucccacuacaacugcuguucugucuucucaggaucagaucaacaagaacuguguagacauuucaggggccagcagugcuuaaaugagcaauacuuagaguugaauuauuauuaacaucuuucccuaaguguggagggugaaguugcagcugacugguaugcacuucuuugauuguaagcgaaggggcggcugagcaccuuucagcuucaggaugcaguagcaacauucucguugccauugggaaauuuauuuauaacccaguaguuaucucaacacuguuuuuccaauauuuuguccagauuuuucuucccccuaauaauuauaccccugcucucaagcuuagcauuuccccuccuuuuugguguuuacaccuuucaaauauuugcagauuguuaacgugucacccucuuagucaccacuuagccgagcuguaccgauuuagcaccuuuuaucuucccuuuaaaggcaggccuucccacccugacucauucucuccugcucucuuuaagggugcuccaguuuucugcauuuccauguggccacccuggcauucagugcugaucauacaugaggaucguuuucuguucuguuauauuggaagccaaacaucucagcugugccccaaugucucagacauugccacucacacuuaauuauguuaccucuaaauuuaaacuguguucccaaaugugacaguucagagaucaaugggguacauagguguggcuaugcugagaugucuguaguugagaauucugucaaucccuucucugguauucaugcaaaacacuucugucuuacaaaugggucauuccagacugaugugcagcauauccugcuuucugccugcuuuagaaaccccacaucucaccucagccuccuucccuccauuucacuaauauggucuagcccauuacaggcacgaugugggaagcaggcgggcuguaugaaaagagugaggucaggaagcugccaccagcuagaacacgucccucuacuacuguguaaggcgugcuagugcugacugcgcuugccgguucucucuuuugauguuuaccuuuuuuucucaguauuuuugcucuuauuuauuuaauacuucuugggaaucuacuuugucgauugacaguguauugggugucugguuagaaaaaauaaaacuugaauucaugacacaguucccacccucaaaagcauguuguacguuaguuucuguuuuauuucuccugaaaauuguagauucccauaacucauggcgacagugaaaggagagggugaauuuauaggaacucugaaagucaccuuagggauccugaggaggaucacaugucacagacauuagaaccuagacaccgagccugaggaccucuguuacuccaggcaguucucuguugauggcuuccguccuuggcuccucagcaggcuucuguuuuccauguagcauguguuuuacauguagcgugugccgagccagcuccagaaagagggucacccuggcucaccuuuguuaggauacagcuuucuggcuggccucacuagagauugaccuccccugcaucuggcagcaccacaucuguucauccugcccugcuaccccacuucugcuccugcuuuccauucccagcuguagcgagagugugggaggacgucacugauugggguuggugagccccccacuggcugagccacagcaccugucugccugauguacucccguugucucucagggguuaacugucuauacccucugcaguagccuuauauagccauauagacagcaguaaaagggaaugcuuucuaccuaguaacuuagcugcaugaggacacacagucuuugucauacugcuaccccuacauuccagguggugucuaaaguaggcuaggaggccugggugacaagaaggagggaggcuucaguguggacucuuucuguguucuaagcaaacagaaggagcuucugcugccugccucugcucucuuuccucagagggcagggcagcagcgagaacacaauggccauggaaucagcaccacugacuaauccuucacauugcuucuuguuuccacuagccguuuccuucugauaaugccuggcuuguuugcuggacugauggucauugggaagcugucgcuucuaggcaaagcaaauuggccauauuuccccucaguucccaccgugcaauacaggaaagaucagacacacuuugaguccuaaagcuuaauuaucacagaauucaacauacauucuaaaauauucagagugauacauaacccuugaccaucaauagagucucuuauaugccuauuaucuugucauuagcaagaauuuguucuucuuguuccaaugcugacugaccaaaguguuuuuguuaauugagcuagccaaugucucuaagaguauaauuuuuuaauagacugauuacuccacaaccuagccuuuuaaauuucaaaagaagcacucuguacuccaagauaagccuugggugcaccaaggacauaccucaaauuauaggauuuuuaaaaccaugcuagaccuuguaaccuuguagacacuuccugucagagagagagagagacugugagccuggugacauuuaacagcucuucguggcaaaacggaagccaaagucaugaugcccugauaaaacauuucucuuccugaccccuccaaacaucaagcggguguucuuuuuauguuguguuuuauuuuaaguaauuuuguucaaccauucaugugcuuaaaagcccaugaaaaacaaugaguuuuaccuuucagcaccuaggccuuacggguuguaugagcuggaaggaguauauauccaugguuucccagccugugccagaucugagauagugugaaucucacgucaccucaccagcgagcacaucauagcaaaggagaaugcucaaaaaugcuuagggaguuuuuaaguauggcauuuuuucaggugacaauaauuuuauuucuugaguaguuucuuggggucacauguucuguaccugugacacuggaggcacagcugaggccauacauccuugucaccagcaguaccacuccaccauguuaucaggagaagcagcauuuaguggugauuugcagucuucacaacuauacacacuggccagagaaagugucugggacucucugccugucaccaggcccagaccaacugcugcagccucacugaaaagcaaccuuucaugcugucuuucuuccuccuucccucccucccucccucccucccucccuccuucccucucuucuuuccuuccuccuccuuuuuucuguucuuucuuucuuccuuccuuucuugcuugcuugcuuaauugguaagaaaguagcacaguaaggcuaguagcccagcagcacacaccuuguuugaagcacggugcaguguacucugggcugccaugcucccuggacccuggacagaaggggauuucaccuuuguucaauguguucaccuggauuguuacagcagccagcuacuuccuucugacucuugcagguuaaaauuggcauaguguccuauucaucaccagaugaacacuccuuguuuauuacuuuggacauaaaagcaagucuagagccuuauaaaccccuggguugggaugcuccaaggccauaagggucugcccaccuuccgcccuugucuuugcaucucacuuucaguguuucucaagcuguguguugccacccacuuaaguucucaauccaguaacaaagccaucuuaguuguugucuuuagugagccuacaguacaauaaacuacuauuuaaugacacuaaucaagauuaaccaguuuguagaaauuuaguuauauguaaguauauacauggggcugcugagcugccucaguggguaacgauaccugccaccaaaccuaauaaccggaguugagagagccaauuccuucagguuguccacugaccuccacauugauuuaucuguauacauaugcaugcacgucuacaugcacauauucauauaccacagcacgggugcauauucaaaggacgguguauauagaaguuucuccuauuaccauauaaguccggggguugaacucagguuguccagcuugguagcaagugucuuuuuuucuucccugaacuaucucuagccuuuaucugcaggcaucacucucauaagagacuucaugcucuaccucuacauuuacaccaaugccuagaaagcaugggccaagaaaggaagagaucgcucuugagcucauuuccuuugaagacaccacuugccaggggagaagugaacccucaguggaauagcaaacagggagcagaugggagaagaagaaccuguguaaauguauuauuuuucauuacaaguggugagaaacgcccugcuuaggcugcugcuucuagguaagcugaagccuggcugcuaggaaguggacuuguuucacaggcccaaaggaaaccucuccuggggcaacucugcuggauggauucccugagcuucauguuuccucagcuuuagcauccggugucuggaucguauaggguuccgaggcccucgcagcuugaccggcuucuugcuaucucagaauccuaacaacgugacaagaacuaaaucuaguacuccacuauugagaaucugagaccugcgguguccuucuagaaaaaaaauccuugccaccgcaggucugguccccugcauauagcagcccccaccccaccccaguucuuuugugaggcucaggaacagaucagaaacuuguuuuuugcauuauucuugucucugcagcaaugcuuuaucuauggguauguggcaaaauaguucaacagaaucguuuauuuuucucccuggcaauucuccucuugcuuaguuugcagaucuaaaaugaaaagugguuuuggcuauugauguugugaaaaacaugggcuaucuuucauuucauuuuucucuagccucaucucucccuucaggguuauucucagguccauggccccugaaguucuugcuaucuuuuagaaaauggaguccuacuccucugauagacacaggugcagggaaagcagcccucuugaucuugcagccauauggcuugcauagggccuucagcuguccggucuugcaagggugagagaacgauggucagccggcuagagcugcccacugcugcugucguucuuuugcugcuguguuccucuaccaccaccuagaucuucauuuugcaugcucucuucuacuggaggccuagaggcucagagggaaagcuauguucugcagcugcugagaaccaaacacggagccuguuccuuuccuucacucauaagaauguagacccucucuccuguugguugugggaucugaucuuuccccagaguuacagagccaaggagcagcagagucagaagcggggcacggauuuccaccacuuugcuucuggaauugucagggcuugguuuucuugucugucuguagccugggucaaguuucuucauaauuacauugcaaucugaauuacuuuaaacacacacacacauauauauauauacauacauauauauaugucuuagcccgacgucaaaaacagcuuacuuuuugcucuaucauauauggccacuauuaguaauaaguguaucuucaaaguaaaugauugaaucaaagaaaagaaaagucugucuagguugaucaguggauguacacuuuguacuaaguaccaucauuggaaacaaacagaauaggcuucuaugcacaugaaucuuauaggcuugcgaucggagucaaagaaaauuuugcaauuuuaaacaugagaauugcuaagacugauaaugauggugaugaagaugaugggaauagcugaaguagccagcauuguucuaauaucuucuguacauaaucucuccugggcuaauguagcaccuuuaaaaacaagauguauuauaugucuucuacagacaaggagucgagccuuuguugaguaauuuagccaaggccaugaggauaauaaaugguagaauacgcugugaagccgcuguguguggcucuagacgccuacuauuucgucagguuucuguuuucuucugccuccugcucugaaugaaagcugauggaauaguauacaaagcacagccuaaggacagagggggcguuuauuugaaaaggaaagugacacugaauuaacacuugggauucuggcagaaagucagauaguaaggaggaaaugucugggaggcggcugcccuuguucuucagcggcacauggcugggcugcuggugucauuuaggggaggaaagccaauuauauaagccguggcuaaagccguggggcugagggucuuaaagggccagggggaacauagugaggcuuccucccagguugagagugcuggggugggccguguuucugcacauuuucucacauuuuccuuuucuccucauucaggcauugaaugucccagaggagcacggaaucucccgggcuuggugcaggaaggagagccauucagcgaggaggccacacuuuucaccaaggaacuagugcugcagcgagagguagggcgucuucauguagcuucguaugcaggggagcacagcccuacuccccggaucucacuagcuccugccauguuaaagauaagccggccgucucuuccauugcccagcccugccauccaggagcuguuucugcaucagcccacacuuuaucuccuugaucccugcaucacuggucagccacccccaaauugucccuucucgcggguagccuggcacaugaggccagcccagccaggaccccaaugcagagagcuuaagcuuggcaucccuccuccucggugaauuagucugagcugccugccuccagcuggauuuagaagcuugacuaacccugucaggggccaauuuucuuugaccauuuauuuguaucuuugaguaauugcauuuucuguagcggguuuucugacuuaauuuaauuguacuucuguaucugccugcugggcugccucuugcaggcagaagaaggcucugugcugcugcggugccuucugcugcugauguuacucaagccuuccucagcagaucuaucuuccuuguagaguacgccagccauucaucccgcucacugagcacugggaagagcaguggggacgcgccccgcucucacugagcacuggggccuaccugccuuugucccuuccuuccuccuguuaacaucucugcagcuguaguguaugcacgcagcugcacauuaugugcggccagaggccuucucucagggcucacuugagauccuagagagcagauggaagggcucaagacguuccgaguuggacagacaugggauaggaacauuaucaucucguuuccuuuucucaucaucuauuacuucaguacuggggcuguggaagagcaggucagcccuagaggcuccuguugggcuacucgggcucugagaagcccacuacuuuucaaacucagcaguacucuugcugucugugggauuucccuaacacuggccuucuuguuuuaauagaagaaauuaauuuggccaaacaaauccugauuccucuauugaagagguauuuguucacgucccaaauaucaacuccaguuaguuaccuggguaaagcugcuucugccuugauggccagccaguggcuggggugugcagcacuuagucaucucauuggcugcacauugcucucugcucucucuguuaagaugcacuuauccuugaaagugacacacugacugccccuacacauaugcaugcaucuuguaaccacacaauauagcuugaauuuuucuuuuaaaguuagcaacauccaccccuccccuccacuaauguuugaaugcaaacacucuauugucuaccaacaccugaagauuagcuggaaggggcaaauauuacagaccucccugcugccuuuguagaccuuucaacauuguccucacaggaacugagaaagcaggagagcccgcucuaguuuaugaccugaggcaccagagaggaaguagcagaaaauccuuuucuuucucuuuuccuuuuuuuuuuuuuuuuuaauuuacuuuuauuuuuugguuuguuuugagauagggucucacuguguagcccuggcuguccuggaaugcacuauguagacuaggcuagccucuaaagagaucugcuugccucugccucccaagugcugggauuaaaggcgugugccacuagccuggcauagcagcagauucuugcugguuucuuaugcuuacaucagggaggaaccccuuaggacacgagugagacauugaacugaauaucacgugucucaccugacuccucuuuuucaccaacaucgccuaaagcagugcuucucagccuuccuaaugcugcggcccuuuaauacaguuccucauguugugcugaccccaaccauaaaauuguuuuuguugcuacuucauaacuguaaauuuuuuacuguuaagagucauaauguaaauaucugaguuuucccauggucuugguagcccucaaaggggucucaacccacaaguugagaacugcugucuuauagugacuuucucuuuucuuuucaacucuuguuuccccgacuccuuuucuuccuggccauguuucuagcccccagguggcagcuaaaacuuacggccaaauauucuuacugccuccuguuuauuguggccuuacucuuaucuguguauuuuuaauacuuacuggcaggaaagguggcauuuuucuccacuuucuuugaugccucuuccuuauaaguuugcagaaccuuagucuaauccaaaguugcuauuugucuuucuugauuguaguggcucagucuuuuacagcccuuuguuuagggucugucaguaaugaacauucugcacuguuggagcaccugauaugauuacuuggucaaacugauuugaaaggucauuauccagaggaaaugggaguauggccuaaaccacaaauaauuuaagauguugacuaaaagagccagcuguagccaacucuccugggcauuucccuucauagaauagauaaaaacugguuucugaaugguaagacagucaaaggagguuuucauuuggcaaguguuguuuauuuacuaucccguguaguaacuucaccuccuccauagagcuucuuagagaacaaagcucuuacauucccacaccuccacagaaauaggcagggagaagcuccauaugcuggugccccugguuauuguaaaaaggaccaugugacuguaugggacgagcccccgggcccuguguagcuaggcccuguggcccuucaggagccaugcugcugcuugaauagcugcacuugagcuuugguuuuauguuuguuccucuuccuuugauaaucaagcguaacuugguauuuugaagaucugacuguccuugggccugcuccaucuccccuuuuaaguuuuuaaaccuuuguucucauuaucucauuugagcccauaauuucucuaccuuggccugcuuuccccauauacuagaacuuuguauuacuaaggggcgagaacaguucacauuucaaaguuuuuacuggauucccauaagaagaagcgcagcaugaccagagaaggaucuagauacugagaaaguaccauggucacuguuacuaggcagucaagaaagagaugggagcuggcucucaggaugcagacacuaagaacuacuacuuauuuuuccuggcuuuggauaagcagggcaccaauaccugucucucccucugcuuugaguaaguagaaaacugcuugccuuuccaucccauugcuacguaagggcaggccugcacggggcaggugaggcuucucuacauuucagauggccucccauauuaggggacaugguucccacgcuugccuuguacauauacgacugccauauguaucacggaacuacugacauuugcagccaccguucagucccauuuuccuaaguggcucucuuggccuuuucaucacaccacuucuuuuucuugucugcuaccugguguuucccuuuaaacacugaucccuuuuggcuugcuucuccuggauuuaguaauccugguccugggcaguggucuggcaugcaggaggcauugccagcccuaaggcaggaagagcuagaagucaaauaccagguuauuaccugauucucugaccugaagcucagggcagccaagagccuuuugggggauuuaaauucuuaccuuuacuccaaggaaguccagagcacucaacaucucuucccaggcugaccaaaaugugcaugcuagggccgugcaaaucuggcccucugccaguuguuugcaaauaaaguuuuguugaagaauaugcauggagauucuuugugcauugucuaugacugcuuguacaccauaagucaguguaauggagucgaguaaggaugucagaaauuguaugggcuccagacaaguuugcuuauaaucccuguaguauagacuaugcuaaauuggguuaaauggcucaucguaaccauguggagcuucgagaagucucugaccuugaggugcuggguugcuuaugagccaugcaacauaaaauuguuuuaugucagcuguaaguucugugucccauuggcuagcauguguuuugugacauauuuuauccucuccucccaccccuaccaugcaguugccuuuuuaaagcaacucccugcuacauugccaaggacaggaaggucugguguaauuucccagauagggaauugcacuuguugcuagcaucuucccagaaguagugaugagagauagaauuagcuaauggguagauaacuggcuuaaaaguacaaacuccuggucuucacacccaguuaucaugugguacugagaauacaauuuuuuucugccuugccuugguauuucugucuaaaagauugaucuagcaauccauccaucaaagagucauuugagaucuuugucaugaguacaagacaucugugcucuuuugacaucaucuuccagaaggccagcuagccagcauauacucaccaaccugucacuauaugccggcacuccaguuguugcuguguuggagaaaccugaaccuacaaaggaggagcuauauuaauaaaagcucggugucaaacagguuuacuugaggcagucuugcaauguaccccaggcagauuugcagcucaugcuucuccugccuuuauaauuuaacucucuccuaguuucaagcugucucggauauagcuuuggagggagagucuacaggggcuugguaauccuucccaguguuuuuuugaugaccccuuuauccucucuagacuucaaaguuguuccuugaugaugccuggauaaugacacccccaugcuggacagcucuagcugaacacucugcccugaccuauuucccucuugcugcuggcaucagaaaggaagauuuccccuccagaacccauucugcagcuucaguaacccugacauagcccuaguuuuccucugacccccaacuccuaguuuuuuucaaaggaaaagacuauaaaguauuauaagcaacuguuacaacugugggguggggggaggaaugccuguuugaaggaaccugaugacuaggucuaucugagaaggaauggaauauacauaggaaagaaagccuagcauugaaagaaaaaugggcccaucuucuucacuuagguuucauguuauagucccucuugugugagagggggaugaggguugguguaaccaggucuuuucugcacccucuggcuucgccccauagugcuccuccagcgcuguguaauguguucucucagccuccugguccaucuguucaugcagccuacucccugccaaggagagucauuggaggagaaggguagcacacagugcugagaauggcucaguccugggaauucaggagugugcaguucaucuggucuuaauggcuccagugcaaccugcucucccacacuugguguuugccacugcccacuaggaacucucacugagccucuaauaacuacgugcuagaaaaucaaacaggcugcucaggugugucucccuuccuuccuuccuuccuuccuuccuuccuuccuuccuuccuuccuuccuuucuuuccuuuuuuuuuuuuuuuguuuguuuguuugugcagaagucacuuuacucuaggcuauccuagcuaccauccaagagaaagugggauguaugugcagccuuuuuaaacacucucuuccccugcaggggcuuaggagcuuuugguugggagaggacagcacaccaccuaccagugaugcguuccagaguugaguuuguucaguuaguucacuguuguuuccauauaaagggccucaggaaaagggaccuuagguucauaguguuugcuagaguucugagggcuuuguuuaaucuguauauguuucacaacaaauguaugcaaaaauugcucucccagccucacaguacaggaagcucagguacaccugcuccucuccuggcuggugguauggccgaugcuaaaauacacugcacucccagugaagcacuuugcuccucagagauugcuaauuuugcuauuagaaagggauuacuuuuuacgccauaucuuaucuuuuuuguuauuguuuuccaacuccagagugucuagaaauaaaggauuuucccaaaggucaaccauuggcugacacuguuccgugaaacauucuauucugagucuuuucuugggcuugagggauuugcugugguccugccucccuggguauuuucucugcuuguguuguucuuccagcuuuugaccaucugacugcuugcuucaugugcuguuuuaacuuuucuggaccuugcuuucuauguagccacguccuuucauuugguaagguauagccauauuccuguuucuguagucuuucucuuaggaggcaagucugacucugacuaugcaucuagaaagacauggcgcccuugcuucuggauaaagugucaucucuaauuuauauaucuccuuggccacuucuccaaccucacaucucaucacuugcuuccuaucugcaccuugucagaacaaaccuacgaugcucguagcuccccaucugucucaguacacagagaugcucgcuuuuguaaagggaagggauuuauuuccccaccaucuuagggucugagaagaaggucugcucuauuauuauuuaugguucucuggaaaagcucucugcacucagugggagaggaaggaagacauuagaguucuuagacugaauaugcgacuucugauugaggaacuuccuaugaacgcgaccugcguacuuacuccagacugucuggguuucccugucuucuaaccaagaugcuacacaaacuuaaacaaugguuuggaguuguagaaaaguuucauuguuuuaaaaaacuuucacuggucuaaaagaaaccaccaguguccucuugguuuucuaauacaguuucuugucucuuugcuuuguaugucucugucuucugcuuuugcugauuagacuguuagcccaagggaucauuuugaaauuucggcccccguaaauuccugauccaagaugaguuguaagcacuaugugaauaucaaacuguuaucugacucuuuacucuugaccuucagguacuucuucuaccccuagaagagaccucaaaccccaucccagccucuaaaugaaaauagcaccauaaaaugacagaaagccagguguagugguacauaccuucaguuggaccauugaggagacagagacaacauggcccuaaguuccaggccagccuacauuccacagagagaccuugucucaaagggagugcgggguuacagcaaaaguuuuaaaugaguacugcugucaugauuuuuuuuuucuccuuccccuggucugcugggucccucugucaguuuuaaguccuagggcagcuuccgguggccuuccucagcaagcuuagucuguuugcugccuccaguagguuccuuucugcagagcugcuggcucagcucugcuguucuucuacugagaacuuucauagucagucaagcauagaauuacauccauucuucugaaauaguugcuggggcuaauuugucauuggcuuggccaagauccuauuaccugugugucauaggggcuaucuaguguagguuugauaggccucagugccuuccagaaauaguguccacaucugucacugcugcuggcaaugaaggugggacaggcauggcauagaacagaaaagauguggccucuuugagacauggaggagagggucucaggggugugauucuauccccagaaaggaaaucuuauucagcagaauccuuguaccuuucccuuaggagcugggcuccacuguugcaaauucuucuuugagaggcauuuguauuuuucucugccaggucagcuuguuuuucuguacuguuguuccaucaaaaauuaaguaagaaauauagugcuugguuggaccugaaauuguacuuuccucccccaaguagaagcagcagcacccuuggcaacgccaagacaauccuggcacggaucucuccuccuuucaucuuuaguccugacccagaucagucccaguguaaagauggaaagacucaaacaugauuucuucuugcaucuuuccaccaaaaugauccacgggacucauuugaacaucauuuaaagugaggccugaagcaaggcuagugcacuugcuggcucguccuaaaaauccuucacagacacuaggcacagccucugccccucaccagacuuggugcuguccacucugacaggacauguucucuacgaacagucccaugggagacaacuguugccaagcguguucauccuccugggcugccaggagccagguagggcuuguggcccagaacaaaugcaaguguucucaggaggaaaauaaaggcuugggcuaggggagcugggugccauuuguuuuaauugagguauaguagaugcuccagaaaaaaaguucuggcuucucuuuccacuuuagucauccugaauauccacuguuggagcugucaaagguaaggguucuuuuaaaacagggucagcagaagcuaauauuguuaauaaugacgagcugacagaaagaaccuaagaauuuuuguuucucaggcaaagcaccuuuuucugaacucuuuaccuucccugcugaacucuuguuuggaaaauaguucuccauuucucuaucuucaauuaggcauauauuucucuuaauacugaagaugaccucauacugaccugccccugacuuaucagaagaauuaaugcaggaccccaauguucgccuacaccuacagcagcccagcauguugguguuuuuagaguccuuucagcccuagugucucccuauuuucuuugucccaaacauucuaaaccacacccacugccugaauuucccccagcucuuguuauugcauaauucaauugguaccuuuuuagaacacagcucauaauauauaauagcaaggcugccugaaccaccagcagaggacaagcagauugucgauugcauuugcucuccagguagcacuaacauucugcuguuccacgugugacucccccaaggacacuagcgugacuguugugguggaugagcugaccuuaauucugcugccuucucacccacucccuaaggcugcuccccagcacuagggagccucugugcucugagcgagacucugcugauggacuucuuacuugcuucuccacccgggacuguuccuggucagcugaacuuaaauggaguuugaaaaugaaagugaccaauggucuguuaugaaauaagauucugagcaagguugagaauuaacagcagagauacucugcaccugucccaaacaacaggguuucacagucacaggggacagcuuguucucagacuuauccucacuacguuuaaggacaucuuuuccuucuuccuuagucacugaacaaaacuuaccaacaugugaagauucagaccuggguccucaucugucucgcuggauacuacagugcuucuaguguugugcaguauggcaguccugccacgcuuaguugccuagguuguauaaagacugucucuucuccauaagguuacuaugaaaaugaacuaucuauguaaauguuucauacaggacccaguaaaugguaaacagucacuagucaacaacagugugcagcauuauuuuauuagugacccuaauucucucucuugguuuugcuaacuugggauucagacuucaauguggauagaacacuuuacccacgguacggugguaggcuugauauagguacauguguugggaucaguauucauguuaaaaaucaacaaaauucauguuuaguucacugccuuaacccuaaacuugucuaagcuaaugucagcaauguaaauauacuccuccaacccucauccagucuuagaccauggcuggucauuggccuagggcucugauccuuuucaaguucuucaaagcuacuaccaguugagcugagcaugguggcauauaucucuaaucucagcacuugauaggcagagguagucagaucucuugaguuaaagaccagcaugguuuguucagaccucaagggcuauauagugacaugcuaucucuaaagaaaaaaacagacaaacaaacaaacaucuuuuaaaagugucucccaguuggauggacuuggcacuuggauagaaauccauuugcuguccuuggucuaaguucucaaacaaaccuuuaaauaucuuugagcaucagccagucuuuuuucuaagcaugauaagacagggucauuuugcccuugguuuuuccugucccauacaucaaacccacuuccuucuaagcagugccacuuucacagaaaaagcaaaggccuucccaagaguguugaccuucgcaagaaggcuuuucuagaugugacuaugaacugauaaggccaaccaucacuacaagaggggacagccagacccuuuauaggugucugagaaauaaguauccucacagccuaaacuaccgugggauucccugcuuuucuuuacuuagguaagaguccuagccuugugaucccuaggaauggccuagacuccaguagccuggguuuccuuguucucagauagaggagccaugcuuucccuuuggccccaucccuaucuaaccacagucucagcagucuaagaucaccauauguuuguccuugauguauauuaaauuggaagacuuggaaaccagcagaaugccagcaggagcccuaaagaaagaucuacguguuaaccaggacagaagggacaggaaaagaaccucaaguagcauuguucggagccaucacuguaggagugacagcugucacggaagcaggaauagagugaacuggaagccccuuccccguacccucuuucuucccagguuaagagugugcuuuccuucucuucauuuccagucucaugauaccauacaauccuuuucaguaguuaaaaaaaaagaaguugacuagauguggaagaugaugcagcuacaacagauccccuggcacuucacuuuccaggucucuguagcauguaugguacaaaggugcuguuaccuccuaagcuccgucaaaacccauuggccugggguuuuuauggcaccacuguaaccuuauaugaggaaaugcaacaacaguccauuacugcugauuggauauggauuuuuggucuggccacaugccacuuaguaauuuuagaauagggucacuuucagacuaagaggaugccuuguaggagggacuaguugauucuuacugccgugcuuuucacagccuugugccccauuucuugaauguaugaccaguucucagucugccuggcagagagagccagagcucuacccuuagcuuucagggcugcagacguggccauuuccaaaugccuggggugcacuuaaguacuuccuccuucuaaucucagcacuuccacucuccgcacaucagcagcuuuguaacuugcauuuaauuuugcuauacguuuagccuuucagguauuuguaggaaaaagguggggauacuggugaaccguggaccacaguuuucaaaguuuaggcaguuucaucugcgucucagucucuggagaaccauuuaagcuagaugccaggagcauccugaggcuccugccauauuuacaugccaguuuuaagucuggguucuguuucauaguguaugcacggugacugccugcccagguuuuacuaucugcaaaauggggguacuaaagcucuguucugccuuaagaaugccaaauaagggaagugcccagacaaggugaggaguuugcuggggagacuuaggcuccgggugauuccugagagugcuguguggcccuaagaggggauaguggccaaaguguuuuguuuuggggguuucuuucucaucagcuucucgguuauagggccaacugacagagcaacaaagguaugaucuggaacuguggauauuggguuaaauucuauuuauuuauuuauuuauuuauuuaaccuuuucucugauaucaaaucugugauaugcuggguuuucuacaagauaauacuucgguccugcuaagcagcauaucuuagcacaaucuaauccaaaggcuuaguagcucucauagucuuccuuguaauuaacuuguuggaugaaacucuaagcagacacugaauauuuuaucuuccuguuaugaguugcuaugcccaugaaucuaauacuccuuuuuccugguuaucugaauaagacuauauuugcauaucugucuucuucucuaucauaauguggccagguucccuucaagauuaagcaaagacccuauaacauuuuaaacuaagaccucggaucuuugucaugucuuucaaccuggagccaugauauuuguucuuguugaguauaaguuucacauuucugcuaucuauuuauguuucuuuggcauguaacccagaaauggguuaauaaggucuugccugggauuguccuuggagcucuggauucuugcuuuuccauaaaaaauuguagucaguggcugaaauuucccagcuaaacgccacuaaaguauggcaacuucaaaaauuuaugagaccuuaggaguccugucaugucucaaugcauaggcuuuuagccuugcaucaaggggacuuguauuguuuaaggagcccauugcccugaagaagcacagcagcauguaaaaggaugaaggcucugagaugcuccaugcuaguccaugagguuaugagggugaggacaggcuuuucaugacacugucacaagggcccccaaguguucuuaccugggugauuagaggccauuccaggaaaauacagcaguuucacacuguccagacuaauguauucuggccuuucuuuuuucauuucuuaaccuauccccuuguguuuuuguaauuuguacaguaucguucaaggguguuaaagagaucaauagcaauucaccuuuucccuuauugauuaaagugauggcaaggaaaaauggcaggcaauaccaauucauuuaucauaagcuauccauuuccuacuaagccacugcugaacuguccgcuguuggguugcugaucugcaaguggcauuacuucuguuucccaggcugccuuaauggaaaugaaagaaccacugugauugguucuuccaaucaaaagacgacacaaaaagaagcaacugugugugugugugugugugugugugugugugugugugugugugugugugaagcucaccacaaauacugugccauaaagaacaggcaaccugucaccacuuagugaacgcugcuuugucacucagcaguacccccucucguuuuuccuaaaguguucuuuuuugucugcuuuucuacagaauguaaauugaauaugaugaacaaaagaucagaaccuuagugaauggcuccaguuuugcugaaguaaagauuagccgccuuuguggcuuuucaguccuaacugggcucaccuuugaggugucagaguuggaucuagggaggcuuggggcacaaaggaagguucuugugguuaagggguucugugcccaccuagggauaaaacacagaggcaguucuuaccagcuucucuuaguccuagaaguucacauggaaggauuguauguagagguaugugugcuguucaccuucacugguuguaccuccugucacuucggaaaagugauagagagcucauuuuaaauguacaacuaaagccauuucacaacaaagcgcucauuuuuaaacuucaguguugcaaauagcaauucacauggguaaagacugguuuuuaaucgcaggauucuacagaggaaaguucacacugacuauagagccaaguuggcuaaccuagcugcuacuucucuuguaaauauaugaaaauaggaauguuguugcuucuuacccauaacucaccuuuccaccucuccauccguguugagguucacugcuaacaugcaaaguaggccacuucucagaaacgucuucuuugguugaguugugguggagaauuaauauuuggguugcuuccuagaggaagcccugcuuagccacuuaccugauuaugcaguuaauggcaaucagugugaucgcagggcuggcggcugcuuguugcugucagggcugcagucuuucauguuacccagcacucagccaggcuucaccagaagagcacugccaccuccauuguaccuaguggguugaggucacuauuuuggauagcccuuuuccaguaggaagaugucacuggaagcccuguggucugccaaagggagauguguagaagguagccagcucucugugaagcugguuaauugcaugugacgcugccagaaggaggauuguucuuuucccaugagucauuaauaaacucauguccuacauuguggggaggggcugacaguccaucaucuuccugagcuuuguuugacaacuuugcuuuugaggccaaagccuuauaauggcuggaggugaugagaagaaaaagaaaugaagacuauauuuccauuuaauauguuuuucuccuaagcuggaaaguagccccugcuuuggcaucaucuuggcagcuacaguaccaagguucaaggcuugccauggguaggaaaugcuaguggcucagcucugcugugggcagcagacuagggacuaggcguggucugcagaugcagcagcuagaagauggcacaugucuuguuccacuggggcuugagacucacaccaucgucuuccuccagccaaggcagccucagcccugcuaggucugaauacagaaagcauuucugguuuuuuagaaacuccauuuuuaggcaaagauggaagaaggcaaagcaaauauaauacaggaaauucgaucuacauuuuuccaugaagcauugagugcagaaaaaaauagaaauagaaauaaguaugaccauucaguuccaaagaccuaaguguagucuuuaaugcugagguagaugguguuguagcuggaaugacugagggaauggagcccaagccauuuugucagagacaaacggaggcaugaaguuaaccaccugaaugcucucccucagagagcucaaguuuccacagggccaucaccuucacaguaccugggacgguagucauccagcuacaguacaaggacuaacuuaagaaugugacagugacagcggugucuccagaggaguggguggugugacggaagcagacgggggagguuaacaggugaauuuuccucagauugcauuacuuuagagaggcgaggacgggguuaaggccacugagaagucacccaggcccugguguuuguaggagacucugcagccuagugcagagcugagcacacaggaccagagcacaagcagagagagacgaggccagguaucugucugcuacugucugcucaggccaaaaucuaaacucagcugcagccaaaggaaacagcuuaauggcuaaaguuggaggcauuuuccuugugaggagagcauuuuguuuuauuuggguuuuucuuuaagaaacuggggaaaguucaacgugcauagccgagauuguccuuaaaagucccugacacugcccgauccuuguccccauguaucauauguucagggaccugcuccugcccucacagaaggccuccaagagagcugugccaccuugucagggucuggaagacuuucacuccaugcugagaucucccuccccaucuucucaaucuucuuuuugucuuuaaaguuggggaggaacaaaucacauuuuccagcaauuuaacguuauuagcugaucccccccccccuuucaaagcagagcuaaauggagcuaaacauacacacgaaggcuauauuuagaccugauggugugguagaguagagaaggcacacacauagagguuuaucugcuaccuaguaaacacagggaggugucagggcuggagaauucaauaguaauaauaagcauuuauauggugcaaugacaacuuugauacagggcauaauuuucuggggauugcuauuaauugugacucugccugugagcggcccccuggugaggggcuuggaacaccaugcagaguuaagcuauauuaaacaucaauuaaaauaguguaaaauagcaacugggcaaaauccauaaaggucagaguagcuguaagcauggaagcguggaugugcaggguuaggaccuagguugccuacugccgugggggauucguguggucagcuauuagcuucugcaagggccaggaucaucagguuugcuggagagugaaccguggaacccauuagcuuucaguuagugcucagagaaguuucagagaccacugcuagccagcaagagaggauauaaaaacaaccagagucaagggaugcauucuuuaucugugcuguccaggacuguggccacuggguauaugcagauacugaacucgagauacacaugcucacacacacccucaccucaccugagaaacggagaaaggagucaguggcuaaauuaaaucagccuuggcuugcuuugugcccaccuucuccugacugucccauuuaccaacucugaccuccaugcucuuccccgguaaagugacuguugugggacuaagugaccuuuacacauuuagacaaaaaagaaaagaaauccagaaaaagaccuaugaagccccgugccucugcacagugucccuauucaagugucagccugcacugaaagcagcccuggucucagucccuccccgccaagaggcuucaccugggcuucuuaucccugaaacacacuuccaaguuguuguccagcacccaaaucuccugaggcacgcuggaugccauuguugccuccuuuguauggaauacaucuacccucaagaaagucgacaacagccagaaccccuaaugaugacucugggucauucucagguguaucauuuuggcuuggguccaugaagcaagagggguauagaaguuaccuugggaagucaggucucagaugcugacucaguggcuauuagccagucccccuccaccuagcaguagaaagucacugcuccagagauuguccucggccgcccagagccccuguggagcugccaacacugcacagcucacaaagggcccuguagcaucucuaauugaggagcuggugagcggccgccuucaguggagguauuuuuagcuacagugauacagccccaucuuuuugcaggauguuuuguuuaguuguuuccuuaaaugaaauaaauaaguaaaauugaagacuguacuacuuauaccccagugccaacacccaagaaguuacgccgcacccccucaccauagccuauguaauuaauucucccuaagacccaggugcugaggcacaguauuagucagaauauuagagagauaucacacacagaggcaagaaaagcuagcaaagagaggagaaacaaugcagucuggccuagugucuccgugcugugggcucugcaagcagcgugggcagccgggaaccacccuccucucgggcugcucgggccuuugaugcaucugaugcaucaagugagugggcuuccuuccacuccugagcagaaggcgcccugugcugcaugagaucccauucucuggucugcuggggcuuagggauggggacaugggguugggguuuuguugucguuugguuugguuugguuugguuuuaugcuuuuauuuuccuugccuuugcccuaucuguggcuuugucgugcuuuccuugucuuuuggguugguuugguuuuggcgucuauauuuauuuguaagagguuuugguuugguuugcugauaaagaacuagaggauaagcacagcccuugcuucagaccccguggcaggauccuguauugaccauggcagucauucgucacccuggcaacacacaugggucggggaggcacagaaaagcuacuaaugcuuggagacuucaucaaccacaagguuuuuugguuugaggcuuuuuucccaaguuccccaggugcauuagcugauaccuagggaaagcuuuguuaauuuugguaggugugauaauagcauugugguuauguaaggaaaugaccgaguauuuuuagagaugcauacugaaguauguaaagcugaaguggcaccauggcuaggauagacuuuaaaaugcugaagcaaagaaagcggggagagagaacgaugaagacuuuauuggaucucuaugaugguuuauggaguacucguuaguauucuacuuucagugguccagauuucuguuuucacaguaguuuuuguauaauuaaaauauuuuuaagauuuuuuuaccaccacucccccugccaggaauuccuauaugcaucuaagguuaagaacuacuggcuuauuuggaaauuaaauucagaccaccuuacccuagcugaucaucuuagaccuaaccuaguucaugacuuuggauuucuaucagcauaaacuugaucccuccagcucauaaacagugcacaucuggggacaggaugggcaggcacaaagaacaaccuaguucugccucuagacuagaauugaggaguagcucaguagacagcucuguguguuccccacaacucuuuaggagaguugcuguaccuuggagcugaccugccuuaccccuugccaaugcuccauccugagagcuucucuggccacaccaggggaauaauggugguugcagcuauucugugaucgugauagaagaaaguccucauuuccuuggagcacuuuacccacugcugguguguccuaaaauuuguauccaaccgucauucccagaaguccauccacauucucuuccucccccaccccucccugugugugugugugugugugugugugugugugugugugugugcgcgcgcgcgcgcgcaugugccccuuguguccucaacauugucccaauucccaagugcuauuuuguucuggcugcuuaguagaugagaccaauagcagcugugcagccaaauuaaauggaguucuggacgaaggcuggagcuucuauccuacauuugcaccauggccuugauuaggacccuggcuaagcgcuucuucauucaaaggcaagcuacugacuaaucuuuauucagggggcuuugugacuuacaccuaaacauuaagcuaaucuguguguugcuauaggguccuaagagggggugagacuacaggcgaucuaggucacuuaucagacuagaauaaauacaguuuuaccagaguauuuacugagagcauugcugccaagcucccagcuccuagggcaguccuuuuagcagaugccugccugagaaguguugaggucaucuacccacccugugccugugccaaaggacuggggcaucucuggcucccuacaggguugaaagacaaucuuggcccuaacaauauacucauauugucuguguucacaauccaaacugggugaauuuucuccuguccucuccuuaaguacacuacaauggauacucugcaagcccauuauauaccuugcacuucguuucuccaugaaacucuuugagcagauggaggcugagauuucuccugcuucuggcuugcucuaagcacacaucuccgccaugcauacccccuagcccugccugcugucaucccgcccagccuagccaucucagaugugcugaauaaccucaagggcaggaucaagucuuuauuguucucuugcacuugaccugccccaggucacagaacaggguucacaaaagcaugcaaacaaauaaauaggccaggugugcuaguuaguucuugucaaccugacacaaaccuaaacauaucucggaagaaggaaucucagaugaggaauugccacaucagacugucuuguggauacaucugugggacauuuucuuaauuacagauuaauguagaaaggccugguguacugugagcagugcaauccaugggcaggugguccuggauuacauaaggaaacuugcugagcacauaguagggaacauuucaggcagcggcauucuuccauggucucuacuccaguucuugcuuccacgucccugccuucugcuccugcccuggcuugcucgaggacgcacugugacuugaaagugugagcagaugaacccuuuccuccccugguuucuuuugggucgugguguuuuaucacagcaacaggaaagcaaacuagaaccaaggaagggcuaaggccaggagugcaguugccuugagccagaagccucacuuaaaaacugguccaucuuuuacuugggccugugaaccuaaaccauagggcaaucuggaguugcccuguguucaccaagaaaggacccuguucacugacuaggaagcuugccucgugugacagacaguuacagagaagggagggauucgguucuccugcucuggaauagaggauugucugagucagcuccucccguuuguuugccugggccuggcuaucuuuccucccucgacuuggccucagaagaaggugcuacauuuguagaugggggcucccuuguuuccuaggacagucauugacuccuguugaaccugaaggaaggcucuaagcaauagcucaugcuucuguaaccaguagcaaggcucauuuggcuaucagucugaccagucuucuccuggccuucuccaauguagagcagagcuuucuaaucuccuggaugauuucauaauaaugaagucccucucgccagcccuaagauagcaaugugaccuaaagcuuaaaugcuaguuuuguuuaauauauagcaaagguagauuaaaggaaaguagagaaaacuccugaagagagaaguaccuagacacugguaccuaaugauuccccagugcagcuaaugcgcaccuaagaggaagcccagccucaggggucuucaguagaaggagccaaacagugccuccuucccucaacaagccuacuguggcucccuccacacaagagagcaucgcaccccuguauccccucucugagacaggucccucacaugguguaguuagcagcguggcagauagaaaccagcauacccagugcccacugcuuaaccuugaacacaaaagcacagaggagauagauguagcuauagacaagagcuuaauuuuguuuucagagauacugauaaggaagaauaauccagaggugacucuauaauccccggaaugacaguuuuaaauucuagcuuaaggaaagcgucucugucuccaacccuaguuccugagccucacauccugcucuucaggagcagaggaaccuggcauagcagugagagacagggaaggccaggcacugugaaauuccagacagcuuccuacccucuuucuguaucuugucagauuucaagcuuuaaguccguauuugugcucugccuacuuggcuggcugugcuugcacuugagcggcuuguuugccuggacagguccaagcugucugagccgucagcagcugcaccuccucccucgugccuucugucugagccaaccuugauucacagcagugcagauggcccaagccauacccggagacgucugccacuccuaucccuucuccugcccuguuuuccugagaugagggggcagcccgaaccagauuugccuacaggucaaccugggccgaaacggagacagcacaugguuaguucauguucuuuagcacauuaagcuuccugugugauuuuaaagacaaaaggaacugagcccaggggacaaggacaaggcaaggcucccguucauacugaguaagaaaugcuuuccagcugguauaagcacuaaccuagacuugcagguagccuuagucacacccacucugcuuccuuagcauugguuugagcugcaagagaauccagagaaaggaaaguaucagaaauuccuccuccuccuccuccuccuccuccuccucuucuuccucuuccuccucuuccucaucuucucuuucuuccuuuuccagucauuacagacuuuggcaauuuuucaaagcacugcucauuuucucaggauucucaauguguuaaaagguaguaguugcauauuauuuaaucauuuagauucucuguaccuuaucccccucuaacagaaacuaagucacuauaacaagcacgaggaggguuguggcugacucuccuuuuacagaggaagaaauguggcagcaaccucaggacagcccucaacuuuuucccaggguagcucacugcuagcaucaggacuguuaacuacauaggaggcagaccauagucuaucagacucugccugagugacaccucccaggcaucucuucaaacagccgacuguagggagggaggccguggcagcugcucugcacuagagaacucuucuagucccaggcugcuggaguaaggaagaacagaacccucaagcaaaacucuccuguagaggaacaucaagaaaaauauuuuccacucugcacaauacaugguguguuugcugcaggguaagcauagcuucagucacugguaaugguaaaauauuuugcccaguaacauccuuacuguaauaaaggccugaagaggcaugugccuggguccacucucuucuguacucuccgucuaaguggaaggagguugugcuagugguguaggguuaagagggcuguagucuggcaucuucucucucauuugguagagaggaaguacucuuugucauaguagaaugccaggaaccuuauuucuauaaagccacauagcagaccucaccagugagaucaguucuguauucuuugugaggcuugggccucaucaucuagaauuagaugucacuuucucuuccugcuacaauggugacuuaaccucuuaaccauaggaaacauaaucuacuggcucuuuuuaacccaguaagucuacuuguguaaaaaugcuggacugcagguaaucuacagacaguccagguuguugggguggauccgaaggaucuaaauagaaaauauuugucaucauucuaaaagaaacuaucaaauucacagccagacugcuagccagcaauaccuguggcagauacaccaucuccucucaccuaucuaccuccaccccaccccuguuaugucucagaauaacccuggaaugcucagugcggugucaguacagcaggccuccagcagagccacugccuucuuuucuuuccaucguagaggcuucauuucaggauagggagguucuuccuucccucgccacaaaacuuccauaagccugccuugaaagggacccacagaggcucuaugccaccuucacuauacuauagccaucuagguaucugccugaugccaggaugcucuggauaugaggagaagaugugaacacaacuagucucucaggaagcuuuccuaauggucgaguacaggaccaccucucaggcuccaaguguuguaucccacagaguuucacacuuaagacugcucuguuuccucugggggaaaguugagaaaagauuccaccacugacucuugguuugguugcagugggaaaaccacugugcugcccugggucugcuuccaccauuccacagauuguaucacaggcuggcccccagcagcagagggaagcccucuuguagcucagguagaagcaucuguauacuugcggaguauacagauuggagcagugaggccugaacuuccaggagggagaugaaguaaccuuacaggauuggcaggcccacugcagccaucucuagucugccuggugauuuccauauguuaauccauauguuaaaggcccagccugccuugacuuggaugcucagguccuauaccauaguggcauuugugcauggaaaggagagaggaacuuugugcuauagucuggcaccugacaagauuucucuauccagcaagccauugccaguagagaacugcugaaguagcacucugugaguugccugggagaccccuccaucuucugccaagucaaacaaaccugccagugcaguagugaauugugucucccaacagcuuugugcaggacacagccuuacgggaaaguccugagcgccaacaacagaggcgucugaggagagacgaauugaugcagaaaggggcgggugccacucagucaucuaaaugaaaaggaaaaggucaguggagcuauaugggguccagguuggauuguugacucugccuuacugcagcaaagagggccagauaaccguccagcccuaggcacugccagccccuuccagcugccgacagcucagcacgaagacacacaugcuuucaguacacagauggguuugcaugucagcaugagcccauuuuuagcccuugccuaggacgggcaguccaugacacaguaauuuaauuauauuugccucccucuguggcccacauauuugaagagguuuggggggaauggauccggcugaggaaaauuacccugccgcucuggcacugccccagagcugagccgcaguaccauaaagggucuugccauccugaauacagcccagggcaucugucugcacugcaggcucucuggacaggcugccuacugacacaucuggcaaagcagccucuggaagcuuccuucucuaucacaggaaagccaguaggggcaaaauaaggggacuuccuccuccccucgucaagaccaacuggcagugguuuccacaauaacuagagccacauuagcucuaaccagauuccagugcguuaaaacagagaugagcucacauaccuucacugacugucucuccagccucagggacagcugugaucuuucuugacuccagaguucuuagaccacacacauccaugugugucugcccuggaaaugacugguagagggaccuaaaaaugauuucccuucaucccaaaaaacuuaugccuguuucacaacucgugugcucaucaguuguuacccagugugccugcacuugcaccacaccccaaagaccugucuuuaccuccuagccaauaagccucccgugagauucaucagcuugucuugaagaacguagucuuuuccccccagugcacuaucccagggaaucccuucugccuaucaccaucuucucaucuccgcuguuuaaugggacaagagggucaugggggcuggaggguuccuagucaacuguaucaagccuucuagagaagaacacucucuuuguugucuuccuaucucaguaccaagaacacauccuccuugcuggcuaaucucuccugcauaaugauagcagcuccucugagagaaagggaauuuucuggcacaguuugucucaacaccagcauaacacaggcuguugcuuaagagugggaaucauuagagucaggccauuauugaaggggaccagucucuaggggaacuagcagaaauuaccacuccuuaauagauggaaacucauuugcuugaagccccugcccuccuccuuauuucucugcauucccuaccuccccacucuucucagcuuugaaguugaaaagagaagcaacuccacccuauccaagacggaaaaugucugcuaaauuaacuuggucaagauagagccuuugcugcaagugucucuucuuuuagaauguuucuacugggacuccauaagaaaccacagcgaagaaggcacauugugauuaaauaugugauggaauuauugcuaggacuacucuguuucccaagagaggauuauugccgccaugguucagaguauguccccaagucaguaugagcauucccucugaggaccucauucucauugcugaaccacacuaggaaagaccaggacguagaaccaggacuacagacuucucugcuucuccaguggucuucacgaccuugacaaaacucuaauacaauuuagccuuuccaagcuauaaaaauggcucagccaguuaaagucuaggcucacaaccaaaaaacaaacaaacaaaccagccaagccuucccugcccagaggcaggcauugucuuguucucaccaguuuagagagaaggggaggagcacuuaggcagcaaggucccuuuccuugucuguuuguacugccacuaaacccacaugcugugguauacugaaagcuguaagaaaggaaaguugccugguuuuucaccuccuagauaaaaucuggaguggauaccauugaugucauaagucagagagcuggugggaaaguccuuccuuugcccccugcaagggaacuauuggagacugcauagaauugcaagcuccaagggucaccaguuacuuugccauuccacacaugguuccccuggaguccagcauuauggagacccugcuggacugaccagaaaucuggucuucaugauauuagcaaaucacaucucauuggguuucauuaguauucuucaaaaauaaauugggguagugcaacaaaacucucuagugaauuuggagaguacucuuaccuauguucacaucccugacauuagaaaacauaagcccgugcucugucucaauuuccauugucaccucaagguuagcuagccuugauuaaaccccccaugaugugaagaugacaucacccagaguugauauaugcuuuuacacggaggaggaagagggacugaggaaagggaaagcuuuaugcugacauaguggacuuaaauaagaaaaaccucuaaugggccaacacuuuggucucuguagcuucagaaugaaacugaagugcacacaccagauguaguuuuguuuugagguaacugugucaugcucugaguaccuuacaggguaaaaguagucuuccuuucccuggcuccucuagcagucucccccuugugguuuucuucuccuuccuuucauacuccagacuucccucuccccauccuuaaagagaugaauuggaagaauaugcugucaugucagaaggaaaccauugucaguucacacaggcagacacuaauaggauaaaguauuauccgacuuccuuuaaguccagaaaugacgucuucuuggaaugguaauagauuaucguuuguaaccacuguggcugccaggcuacaggaauaggcugcuagugucugaggccucagcucuguaucugagcucuuacaagggaugcacugagcauuccuccagucaggacuaaaggcugacacuugguuccuggauggaacugccuauguagcaaagucuauauaacucauucaauuuaccuaugggagggggguuccccaaguuggagcaacugucuggaugguauuaaugaacucagacacguggguagaugaagaaaucuagaccuuggagacugggaauaaguagccucaggccagaaacccacacuuugcagaaggaacugugaaagccugucucccucugcuugcugacucaauaucaaguagugauuuaccuagugacuaaaguaccaccggcucagagacaggaggaccaaaauugaggccuuaaaggaaguauaagagauuaagaaguugcugcagagaggcaauaagauguaaauaucagaggaaaggaagaaccauaauucuuguauggaagggucauucaggguuucuuaagcccugucauggagauuaugaaagaaaaccuaauguaauaagaaugccuuuauuaguggacauauaaaaaggcagguggcuacuaaagaaacaaauaaauugaggacuguugcuacuauuuaauaaugugaccauagugacugcucuaguacugaagugggugagcuugaaaggcugagucuuacugugcagcaggccucacacccgguacuagaguggccucucaucuuagugccucccagauagaaguuccaaauucucggagauguugcucccuaaucaagugcuaacuugcuuugacaagacagcuucuccagcauuuccccacaggccuaggccuacucucugacucacuacaaguauucauaugcacugaacucagucaucauaauuucuauaauaccuucccuuguggguaaauacugaacuguggccucuacugcuuccuuagugguuuugguuuugguuuuuugagacaggguuucucuguauagcccuggcuguccuggagcucacuuuguaaaccagguuggccucgaacucagaaauccgccugccucugccucccgagugcuaggauuaaaggcgugcaccaccacgccuggcucuggugacuauaccuuaauagaaauuagggaaaugggcucauagcagaccuaagaaagugcucagaguccaggauaaaauaccaucugaagacugccuugcuuuccccaacagugcacagccugcaggagaaggaucaggacucuugugaaagcgugugguuuggcccaagucccagcagcaaaaaaaguuggcauguaccagugaauaaaaccuaugaucacccuuaagacuaauucuagacucucauuaggaaagcaacaagcauugguuuuuagccugccuuggaaagccuauccccugcuuuucuucuccuugccccaugucacgcuaacaauccucugccugguccaaccagcaucuuacuaaauuuaaaaaaaaaaaaaucuccuucuuaacugcaccacaggccugugugucuuccacguagcuucauuuuucucucacuuguuaaaaucauggugcuugcucccuuucuucaagggcccaguagcucucucugugcuucuccaucuuggugcuuccuccuuccuaucuccagaccuggucaggcuuuaaaacaaggaagcauuuguaucauugaccuggguaauuuugguucaguugccccugguagagaacaacagauacaugaagagucuaggaagcauggcaucuuguuaaagacuaagacucccugggcagaaauguccuguucuuccucgguuuuuacaucacuauuagcagaagcaccuuuaucaaacaguaauccauuccuugacuaagacaguguugugggccagcugcagaguuaguuagguacagaacacaaaacaaaauacaaccaucuuuuccucuuagguuuggguuuuuaaguagcauugucuccaacucacagauaaccauucuuucccuauggcagagugaaaaugagaagacacaggguucaaggguagagguaauaaaugggcacuggucuuuggucuguauauuuaaaucaucaaacagcugccaccuauaaaauaccuacuauaccacaucagccaccacacuaagugugagauaaauauacaaauucucaauguuuacagcagccuaugaaguagugaagcacauaugaauuaauagucuucauuuuacagaugaagacacucagugcuugcuaagucauaagacuaggaagugauggagcuggaauucaacccaagagacuggcuucagauccagagucuguuugcaagcauuauggguguucguuccccccaaccuucuccccaaccccaccaugcauacacaggguguaauggaacaacacuggccugguuuuuuuuuuaauuucuuaaacacgcucaagauguaauuuacuuauuuuaauuuaaagcaaagauggaaacaauccaguaccuaaaccauucuucccccugcagaggaaaggguacuuucuaaguggauagaaaccaaagagagucacuuugagccaaaagcugccuugcaguuuagcugaggcaggguuuagaaaugacaugaacagugccugucuuaggcaguggcguggugugcugagugccagcagaggagaucaaaucagacaaguuuagauauaaauguucucucuucucuuuuaagcccuugcugccuuagugcacugaaaugguggaccaucuuggaguacaguuccuagccaguggaggaaggccauugacucuggcccucuugccugcccacaauaggaauugucuugcaggagggacacugcauguugcucugccuagcaaguuacuggccucaauacauguuaaauauccacaauaaagcuaaugucucuaagccuuagagacuagccugucuaccuucauugauaauagggugcagcauuacaccaaagggugcuaagaaguccuggaguagauuguacaaauggugaccacaguguggcauuaaagaacuaaauggcucaucagguaaaggcacucauuacuaagccuaaugaccugaguucuagccucaccacacaugaggaagggaaaaaccaacucccacaaauuguccucuaaaagccacgcauaccccauccccccacuaagucgacagaugugagcauuuuaaaagagccaaggcuggguagguaucuagaggagaggagggggcucaugcuccuguucuccaucccagccgcauuauuacugggcaaaugacagacagcacucccuguggagacugugucuaauaggaacuuuaagaccuuuucagucagcuacuuugcagagcuuugcagccuauaguugggagggagccaagucaucucucucacuggaagcaccaucaugccuacuuucaacucuccuguagcuaucacccucugugggauucugcagucucugucuaccauugggccuaagaauccagaacuguaugugcacuccugaggcucuaaccccuuaugcauguacggagcuccuguugucagaacuguugucagaccuuacaggguagcugagcuggaugggauggaaagggaaauaccucuuuguagaagaagagaacacacaaguaggaagucccauuuuaguugcauaucaguaaggggaaaaaacacauuuggccuaggacucuugacuaagagucccugguucuagucuaaccucuuccauugucagugugaccuuggauauguguuucuauuucuguagcgcucaguuuccuugaccaaaaaauauuuuuaaaaauuaggcuaaguaauuuuuaugaccuuaaaaauucuauaaugaaaauucuguaauuccauauacucagcugcagucuuuccucuaauguguugcuauaacuaccccugaagagcuaccaacccacguuccauucccagguaaccagccuuacagcuuggccaggcuugagaaugagucauuaacgcagccuugagccucacuucagugcucuuccgaaaaaagucccaagcuccugcuuaagggaggauguaccccagcugcauggcaaaagcaggguaccucuuaacuggauggcagugcuagaccagaggguaagcuacuggggaaagagcugccuaugaaaugccaaggacacucuugccuaggguucccccccucucuccccacccucaucgcuucggguuccaagagcagaagauccucaucccuaggacagaggcgucccuccuuaggauuuucccaccucucuuccucuguccucagaccuuuguuuagcccaagacccuuugucauugcagauacugcauaauuucugacuucccagacagcugucagaaaaggggauguuaggaaaucagaaaucagcgccccaccuuguggugcugaggcagcaacuucauccccacuugccucagaauguauacccaggaagcuguucccaacagccugaguuguguccauggcacuaggaaacgcagucauuucuuggauuuucaucugauccugggccaagucccacccuuugcucugcugcgguuuucuuucuuuauuaggaauagauaguaaaaggaggacagagagaaccagccacuguugccugcguuuuaagugcauaccaguguuuaugugcugccauaggcacugauagccagaaaugaucuguauaccuaggaagauucaaaauuggccauuucuuagccaacugcugcaaagugcugccugccucuuucccuuuucagugccagauagaucacacccacucaguccucauucccugcauuaguauaaauauucgcugaagaaacaugagguccuuguucauggaaccucccugggagucauugcucugugaaccucaagagccagacccccaccuccuccaaacacaucagacuauucagcaacacugccugugggaauuugcagccaaacuacauuaccgaggcucucuuaaauccaagccucccaggguccucugguugagccuguacugccugaccaucgggaucugcugagguggcgguucacuucuggccaggucccaggagcugaggcugacccauuuccccugcuuuuuuccagggcauggggaauuugguuauauccccaacaaagccagggacuaacacacuuagcuugugaaagaugcacuggaguuggggugcauuuauuuaaacuaaagaaaggugguugacagcuuuuagcauuuucccacacuuaaauuuaacauugucucccuccccacaucaagccucuucccuccccccacccccuucauuuaaauauaaaugacucggucuguguguauaaggcuguauguauagguucagaaucuuauucaauuuaacccuuuagggacauugaauuaaaaauugaacaauauuuauuaaaauacaaaaauacacuuuucucacauuacaaucaguguucuuuuguuggcaucucccacccauaccacccccuuucaaaucugaacccuuaauuuucucuuaaagcuaaaauaauaacugaaaguuacaucauuaaauggaccagaauaagagaccuugcccuugcuuguaacuacuggagguagccuaggggagggaagcuucccccaauggugcccauucaacagaauuucaugcccaacucauuuguguguuccccuugucaguguucuuguaacauccugguuggcgaaggcuucuuuaaauugagccugugcccuuuuuagcucuccuuccccucucuacucauguucugcccccacucacucuaucaccacaacuaguuggcaucagcugcaauaaucccuaaugaaucagcauuuagaauagucaccaaauccuaagcaagagaaaagcuuccacucccccaaguuccccccauucccagccuauccuccuuuccaccucaaaacaagcaagaucuuuuuugaaaaaucauaaaaugucaucauugucuacaaucauuugucagauacccggaacaacagguggccacugcacaaugcugauuuauggccuccugugaaucauucccucugcugcugcugcucugcuucccuuccuccugggccggccgcacccccuucaggccgccuccuccucccgggaaacccugaauagacacaugccuugcagaguggguuaugcccaacugcaggaaucuggugcaaugugaaagcauuugauggagagcuacgccagcucccuuccuuccaagcugucuugaagcauugucaggggagacacaugccagucugaaggcacaaacccagaggauuugcgcacacguacaaagaaacaaccucuggaaggauuaguuggaauuuuggugguuuuccuacuuaaaauacauuuacagaucuaucuuccccauugucucuguaggggaaaaaaaaucaccgcucaaccuuugggcacaguacaaauuugugaugcuuuuuaaaauuauuuuguuuaauaagauagaucuguaaagacagcucucagcuuaagaaaggugucuauagaaaugguauuccuagauccuguaaagcaucuucuaaaaauugacagaugcaggcuauccucccugcccccagcagcccacacccugccacuuuagggguguugguuguuuuaguuuguuuugucuuagcaguuuccaccuuacagcaguugacuugaggcuccuacccacaacauugccaagaaccccuucccuccccuuuaaauagaacuuacaaguuagaaaauaguuuuguuuucauuuuuuuguuuuuaaauuuuaauauaaucuuuuuuaaccagcccauagauuuaauauauaagcauauacaagaaaaagucucuccccacucuguacaaaaguugcucuuuuuugugcauucuauugcauuuuauaaguuuuugagggagggggagucauauuugaguuuccuguaccuuguccuugguaugggucugaauuauauaagguucagagauaguggugacuguggggugcagagaguuccccaggcuguuuucuguccagugggccccaugugcugguuuguagguguuguaguuaauauggucauguauugugggcaacacuacugcccccucaccugauacaccggacggagcugcuguugcugcugcaggugcugcugcugggaugucuucauccaccuggauaaucucuacuguccuggcagcugugacuguacuccgcugcuggugccgcuugcgaaguuuauagaagacaaucaacauggcagcagcuaggagagucacugccacaaagcagccaaugaugaucuugguggucuucaugacuucauccaggcuggucugcaucuugucagugguaucuguggaggguacuggcaccugcuugggcacacggguggucugaaugagcaccgugguagaggugguauaugccggcugguaaccaguggauguggugggaacaggcuuguacuuccguguuauguccucaggugauaucucugugguuuccacuguuacaguggugaagaagcugaaguuggggguguugagcucggccgagcucacauugagguaggccgaggcauuggaguugccugccacauuggucaccaugcauguguauacuccagugucuaugagcagcacacgagaaaaguucaaggugccaucauugagaacagagauccggggaugccgggaggcguggcugagcacugucccauugggcagcaaccacuucacagaggacauagggggaguccgacacuucaguucugccauccgauccucagagauauugaggucccggggugcauccaugaugaaaggggcagagcacugaaaggcagccugguccaccucuaccagguagcggccucgcaugugcaugggagcaugacagcggccacagcagguggaauugguugggauauacucccgaagccaccaagccagccacagaauaucacaaucacaguuccaaggauugugguguaggugcaacuccaccagguaucucaggggugugaagaggucauggggcaaagaugagagguuauugugggcuaaguugaguuccacgagggaagccaguccgucaaaagcauuccgcucaaucaggcugaccugugaguucaucacccacaguuuuuugagggagcuuaggccauggaaggacccaggccugaucucaggaaagugguucccugacaucucaagcuccucgagccccaccagggguguaagauugggcauauccuuaauguugcacaugcccaaguucagguacuugagguugaacagccccucaaaagcccccucagagauauacuccagcuucuugaguucccccaaguccagacgcaugagggagggcacccgguugaaggcauaagaagggaugcucucaaugggauuguuucgcagccagagcucccgcaguuuggacagguacucaaaggccccacuggggaugacugucagccaguugucgaacaguuccagaguguugagacuggcgaggccauugaaggcccccaccucuaucugccugauggaguuccugcccagcugcaggaccuccaggugauggaggugccugaaggugucggccugaaucaucuggauguuguuuuccaugagguugagauaccggguguuggaaggaauacccugugggaccucagagaguccccggcgggugcacaccaccuugcugaacugguuacugcaggaacagacggaggggcaguuuuggggcccggcugaagcggcagcagcgauggcugcacacagaauccacacuugcgccgugagguagacgacgggaagcaggacggcauuccagguguggugcacaguuaccugccacaagagcuucaugguguggcacguucauaauucaccaucgccugggauuuuggcuuggaaaagagaaccagccuuaccccggcuuaagugagcuaggagcuccucuuuccaucuggagaaggagguggggagggggcgauuagagacaagcagaucggccuagaaaaacccugcgaaacuacugagcggccccucaucuaccagcccacccucaaggccaacccauagaaagcuaagacucucucccacguugcgaccauccccacccaauucccugucaccuaccucggaaggaaagcaggaaagaauuagcgcuguguccuuaagcuuucuccacgagagcugggcucaucguucccauucugacuuuaguuuuaauuaacaaagggggaaguagugggggcagggagggcagaggggaggggaggggagggguaggggagacaaaauggcuucuaguaaauccggagccggcgaagccgcggaguugaggcgcgccagggagagccaaggcccggcgggcuaugcaggugcaugcccccccgagagcccgaggagcggcgccaccagcgcuucccugcuuuguccuuggacccuggcaccagcuuguuccagucgcgggagaaggcgcuucaucgccaaagugugucuccagcccccagcccucucccugggccgccgcgggggaugggggugcgggggcgcucccgaagccgcccaggccgcgcucgcugguugcugcgcugcucuccacucugcuuucccagcgucggccgcccagagcuggcggcagcugauugcagucgugagcucgcggggcugcgagaguuaagagguguucgcugcgccuucgcccucccuaggcacacacccccuuuucucuucgccucuucucggaaggguuaaaaagacaaaaacugggcucaguucuccagucccgccgucugcuggugcggggagcgguaauccguccagccccagaggggcagcggcguggacguggugcugggacccaguccgcgaacggaggagcgcgcagcgcccgcggucgcgcccgcaccgcaggccccuucagggaguccgggggcgggcgcggguccggcagcggcggcggccgcagcccccggcagcgcgcaagcgcccgccgccgcccgccacugcugggcucccggcgcgccgccggccccggcuuugugcggagagugcgaguucgccgcugggcucccggagccuucagcaacggagcugccagcgggcugcugcagcggccagagcgcuggcgacggcagcgugagcaguggggguagcggcugcgggaaacgcuccgaagccggugaacaugguccccgcuggcuagcggcggcgguggcagcagcggggccccugcgcucggcgcccaccgucuccuccucgcgccgggcucgcgguguugcagguggcagccacgcagacugcucucucauccuuuuguccuucagucagaacgugaauguacugcugacgcauacuguucuagggagaagauuagcgugaugcagugcucuuauguauuaacaccgcucucccucugccgccugcccucaagggguuaacgccgcgccuuccagcacgcgcuggcucgcgccgcgcagccccgagucgcggagggcugccugccuuccucgcuucuuccuuccuuccuuccuuccuuccuuccuuccuuccuuccuuccuuccuucuuuuuccccaccccccuccccccucccccgcagcuuccuccccgcccccucuagacgaucggagcggcccgagcgggcgagcgggcgagcgaguccgagugagcgucaagugaggggcugcgcgcuagucgcaggcguucgcagcuauuuuggucaggucggagcgaguggcugguuggccgcugauaggcuggagccgugcggggcugcagcggagacugcgcggcccccacccgagccacccagcacccuacagccguggacugcugggcucaggggcccgggugcggcggcccucgguggggcugcagcaguuggccggccuccuacgagcgcccgcgucauccgcacccccgcugaaugcugacggggugccuggcugcgcggccagaguuuggaucugcaggaugguggggaccuaggggcaggcagccgaauccacgcaagggcugcguugagucagaagaccaaagucuaugcuucgccuuacucugugccuguccuuccaguccccucucucgaacauuuucuugcccccuccccucucccacaguaacuagggcuuuaaaugauaguuuucuuaaugagggcugugggggcgggaaacagugggaagaaagaccaaauucaaggagucggggaaaugacaaccuggggaggauugaggugaguucugagaacccauggugcagcagcccgugguucauucauuggggagcugccugcagccuugccucucagaugcccccuuccccuccccuguaugcaggggccaguaagguaauuuaugccuucugccccuggagcugcaccagccucucucugggagucccuuagcagcuugcugaaaggggaguucuggucccugcuuugacaggcuauuguaaaagcauaggucagcauuugccaacucauuuccuccauaaaagaaccucuuuucucaaccaugugagggugaaacaaucuauagauuagcacugugcuguagguccaguagaaucacugagauccucccagcuuuugccuguuaucuaacaaguguguuguuuaaccccauuguucccacgugggcuguuacuuacggaugaggaccccaggauuucccaacuuccugaacucuaccacagccauaaucucaguauuaucugcuucuucaaacccuaaaccuucuccaaguccuagaaaguuccaauguccacaauuuuguauuccuguccuuuaccaagaccgugacauuuauauucgcugucaaggaaaaacauuagcaugauauuuuugagccauuucuuuaugauucauuuuaugaauggguagaauaaaguaugugacuagagucccacauauacuaaguuguagcaccaggauuugaacccugacaagccccacacagauuggugucagggcucuugggcguaggcaugauuccacagaguguucuuacagacuaaugcagucagacuucacccuccacucgcuaguccuuguuaggguguuugugugcccaccaugcuaagaauguaccugcgacugcucuggugaagagacugcccccuguugucuccauuuuccagguaaagcacuugugccagauagugacagucagcuuuucaagucagucuucaauucaugagaccagugaguucaucccuaacagaauauccacuguaucuacugcccaggccagugguggaggcaagguuggggagagacugaacauucaaucaaggguauaugagaaaucagaaagagcaugagagaaaggacuaagaaagucaguccuacaaacguaucacuugugaugagagaucagagggagaaauuagaaacugagguaagcccuacacucaugcuaaggucuaauuccaguugacucugcaguggcuuuccccuuggagacaggguuuuguuuuaaagccuagacuggccuugaauucauagcgauccucuagccucaaccuuucaacucuuguaauuccaggcaugugccccaauccuuugaauuccucauuaaagcccguguguaagaaggaugucacugucuugugggcccaggaaaugugagccugguacaccaggaaucuguggggaaagcugucguugacccagcugcaacuaagcagggaaaguguuguguuauuggggauauuggggguggguaucacuagggaauggguggcacacaggaguauggugccucucucuccuuucaggaaaaggggcucugccugaacugguuuccugcuuguguaggcaaacuggggccccaucuguucagcugcugcccccacauuguaaagguagaugggagggagggugggcugaguuggauuaaaucacuacuaggaacaagauuaucucguaguaaaugaagucggugcugauuagaguaaauguucccaaauucaguggagugcuacaugggauugcuuuacccuuuaugggccagcuaggccacagaaguuccuggaaccuacagaguagacuaaagaagaggcugucaaaccugcaguucacaguccuccugaccugaagcagucuuccagcgucuuacugaguuuccucugguauuuugccccucacaacuaguaguucuggcuggugccuggaucuguaguaguaccacuaagaaauaagagaaggcaguucacauuuaaauaaggaacacugcaguggacugagaacaugggcaguuucacauaggcacuguuaaaagaaugcuaaagguguguucaagaggcuggccaaagccugggucagcagcucaguuuugaagaaugggccuuguacugaaguugggaugccugcguucugguuguuguuucagauuagauagaauguauaaugaaguaugccuugauuuaugaaaucaaggagaugggcuagaaaguuucacuuacuucucagaguccaugacuuucccuccuuuucagacaggcagcuuugggaagaaggcugauccuuugggguuguagccuuggaauuaggcuguggagcugaggagagaauguucccuucaguuuaguauaaacauccacaggacuggaauagagcugaucacagaucacagcauguucauuuuuaaagaauccuuaagagagaucauauugacuuggccucucacuuuauugauguuaaggaaacucagaaaggcaugguaacuucccuaaagucacaugacuaguuaauaucaaagucugucccucugaguuccuucuaucaguaugcugauauguggcuaauuggccuuuaaagccugggcuugaagauauuaucaaaugcuugcucuguauucuuugugagcagacauguucuaugcuuacuguuuuggggguaaagguggaguuuugauagugcuaacaugccauuucauaugacuugggauucugauaagaagucaaaggaauguucauguagagggacccagggcugccaggcuggcccacucccuacuuugcaaauaugucugucccugaggcauuauccucagcagccacuagauguccauaaugccucaugggguuugcaaguaacagcaggguaccaucuugcuucuaauauacuuuuggguuucuucuggggagguccaacaagaacagaaucagaguaagggcaagaaaaggaagagauuugagagacaggaauaaagaaggaaaaauaauaugaaaauuguucuccaaagagacaaggaaagauauuaguuggugaauuugcaaugauaaaaaaaaaauguaagaaauguuccauguaggagugcucauggccuccuguccagugcagugacugagcuucuucucuggagucaccuggccacugaagauucuguuccucuuagaggaggcucccuuacugccucugauccccuagugaggcucugcugcgauugcccacagucaucaauaggauguauuucuuccuugaguggaugguccagggcaacacagaugcucugaaaguuguuuucucuagaaaucucugcucuuuuaaagaaagugaagggaaaagcuuuaaacuaaagaaggaggaagucaggccggagagagggcucagugguuaagauugcucuuccagagguccugaguucaauucccagcaaccacaugguggcucacaaccaucuguaaugacaucugaugcccucuucuggugugucuggagaaagugacaguguacucacauaaaauaaauaaaucuuuaaaaaaaaaaaaaaggaagaagaagucaaagugggcugggacgauagcuuuguaguagaucuccaacauggcaucuccagugccuuagauucuguccccaggauugaagguggcaggguugaggcacuccauagagccuagcaagagccauuuucuaaaacuucaucugaaauaagacaagguagcugauaaccauuacagagcgcugggcuuaugauauagcucaagccuaucaaaagcacugcauuaacuagccaugauagagcacaccuauaaccccagaauucaguucacagucauccuacauagcaacuuugaagccagccugggauauaugagacucugucuagagaaaaagaaagggagggagggaaauuacauggagcuggacagauuacaaaggcuucuuucucuacugagacuuucucuacugagacuaguuucaccagggcugguggugccuuugggcuggagugaaaagccaggccuccugcuugcuagcuggcucuuccuuucuugagaaaguaaguuugggguaccauucuugccacagucacacauaagggccagcaaucaaagauguccaguagaacaccuaugaauaccccuucccucuuugcagauacacuggcccauccaggcccaaugguuugcuuucuuuaauaaccuguauauagaauaacuuuaguaacauuuucugguuguugauagguacuuaaggcuguaaacacagcacugagcuaagaaaccauuagauucacuaguuuauauguggauuuaagaaguuuuguuaugguuacagaaguaaugagugucuuaauuucuuguggguuuuuuuuuuuuuuuuuuuuuuuuuuuuuuuuuuuuuuuuuugguuuuuugagauaggguuucucuguguagcccuggcuguccuggaacucacuuuguagaccaggcuggccucgaacucagaaauccgccugccucugacuccuggguguugggauuaaaggccugcgccaccacgcccagcagagugacuucauuucuuuggcugccauaaaaacauuuccacauaauagucagugacuucagccaccaaauucucuuggagauuuaggagcucaaagcucuuagucuaguaaggcuuugcuccuugaagaaucuugaguggccuugacuucuggaggcagcccuugucuugucaauguguccccuuaggcucugccuccauggucacacugucucauuuucuucuuuccugucuguaaguuagagggacacuucugguugaauuuagggcccaccaggauaauccgugcaaacuagguuaugaaucaggguuccacaccuaaaauuaauugcuucacagaugcgcaugugauguaucuguugaagcuacucauguacccuaacuacagucuacaagauuacacgcaguguguacauguacaugccgucaaguguuagagcacagugguggccaugaggaaucucuggaaucagacaaacuugaaccugaaucucagauaggcuuuguacuguguauguguaaauccuuaagcuucagauccuuccuguguaaaguagucaacuucuuuuaucuuauuggaguacaaggaaguuuuggaauucaugaccgucucagcaaacacuaauaauaguauguauuguuuuuguuuguuuuauacagauugauugauugauugauugauugauuuugaagcaggguuucucuguguagcucuagcuguccuggaacucacucuagauccacaugcuccugccucuggaaugcugggauuaaagucaugugccaccucugucugauacauuuauuguuuuuaguauggaagcuacuauagaaaaaaaaaguuuugucuagucaauuuuugauugaauucuuucuguuaucuuuuuauuauuuagaaucacuuacucuuggcauugcuccuaauuuagaacuucuaauucuucauccauaaagugguuuuucuauuucuaacaguuaauguaauucugagacaugaucucacucuauaacccuggaugcccuagaacucacugcguagauaaggcuggucucgaacaugaaaagaucuaccuggcaggugccaccacacccagcaguuaauauuaguguacuaguuugucaacaucucacaugaccccagaacauauuuagaacugcuaagguaaucucuguuagauuaguaaaaaccuguacuguuuguaaucuauucuccacagcaacuaaagugaucguguugacuuuacgucagauuauguuauugauuuacuuaaaauguuccauuuuccucauaaauugaauagcaacggaaaugccuaccacagcuccucagccuuuaucccuuuccuucaaccucaguccugacauuuaucaaaccccuccauacuccuagcgugacaguuacacuggucaucauauucuggaauauucuuaaauugauucucucccuugggauuuugcucuaucuucaacauagcuugcucuuucccacauccuuggucuagcuucuugagcagucuuaauuacauuccccagcuuuagcuuugcuugcuuuguaccauuuccaaagaugacuaugucugggaauuuguuuauguguucaucgcauucccccauggaagcacaacauuggcccuuccuucuuuccuuccuuccuuccuuccuuccuuccuuccuuccuuccuucccagcucuucuccucaguaguaaaacuguucuuaggccugaggagaagagcuuggaccccuuguuccauggacaccauuagcccuaacucugcuccauuaucaucucugaaaagguaguuuacaauuuguugguuuuguuuuuuaauacaagaagaauaaagcggauccuggugaucucaagaucuccaguucucacuuuggacuuuccuaacuccugcugagagacuccugagaggcaguuuuauggaggcaacguaaaggcgugcagguuucugacaguuguggaugcgcagagugaguugcaauauggacacaggcguacagacauaccugcacucacaucugcacucacaucugcaugugccugucaguuucgguuuugcuaaagugcauuuucugcuaagggagugcggacuguugagccugaaauagagaacaccaggacagugagaucaaaugcuuugaaaguggcugugccaacgcuuuuugcuaauuaaagaauguuaggacaaucaccacuagcagcaguaaagggcgccccauuaccucucucuauggugaguuggguaaauuuaaaggcagcuauaaauaccccacugagcuccugagcuuaagcgcaguuggggcugggugaagaggaggccuagcuucugucuccuucugucccuucucuaauagcugucagucccuaaauuuuucaugacaacagaacaaacaguuccaucaacaaacucuuaauuuaacuuaaaacauccuagaggagguaccagacaagugagaaucaagucugacugggagccuggguccccuggguccuucuguguugccuuugacuuuuuuuuccccuuuugccugaagauguuccaaccuguuccuguaccauagauguuuuuaaggaaaacaaagucacuaggcuuaaggccacuaucccaggaauauucuaggcacccuuacuagaauucagaauuguacugucuacguucacucuuuacaguuuugggcuaauuuuaagagguaugaucaaauuuggaacuuccauguuuuugucucuugagcauggucugcucuugagugguuucuugcagcucuuccacaaccuccaagccguucuuacccgucaguuuauagagcagugccuugcuucuacuaccuucucucugccaaccuccuugauuuguuugcuguuuuuguagauagaucaucauuucuggccaucaagcugcuuuauauaauccaucaauuguuuucaguuccacacugccagccuuagcuauggcuaggauuccccuaguuccgaaugguauaacuucaguuugucguucuguacugacuuagcaacuuggcuucuuccaccaugcauucauugacccauccuugggucuucagggagugagggagaaucaaaggacacauagcauguggcuugaguggucucaaauucucuggaguggcagucuucucugcauccuaccuuagccugaggaggaguacuggugcucagaaguagaggggagugcagcccuggggaugccagaaccagccgcaccauuggcuucccccugagucaucagaugagcuauggguagguuggcuggcacccagauuccugggugcuccguuguucuuaagauaacuuuuuggggaguucgauuuacucagcauucagccugcuuuugguccuuguuuucagaugcagcuuuuaccugcagaugcugcuaguggaacucacccuuauuuuaaaggaugugccugcugguaaaugugaaauaaggaauuaggguccuuagauccucauucagguuuagacagguuagagaguccugagucaguugguuagcugggcuguucacauaugcauuuucuccuauuuacuuaccguagccucuuaucacaauaucugcauuugacuggagccaauagguagauuuguuucuuuuuaauuaaggcaagccugagucuuuugaaauuuauucuguuccacuguagaauaccuucauagaccccaccauaaauccucaucuuucagauuucgcaucacuauaccagccaaagaugcuauaagugagaagcacuuaggagccucuuuucuuggaccauuucaaauguugcuguuagggacaccagacugaggugguucugcuucuggugagugcagugaagccccacccaguugaggguccagggcuaccuccuuggagccuagcuagaggagcugucauucugugucccuuucuugguaacuguggcuaguuuguguggcagcccagugagacugcuugauugguauucugugcacaagcacugaaaaaagcccaggaggagcccugccagccaauaacucugaaagggcucuuugugcaaaugagcagcaugcgagcuggacagggcucacucccucccccgccaguguccucucuggccaagcaauuugguggugcuuuggcacuggcacagaguacuuggggaucccuccccaaaaagagaccaucuugggaucccagacacauagagcaacuugagcucuguccuuccugccccggcucuggcagucugccuccaagugccagucagugggaucuauucaaggcugugucuaugcauagauaaggggcaggaaguaaagaaaggagaugagugugaacagaccaaccaucagcaaaguaggggcacucucacuucucucucuggugggauccccagaaaccuggggcauggaaccacacugcacaugagcuuccaucacuguguuccagcaggaccugagccauuugauuuuccuaaagcugccuguuguccucaugccuaagaaagggaagaaauaagagccuuugugccugcauagcugacagcugcagaguaagacucuaucaaacuaauaccaagaagcauccuggugccgauaggagccaagcacagccaggcacaggcacuagugacuaccagccccaugcuuaaugacucuuaaggaguuggcucuugccacuaccauuuuacacacacacacacugucuccucucagaugucuuuuguuauuaaugaguuuucuaaacacauaagcuugacucgcuugcuuugggugaaggagaccauucucauuagguacugucuucuaggaaggaaagcauuaaguagguguugaagguuuuucuaaggccucacacuacaugugagccuagaagacuagaggacugacaagugaggguaguugggaguggucagcuuccugcaguucgcucaucucccuugccaucugauggcuuccugagacaggcucaaaaaguggcccaccacccaacugacaccagcuguccccugaaccuccauuucagauuacugguguuuuguuuuauuuccaaacaggccucaccuuucacaguuuuugcuaccuccauguaucucauuaaccuuaauuacuuugaauaugcugaucaaagacccagauguccaacuggugacagaaauacagguuaaaaaugaguaagcuggagaguuggguagcucaguggagaaagugauugcugugcaagcuugaggacccaaguuugaauccccagaauucauauaauaccugguuaggaauggugaccugccucuaaucucaacguagaaauccccugaacauuccagcuagccagaauggcaaaauuggugagcuucagggcaacgauagaccuugucucaauguagaaggaagagaacaaucgaaggggacaacuaaugucacucuuggguugucacgugaacccacauacaagagcaccuagauaccaagccacauucugaggaauaaaaguaacucuuaguccacagaagcagugccaugcugucagcagaaugggcauuaagugggacagugacaucaggcaaauuuggggguuuuuucccuuccuaucagacuaaauacccuuauucuugaagccaucaaagagggguggagcagagagagcaguguggaggggaagacuauagccugagguaggcugccuuaucguggaagcuagcagaguugggcucccuguacugccuugugcuacucucuccugggugugucugcucccaaaaaggaacaaagaugucacccuagucagggucaugccuuguacuguuacuuucacauccagauacuuggagaagaaaacccagggaaacuuucccauuugccugaaacaaauggcuccagacucucccucaaauacagccacuggcauuuaagaucuauguguugcagugucucugccccacauggucagguagcuuugcagcuuggagaagcacccccacccccaauucauacacacacaaaaugcacucaggcccauccacccaggggcaggugugcuccuaaugaugcacacuguagagaaagccacuuccuagaggccuuugccccauacuaggucaggagggcggcaaauaugaaucuagugccuugaaagcuuuacucugcaauucucugcaugggucccaagcagcacggucccuaaacucccuccuugucuucaccuugcuggaaccacucauuguuuuugcaucuuacaaagagcuuuccucucuuucucuuuuccugucucuuuuaucccuagucuuccauucccaaacaacugaagacaaucuuccaaagggaccuuguuggggugggaacaauagacaauaguuagucaauggaucagaugaguccuaagguucuguugcacgagagagugacuguaguucacaauaauaaauuguauuuuucuuuguuaacucuguggggugugugugugugugugugugugugcaugcgcgccugccugccugccuguguuuggcaugcaugucauggggaauguguggagaggacagagggccacuugaggagucaggucucuccuucuaccaucauguggauuccaggauggaauucaugcugucaggcuuggccgguucgugcuuuacccacucagccaccucagcacucacauuuccaacuucagaguagaagaaacagucaaauuguaaagugauagauaugcuugcuacccugauuugaucauuauacaauaugugcguauaucaauaaauauguacaauuauuguguguccauugagagcaacuuaaaaauagacacaaaacagagaaaagaauccucuugagagaggagauagccucacugacagcuccagaggucugccaaccucugccaugcaucugcuccguuauguuuuccaggugcuuaguguggacuauaucucuguauugauggaucucauuugguugucacgugcauuugucuuggaggccugcuaaugccauuugaguuucugaaauccuuauuuugcaaauccauuuguguccuggguuuagcacccgauuacaggauuagcagagauuauaaggucugucugaugucuccuccaagcuuucaaucugauucguggcuaggaauugagaaauuugcacacugauagaaaggaagugggggguagcuacuggggaaaaacaaacaaaaaaggcucucuuaggaagaauuggaauggugccugccuugauacuuggaucagaaccaguuaggaaccugaaaccuugccguaggccacgcagcuucagaacuauuugaagcugucccucccucuuccucccacauccucagcagcugccccuggaauagaggaguggaggucugagcugagcaccagcccuuugguggcauccuucacugagagcuuuccaugugugucaucagccauccuguggccuccaccuugucaguucucauuagacagaccuuccacucuacacugcggagcuggagacaggaaagaaggacagagaugaguuugggauacaacaaccucugcuguuaggggaaccagugauuuugauuuguuucaggauuuaaaaggccaugcauaaauaacugcuuaaaauucaugggucacacuaaguuguuuuauccaaguaagaaaacuuugaagcagcuuuaauaaugaggauuaucacguuguauguaaaguuggugucaaaguacagcagcucuagggugcgcuaguuuaauagaaaugugacccauaaucagagucacaggugucuuucuuggcugcaggaugguugccauaacuucaggcauuucacacuuacacaccagucuugaaaggcaggaaaaacuauagauuccuauuuuuuaaaucaugauaaaaccauccccuaaaagccugucugucaccugaccccauuuacaccuaaaucauucagagcgggaugacaugcccaaaacuaauaugugaaaucagaaagggaacucuccugccccacccagugaauggcugagacugggguuuauagcuucaauggauuuacauagggaaaaugcaucuuuauuuuuauuaaccauaacuaaaaccuagcuuuucauuugauuaugaauguaagcaacaaaucauaguaaagccaaugcagcuaugacccuugucacuccuuugaaauuaugguggcuaggaagggacuggagagauggcucaaugguuaagagcacuggcugcucuuccagggaaccaagguucaauucucaacacccacauagucacucccaaccaacuguaacuccagucccaggggaauccaguaccaccuucuagccucugcaggcaccaggcacacauguaguacacagacaugcacauaaaauaaaaguaaaggaaauuuuuuugagaaauuucagugggauugaggcauguuaucaaagcuuguuacuuaguguagcuguaaagaagggcauguacuuacuaugucugaauaugucaguaaaauugguuuccuguguauugugccuaaguugcacuggcauggucuucucuaugccaccaccuguuaauuccuuaauauuuucauuuaaaaucacuccagucuuucugaaauaauuuuuauuuccuuaaauggaaagcugucacuuaccaaaugaaagaaaaccuuuuuuaaaaacaaauagaguguauagaauaacgaagcauauuacugacuucuggcaaucccauuugcccucaaggcucugccccucuuuuguuaaggagaugcuaaagacagauuagcagcacacugggacuugcuccuuaauauaaucagagcugagagauaauugaaaauggaauaacucaguuugugguucuccauuuagugcccugucagugaccugccuaaaauaauucagugugugggcaaaagcagguuuaugauaggcuccuugucuuaagcauuagugaccccacgcccacccaccgagaagagcaguacaacuuaucuuuuaugcacaugaaucauuuuuuaaugauuuuuuaaaaucuucuacuuacucacaaagccauguuucaguuucuuguuccagaguuugauuuggagcagacuugacacguccucaccugacccccacacagcacaccucuccucgaccugcuucccucucacgcuuuccccuuuccaccagcuccucucugaccuccgugaucccugcaauacaugccagcugugauccagcaacuacuugcuaguuggcaggguugauguuacuagcugagccuuugugguacagucccagaacacugaaagauaugagagcccaaaguacacccagagccuuagcccguacagaaagcagcaagcacugcauggguuggcacugaucaugcaacuucaaggugugggggccaggauuagaucagggcccuugagagcuggaaggaaucuggugaucagucccauggcaaaagccuggagcguuuccacucacuguaugacggcacucucaggggaagguagagucuugucuuucugccaaaacauucaaagcauuccuccaucuuccgacuuuacucuucuucguguggcuguuccucccuuaccucccuuaccaaagcugaugaagguuaaauaaagcagcaagcaccuggguccaugcuccuucccuuugcugcgcccuccugggcucuuagcucuuccuccagggccuuuuagggcuguacagagauacugcaagaggggguguuuuuucuggcccugugugccuugcccuccugggauguucuugcuuacuuguggaagcugcuaaaguauagaggaugaugaaggaagggccuuccucuucccccuuuucugcuguuuccuccugcccuaaaaacuuuugauugccaugugaaauccacagucuuuuccucauucauuuucuguacuccuuucugaccucagagaugaaaagcauuguggggagggagugacaccacagucguaauucuaggcucuggauuagaaccaucugggcuaaguugugguguuuuuaauucagugccccagcacagaaaggcuggcugacacugacugcacuuuuacaaaacuucuggagcuguuagggguguguguggguguguguguuggugagcauguuuguguguaugugcgugcugcuagccuagaguaggccucacauauaacaucucacuugagaaacguuucuuaaugguucacaacgacaaacguuacugucuuuaagcuaagugguucaauuagccgugauuggaaagagugggauagacuggggaaacucagcuuauuugggaauagccuugggaaugugaaacgaggaagagagcaucccuccccucaagagcggucauagaggcguggcuagcugcguggcuaggaaaauauugcccagaacagucuuuuauuuggaagagauaguggagcagaaaagccucugggggagguguagcaucacguucucgaaugaggugaguuguacauguauccucccugcugcuagaccgucaguucuccaaauaguccuuacucccuugugugccuucucugcccugcuggugcagcacagcgcgcucucagcuagcgagaaugcccucugcuuuguagcuucucacagcuguucccauggcuguuuguucauggucuuccugccuaccaaagcgcagaagcuuuggggaauauucaaaccaucgcagagccuuuuaaaacaucuuuauaggcaacuacagauacauguggggggugggguguacauguggccaagaccuucaaagucuggucccucuucguucccauuccccuuugucuuaacuaaccuuauaggaaaaaaagcaaagacgauuucaaucugaaggauuuuucuuccccuuuuuacccgaugugcauuucaguauguacaggguucugugauugacaugucacccugucaaggccccacugggccuccuccccagcaugcccuugccuaaacgcucauucugccccuguuccaacccucccagugaaagcaaguuuucucuccaagugucaguagggcacaaagccaaaagcucucccuuucuucucuguucucacugcccauauguagcuggcauagcuguccacccugcccaccacuuaucuacccagccccuccugugaaaaggacugaggagcucuaggucaagggguagccacagccacucaucauguggcagucugauccagcacugcagauguacggucacauagucauuuaccuuagaacucuaggccugucaaguccuuacuuacuagcuuuacaguaucagaccucaggcaccucacuucuuugaagccauguccacccauaaaacagggauacuuacagggucaaguuccaauaggaagugugccagagcccacugcucagggagggauggagugguaagguccauccaugggggguuuagggcaguuaaauggggaaaggauucuugguugucuuggaaucacaugaaaaccuagcugaaccugaggaggcgggggugaggggccaugucaaggaagcguguccugggcaauacugcuuucugaaccaagaaguauaggccuugaugggauucucuaucccacaacccuuggggaccacaggaugacuccuacagugauggggcagggugcaagagaggaauuagaaggaagaggccugaaacacuuuaucugguucuuccuucucuuuuuccucuucuuuccauguagaaaguuuuauuucaauacccuucuaaagacagggggugugcagggguaggagguaugguuuguuuggguaaaauaccuggguuuugacagucuuaacucacauuauuuucauaauuuugggcaaaugggaucaaugugaucauguauauaggucuugaaagaugaaaguccccaccuuaauguacauccccucuugcugguguccccagaucacccacauuuacagcacugaccccugccaguuccauucucguggauuuaugcagugcaguggccacacugaagcaaggagccacucuguccccacauaggcuaccuuauugccguggacaauccauguuccacucaguucccaacgguuuuggucucuggaauaaucauugcaaaagcuugcuuuggccucuggguccuggcugacuuuuucuagucucaacaacccugcugccccacagucugggcacagaucccugguccauuuaucuugucaccuguaaaucuaguuuccaugcuucugccaagauucuuuucuucauucccacgucauuuaccagugacccagccagucuucuccagaaaauuccuguuguaauucucgagaaccguaguguguaugguucuggugugaagaggagccgagaggaagcaggggacgacugccacucuuucuaaccugcggaaggccaccuuucccuagaaagcuguucugucugcccuccacuguagaugaacucagcaagugcgccucgagccugggcggcaggagcuuugcugaguggaagccucaggugcagagugcagccuggcccugcugcuccugccuuguguucugcucugugggccaaccuccagcacagcgaguuuccuucucaucaguccacuagauccucuggguggagcauccagauccucugggccuacccuuccaaagacuugggaagacgucuagaagggcauuugaaacucacaagaucauuuucuuuuagacagaaaacuaagcuuugagaugacuuacaaggguggagagagcugggcuacaccuuauauaaaugugagacauaauuugccagguguagcaaaugccaaguacugugcuuaaguucagaaaucaguuacacgguuacaacaugaaggugacccugcuugacagcaguuuguuucaaaauuacuccaaggaguuuuguguacuacaagcaguacacuaacaacaguaugaagugacugacaaaaaauguauugacaggaacaguauggauugaaggagguauugcccacugcuaagcagugucugggguacugugccuccuuguuacugcugcauuuuuaagccauucuuuuguuauaauuaaauuaugugcuugugugugugcaugagagagagagacaaggagacagcagaggaucuguaauuguaugcuuguguauggaucuauguguggauauauauguagacacacaagugccagaugcaggggccacacacagcaaaucuuccuggaguuacaggcaguuuugcucugagagcacuaugugcuccuaaccacugaggccaucucuucagccuccuuuucuccuagaggauucuucaguaauguggcaugcaggauucagucaugggcuagaaaucacuagggagggaaagaaagagcagaacaaacauucccaguauauggcucugcaguggaaggagacagggacgcaacacccuuugugugcgugcuaugcugugcaccacucugugguuucuccuuccauccuaaaagcagugcucugggcuuaaguuacauuuggacucagggaacuuuucuagauaauaagaaaaaggaacccuguuuguucuagauugugcuggaauacacaguuuagaccauugggaguucagauuagagagguuagaggguuuggaagaacauguggccuuauuagaugggcuguucuagaagaaagccccccgguaccagcccacuuaauagaaauugaucugucagagguauggagauaucugcaucgggaaugggggagauaaggguacuugaacaaccucucugguucaaguagaauguucuggaauucccuaagacuuuaagaacguggcaugaaguauagcugcuaggcaggaagagaagacaaagcugcccgcaggucacuguccuggcucaggcuaacagauuacaggucguuuauggccgccuuuagccuagugccccuguuugcucaucucaacugucugcacaggcauccaucugcagcuugucugucaaggaugcaucugacccuucucccaguuuuaauuccacuucacugccacagcuugucuucccauguaggaacggauguucuaaaguuccaucccccuccuugccucccuccggugguagagacucccugucagcagcauccacugaaagaaggcugggcacagacauccugguacagacagaacugucuuccaagcaggccaguugaugaggccguguguggaucugcaugcucacauugcagccugaucgaugccugucagagcucagcaucagagugacagcugcaugccgggcuguuugcugaacacagcgcguccgucaagggaaaucaaaugaaauccaucuucuuguccaaagcauggcccgaugggcugugccuggaaugccaguccuguaucccauccuacauccuacaugcccugaaaaucauugcucuuggaacuucaguguuauauuggugggucccuugggcaggagaauuagagucaaugaaaauuaugcccagggaccaauaccccuagcuccauuccuguagcaacuuccuguuauugcuagugucuauugucauugcuaguauuguauagaguauauauauauauauauauauauauauauauauauauauauaugcaugcgccuguguacauugaguaggacacagcuaaaguagaggugguagacaauuggugggaaaggggcucuuuggagagucucauuagagaagcaauuaucaggcuuuaagguuuucagaauugacagggauacacuuuggcaaagguucuauguuuguaaaccauuuggggcugcagaaagcucugccacccugugucuuggcugccagccagcuaccgacucucuccucucccuaaagccucuuuuauccccuacaagccuguaccugaaccuucaaggagccccucagcagcccuuaguagcccucggcugcuccagcacugcguuucccagggcugcuaggccagcucuucagugaagaagagcccuucccaccucugacugaagcuaagcuggugcuucuauccauuugccuccccucccaucagggucugaacaguucuuagacuccaaggggaaaaugcagcaggaggccugucacuuagcaaggugguauuuuucccucacuucuuggaaggccagagcacaaauuuguucgaaagauacaagugggcuggcuaucugggcagcagaggaaagaggucaguacaggaguaggggguggaucacagccacugagaggugagguuucucuagugaagaaggacugccuugcagaacccacaagaaugggguuucuggaugaauggcaguccagggaaaagccacaguucccgagggcuucuuucucugccaacccucaaagggccuuucaaagcagggaaggauucuccgguauaacugcccuggggauuugcuugcuggaaugggccccugcaugggccuccucuccacacugcccuacuuugucaagcugagcucuccucaccccaggccuguggagugcagcagucaaagcuuuauugcccacaugcuggagcuacucugcaauaaaagaaaauaaaacaagguaaugggaauggcuagugcggagggcagccccccggagaaugcugcugcccgucuccccaccacuacccaucaccuuuaagaugcuuguugcggaggaaggcaucgcuggucagcgggagcaguguuugcacaggagaacuugugcagggguauagacccaaucugggugcauccuccaggauccugccucauaagaaagcaggaacagaaacugauuguaccuuacagggaaaggagaggaauccuguccaagagaguuccaaaggguaacagaagucacuguccagaaagcugccugaggcuauaguguaucuuggcaagugcugguaguagaaaacucaucggaagagguguagucuggaaaagccaacaagaaguagagggcccugggcgcugguaaacuguccuucccaggucccacuucacaugagauuuaggauggacaccagauauuuaugccucgcacggaagauggcauuagcagucguucaaagucuccaaugauuuccauuuugucaugcgcugugucuggaccuuugaccagagagcuuuuaaauuccucucccuagccccuuuucuccucucccucucccuggcuccucuguccacaggcuugauccagacuuguugaugagccucagccucccccgccacccuaccccccuacacacacacagaggcacuaaaucuugccugucugccgugcgacccaccaucauuuuccaagcucaccuacgcccaugaaugcuuaauuuaaaacuucugcugccucucagcaguuuguaauucugaggccgaucucagcagaggagacaaaaugggcugaugaauguacucaggaaagugagcagaaaacgauacacggagcgucucugugaugugaggccaggcuuucuuaaccauuuaguauaauaagauggauaucuacagugcugaguuguucuaauaggauggauaucugccugauguaucggccugcaggguaguuaugaguuuuaaauuuccucaucucuacggcaauaaauucucugggcuuuucaauuauaaacucacuuuucucaguuggggaagccagaagaauuuuguuuuggucaagguuaaaagcagcuggcacaguaugggcugggagacggaagcacgcaagcugagccuguaccuaugccucccuucucagcagccagugcccuucccaggcagcacuguaggccagccuccuuugcucuccucaguuagauauuccccacagggaucuaaaggagucccuauugcuucagaaguuugcacuuacaagguuaacccccucacuggggcuugcuuuaacagagggagaaaagccggggagaaaugaaaugggagcuccgagaggggguugcccugucuggccaccuccugguggaagccaacaaguggcugcugcaguggcuucuaggagucaaggagcugacugaguuucuggggcuuggcccacgcugagcagccagcagagacuagacaggaagagucccggaggauaaugagcccagggcugcuaaguggaguacucagcaggguccugcggauccuugcucuggcagaugaagcagagggaccugccucuccuaaugacuuucucuucccacugacacaucacccaggccaagagcaaagcagccaggccagcaggaagacagaugccucuccccagggcugcuuccuggccucucucaauuugccuucaaccccacauccuggccagagccuccaccucaauuccuucaggaaauuuaggcauucaggaauaugaugcuuccagaugccacagaaucauucugccuacagguuaaugacaagagccagguuagaaaaguaagcaagauugagcucaaauucuggucucuauacuuaccaaaugaccuugggcagauuuauucuuuuuuuucucuuuuaaucugcauuuaauuaaauuuaaccauuaccuauuaauagaguaccaagguauguuucuauacaauauacauuauauuguuuuuaaauuaauguaacaucuuuuucaaacaucacauauuuuuauuuauuggaggagaguuuggguuucucuauguagcccuggcuguccuggaucucuguagaccaggcugaccuugaacucagagauccaccuucuuagugcugggauugaagguguggaccaccaggaccagcuucaaaaauucuuuuuuaauggugaaagcuguccaaguccuuuuuccccauuuugucuguggucgugucacuaugcaacagcauguuagagcuucuucuaucugacuauaguguugcccuuagaguacccuuucuucuuccucuuguucuuuaucuguaacacgggggaucuaacacaaggcuuuguaccugcuaggccugugcucuaccauggagcaugguccuacauggaguacucucucacuucagcaaguuguuuuaacuuguaagagccuccaauuccuuaucaguagaauggagccauaaaaaucguuuuauaaacaguggugagaacuaagucaguccauguugaaucuaauggaaguucuuccaugaguggcucucauagccagaacucggcaaaggauuuccuuuacuucucccugaucuuccccucagaugcggaguugacagcucuuuagguaagaguccucuuacuagaccguguauagucugccucugccaugccuggccuuuaggcaaaaccuauauuccagguacagccuucgugagccagacuauggccccagggacguucuauguauggcccagcccugugcuccuggcaguuccugucacuaaaacaaaaaggaagcuucuuuuucugagacuguccgcuuuuauguucuucaagccagacaaauagauaaaugccagugauagacauuuguauguccuuucauuccacucauuuuacuuguguugaccuacugugugaaccagacaccaugcagguguuggguccacaaagucaaguaucaaggagcuggcaggcugaccucagcagucagagaugaugaucugugcucuguguugcccacauucccucagagcacaacagggcacuggguaagauuacuuacaggaagugcugugaggcccuagucaguauuaacuuggggcggggguggggggggcaugcacuccaacuccagacagagguuccaacacagcccugaggauugcacccaguuagucucccuguagaucaaagcaguguuugcuuaaauauaaguaaacuucucuuccuucucauaaaagaagcucagaggccagcaccacucuagugucucccaguguccucaggguacguguucccauguguguguagaaagguccauuuacccacucuguuguacuuaguuuuuacccacaauucucaagggaaaagguucccacagcugcagccucucagcuuuuccuacuagccugggagucaaaaggaggagaaaacacaaagauaguaacuguuuuucuauaaguccugccccaggauuucugcuaaaucucacuaauguuacuagagagagaggagacugggaacuauaaucuuggagcugaccauguggaugccggagauaacaaaaauagaaaagggaaggaggaaaggcuauuggcauaucucuacuacagacagcaagacauaaaggugcaagauugcagggucugucuagggccagaucagagucuguugggcaugaggggguaggaggugauaggaaugagccuggaggagcacucacacaccccaucccucccugcugagccuuaaauuccacuaauucagacaagggaaaguuccaguggccaagaaacagcaccuccaguucacacucugagccucucagggacagguuccuugcauauucuagaagccagggccuaaagcaaggcagcuaggcuacaugcuggccaaaagccaauauuuuuuccauggaaaacucuagaacuugguaacacuguacaacagaauuagguuucuauucuuucucuguaagcccaguaagcagcauuuguucagcauuuauuguguauuagacauggauuuaagcuuaauauacauuagcucacauuaaccuuaugaaagagacucuucauuuucuuacuccuaugucacagcuuaaauauaaacaaagacuuaaaaugccuuucuuggaguuuauaaauggcuaaggcagaguucaaacuaaaguagucugacugugcagcucuuacugauaaccagugcagucaguagauguccccaacauuaaagacagaaauaugugggcuggagauagguggguaagacaaagcauggugcuugugcuccgugcagggaagcaauggaaacuggugcugacuccccagccuagcaaggccugggccuucagccuuggucucagagucguaguagugguugccauuguuuauuuauucuuuucccccucuuuucuuuaucuuucccuguauaucaggacuuggggugaguguaccucguggucaauuagcaagcuacgaugguauaucugcauuucuucucaugccuuacucccccccaacccuccucaugauuauaauaggacuuugugcaccuuguucaagucccacccauccugcuucccuuccugccuucuuaagggucuccaggauccagccccugauucaugaucuguaucagaaggguuaggucccaauaugccccaugccuccucucaagggcagcccuccagagcuuugguucuauccagucugcuuacacuugcugcuggucugugcucaccccaccaucccucucuuccucauuccagcgucugauuauauccccacugaucuuaccauccccuuauuuccaugcucguuccacauugcuuucaaagcugcuccugauacuuguaguagcaggucugucuuucuccucucucagaagucaacuccgucuuaaagcccagucccucucuaaagagugucgugcauggcucuucaucccucccucaaagcugcggucuccucggaacccagcuagugucugcuguccauguuggugaguugcuaggugauuuacaggacauuuugucacuaauugacaugauauggcuucacucagcugaaccucaggcucuucacacccccaugucacuguguuagaucagcugcaguguccugugccaugcuuuuguacuuagcaaaugccaaaugacuuuuccuugguugguugauuauggugagccuucagccacucuauauauccuucaugguuuuuaucugcuccuguuuccuugggcauuugucuuugcauuuugaagacucauagucaucguuggauauuaacacucuguccaguacagccugacaucccucuugcuucugcaagucuaccgugucuccugagccacacugaucuugcaguagacacaggaugcugcuacagugugaaccuguaauuucugcugcuugccuggccuuggaaacgaucuguguuaagaaagcucuggauagcaaccagaaauguagccaccuggaaagcacugcccagaagcaaaagagcccugccaagcauagucucuccccaaggaguguaggauccugcugugcaagggacccaaagggguugaacagaaacaggaaaacaaccaccucauucagaaggcaaaacauauaagcaaaaggucaugaaaagcacuagcaagaugauauacaggguagagcugaacaccaaauggaggugguuuuuaggaaaugugggugaaagaaagcuucuuggaagacagagagcuguggguugcaccuugcaaacuaugcccauaguuucccucuagauuccagauagcaccugccaggaggggcuugccauaucguucuuuuucgguaaaugguuagcuuucucagagugaguucugucuccucuugcccauguaagcgagacuccuugcccaaccaucacaacccuaauauaggcuuguggcucugagauggguaggaauuuaagagguaggaaugggcagcucacagcaagcaaagcagcugauccagaacagaggguccuugaagaaaugaggcgguaggaggcauacaucagcccugucuaacuuacuucaucuugggaaaguagaagaugcuaaacaucucuuuagucuuuuuuuuuucuuuccugauguccuugcagcaucucaguaagucccugcuuagaaggagauuaggauuggccuuuuccuucuugcuugcugccucugacccucccucucugcauuucccugugcacugacucuaggcaacagcucaggagcaacaggccauagagagcacccccagaaggcauugaaagaaacgggauugcuuaaaugguauuuaaacugagugguggggugauggcaggagucucagagcuuugucugaggacacugugacaguagcugcauccaaguguccuuugucagaagaggcagcucagcugaugcuaggucaguucacuguuccuccuucuggucaaaaggauucagaugcuaauugugacuuccagugaucuugggagacacugagcucccucauuuacucucucuaauuucaggacauccccuccuuaggggcaucucccuacagggagcagggagcacguggcuuaugggguucuuccaaguacacggcagagcauggagguggagcagacuaaaugaggccagcuauucccugucucagaacaggacagagucagccugagcagauauauuagggcaaagggaccaccaacugacuccugguacuuuuuuguacugaauuguauuugggacauuuaauugagauuagaaggaaggaaaaaaaucgagauuccuaguuccuguagggagacagaguccauccacagccaagcugugacucuguguacuugucuuucccauuuugugucuaaucucauuguagugaccugaaauuuuugagaaggugaucauuaugucuaauagacuaugaaagccuguaucaugaguaaagugaaggaagaaugugguuccaguguaggucugcacagcacgggucacaggcccauuguuccauucccucugugggcaggaaacacugggaccugccacagaauaaaacaggcagagcucagggcacauccagacgugucuuaguguaaacuauagcccuacacucaguguuuggaaggguuuauagccaauuagggcuccaauuucagaggauaagugaugccacauuuuaauugucauuagcaagaaaaagucagcagcaaggaagcccaaccucuccacauacagaagggcagggccccaucauuaaccaggcugaucuggccucuggcaggcugcauuuauccuuauuucauguguacauacucaaaccuuauaauggguagcuuuuacccaugggccuuucugugcauuacugagaugccagagagaucaugcuccccuugggucacagaaagcaagaaucaaguuguucucugugcagaagggcggacacagaacagcccucuagcacugauacugcguagacucaaagaccagucuuccaggcacagcaucaucucaaaggagguuuccuuuucucucugguaggaauuugaaaaaguuuggaagcauguagcagacaggggcauagcucaaaaaaugcucagaucucuucucuccuaggucuaaaaguagcuccuuaaugggguccaaggagaaccucggacuuucuguucuuuguguuggaaguuaacagaauuguugccagcccacaauaguaccaagcacagcucaguaaaggugccuucccugcacauagcgugcacagugcguggauuggcaaagaggcaggaugaguuaagaacgguagggaugagugccgggccaggagcuuucucagggugaccggcaagggugggugaugagggaagugggcaguugcugaaaguguuggauuuuuguccacucaagcuauuugcuguggcucuucuuauggucugcaagaggaaugaguaucaaugucccuuuugcuaagaggucaguugauaguacagaaaacaccccaauaguuugugaguauaccuauggccacagcccaaguuuccugcacucucccagaggccuaaaaccuccuggcacucauagguaaccuguagcauaaagcuuucucaguccuuguucccuaagugacaggggccugaccuauacgaccuaacuacuugcuugguggaagaucuagcacuggcuucuccagccccaacccugcaucugcuccauccucuuagcuccuguacugagcuccucgagugucaugucugcucuugcccuucagcccuuucaugcugagggaucaguagccaggaggcgauggauguguaggagacuaggaggagauauccacagcugcugucugcacucaugccugauaaauagaggaauccauccuugcuccaguuauguucugcccagacaaagccaacuacagaagagccccuucugcucacugugucugggcugccucugagucaucagugcugacugcccugaccgaggccgggcugcggcccucuaggcucccgugggcaggucugcuacaacacagcagcuguggaccagcccccguggcagagugucuccagcaagcgucugucaucauuucagugccacuguguauagacacaguuaaguacuuucucucaaucugaugaugaugaucuaaggaaaccaggaccuuucaccuuccagcugcuuacugaaugcuuacccaggaccauuaagaaguguccauucuaguauugagacgcugaggugagaugagaugagaugagcugcagucguaggaaggaacagcagagcacacauggaaugggaggcaucuggcaugccuggauuaaaauauugagggguaagaucuagcagaaccuugugaugaagguacuuaacacuauacugugcugagaaauuugaacuucaguagaaagcaaagaacuuuagcagaauggugauagauauggauuuuuuaaaaauuaauaacgugcugacuacaacguaagccaaauucuuuuuacgguuugacauauucuuuaucaaagcccuuugagguggcacuccuucauuaugcucauuugacauagagaauguucuaagcccaugaugauuaaauaaguuauguauagucauguugcuagccaauaaaacaagauuugaaacagguaaucuggcuccagagccugcaucuaaccauugugccgcauugccuagaaaaagccacacccugugagaacagagagaggcuguugaagacagcagugaggaagguguuaccuacagccaagauccagccugaaguguggggcagugcagauaaagaaggaagaguaucagucaguagagucagaaugaguggagucauugugacaguaccuggagcccaagaagugacccucacugccaccugagaagagagggcuuccuaguaaaggugacagagugaggguuggacucacucccugguacgguugaauuugguagugaggccugggcuguggguauacuggccacucagaguaauagaauggaagaacucuccacaauaugcccugggaauaucuguguuuagaggucaugcuguugaggaagaauucucagcuaagaucaagaaaaagccaagauugaagaucagagaucuaaaaacagacuguuucaaaaagauagggguugcuuagcuuggucagaucauuugaaaggucagaaaugaugaagucugcaaagaaauuaugaaaauggcaaugaagagguccugagugaccuugugagguaacagugacuguaggaacugguccauuggacagggagagugggauggagggagugggcacuugcagaaagcucuggaugaggggagaaaggugggcaggccggguuaagaucuggaugguggugaugggcaguagccagaaaggcaguguagaagguaagugacagaagcagguaucuacggugaccuaaaggagagaguguaugccuuguggguuucuuuuucccuuuaaaauggaugaagagagccaggugugguggcacacaccuuuaaucccagcacuugggaggcagaggcagguggauuucugaguucgaggacagccagggcuacagagaaacccugucucaaaaaaaacaaaaaaaaacaaaaaaaauggauggagaggaaagaaauaaccauggaugccaaucuaaguggguguucagucuaagcaaaguagagggccucucagugacauugcccgcaguguguuggguaaaggagcuugagaauugggggucuccgauggaaaacugccauuugaacaugaccuguaggacaucuaguuacuuauaguccaugcaagagauuugcuagccuugggcacuugcuacauagaucauacacacauugauuuccuacuacaaaaauaggcugaaaccuagcuccguguuccuucaaggcagguauagcuuuugaagccagagaauacacuggcugggcuuggguaagaaaacagucgucuugccucccuuuggcuaagaccacucuccacaugagcuagcaagcaccagaaggaucagaaccauucagaaaaaucucagagcaugccucuugcuuggugaggaacaguccaagcuccuuccagaucugucacauuuccugugugaagcucggggaagagagaguuaacucucccucaggccuccagccugggguuuuccugggaagaugaacagucugcuuuccuuauugucugcaccaaaggaacagauugcgucaguuuguaaacuguguuaccgcuugcaaaggccuggagucagcagguuuccauuucccagcagacuccaacgaugcugaucgccuuggcuucugcuucucugccucaggcaggauggaaaauguguucccacccucucaucauccucaccauagaggugggggagaaggagguccuucuagcccaguccucucucuuguuacccaggcuuucccuguguuuccaguagcuucuuggccuuaguuucuauucugccacccugucuggacuucugggcauuccuagggcuuuggcauggcucagugcuaagaugucagaaaauaaauuauuuggaaaagcaauuauugauaugaguuagucaugaaagaucaugugguauagagguggcagggcaucucaaggagguauugaugagaacggagccacacugugccagccgaguaugaaagagcuugcugcugcccgccucaagccugcccacuccccacugcacugcacugaugguaaugagacccaggaggccuuucauaggcacagccucccagcucccagagcauugaauuauuaauuacauuguguuaauguucaucgucucugaaagacguugguauguguguggccgcgaggggaggcuugaguuggccguguuaagcugcuacuauauuaaggugaagugucuccucgaguucucacucuagccgugguagccucaccacagcuuugaugcagcaucagugacgguggaaaacccaaauccacggcaugagcccucucuucgccagcgaggaucucaguuaugcucugcuugcccugcaauuccacucacauucucacaaaaggcaaaaugaguggguugcagucuuugacugucugcuguugcuauaacagaauaaaugacacugguuaguuugagguuuguuuguuuaucaguuuaggguguuuuguuguggguuguuuugguuuguuuguuuaggguauuuuuacuuugguuggugcuuugguuuuugguuuguuuuuaauuaguuuauuugggcucacaguuugggaagccggagaggaugcauugucaccagcacugacgucgucgugguggauggcauucugucuggagcaccugugaaagaaaagcaguuuaugauaaacagacagaaaauaagaaguggggagggagugggcugacucuucuguaacaagcuggcccuuccaaagagggauaucuuccaccaggucccaucuuuuguuugauugguugguugguugguugguugguugguuggcugagugguugguugguugguuggcugagugguugguuuggugauagugguaauuguguugcagcaaaaucucauuauguacaccgagggagacucagaauccuccuuccucacgcuccagaguuccgagauuguguguacaugcuaccaugcccucuagccuacuuauaaagauuccccauuucucaagcuaccauacuuaggguucugccagacuuugagaccaagguuacaccacuugaaccuauuggcaacaaaccagccaagccauagaggaagaagcuggaguguccccagcucacaguaucaguuagucaucuuuucuauuccccgcccuucccuuccauuuugucuccucugcaacaugacuaacaagcaaggcuucccucugcccuucuucgacacuccccaucuucuuuuauguguuccuuuaccauagcuucagaaaauccagaccaaagaaccacagaaaugggucaacucacuuaacugagcccaaagcaggcaugaugcaccagccaauaggaggcaguuacauugaccauuggagaccaaagcauuucucuaguccuuaucaguuauaugggccuuuuagccugucugucacugaugacuuaagagaguugaaaucaugaguguggcugauaugggaaugauggagauuucugccucuaaagcuugucauuggaacccccagugugaucucccuagagcuagcuccugguccacccucuggagaaacaaaccuacaucugugcauaaccguguacacagucagucuuccuuuccaggugcccuugggcugggguuggggcaccccugggacuauguuccaggcuuucugugggcucccaaccccuggcgcucaggcugacuggaggcucuagucauuuucugugcugccuuaggcauugugcauaggcuaugccaaugcccucgaggagauacuacuguuauccaccuuccuggaaaacacaggaaaagcugguauauauguaugggauccuauguccauagccaguaaaucccaccuggacuaucuccuuuggcugccugcauucauuguaugaaguguggauuccccuuacuguccuucccugaucuuucuuuugcccuugguacccuagauagcuuacuuaacucagcagagaccaccucuaaugcauacuuucuucuuucccauguccucacugcacugggacccugaaagagcuucaggagguggauguggcuauauaccuuuguccuuuaguaacacuuggcguccagaucagcaucugcaauagauguuaggacagacaccaaaccccagaacgguugaccucagagcucccuuugugguuuaacaccuaagcagucuuauaaugucucccaccccaguacacacacacacacacacacacacacacacacacacacacacauucaauuccaccccuccuucacuuugggagagaaucuggaagcuaaauggcuaggaaguccaaaaguuaagagaaggcaaacaaucaaccuuaccuagcuuuucuuucucucucuuccuccacacccuuggcaaaccccaaguggcuccccagccugcauugcaccccaggcagggaguauguucccgcuuagaacaggagaaugacucagccccacugccugucugauugaaguaguuccuguguuaaggagcuggacagauuccagacaagaggggaaagggggacaauuugaaggcggagacagaaacugaguauauauuucuggaagugagggcacagaggccacugaaagagaagcuguaaaaaugacacaaauugcuggucaccaccauccucccucugcuccaagccauagcccuggugguugcucccaguucucccucccuucccuuacccccucacucuucuugccuucccuacccagccuuagccaaaaauaaagagcccacagcccagcugggugggcacugaggugugcauguugccugggcaccaggagcucuuccucaguaauuaagagacaugcagauuagcagccugugccauuuuauuaauuugguaaauaagccagaacaauuucauuaguggcacauuaaugugcuugggagcaggagggugugucccacugugaggcauaagguccccuggcugcccuagcccauagacagaccagguccagagugucuaguauuuugucccccugagcaugguuggcucucagcucccacccccuuuagcuugauggugaggagaacacacacacuaagcauggaaagcaucuaucugucugggugaauuuggggacagugacccauaccugagcacuuccugucaacuccauuuggcuaaccuucacuuguuuauaaggacccccaguauaagaaaccaaagauauuuagagaggucacagaaugacugggcucacuaagcagggauugguccacaaaugugcagagcucaguauauagcuugaccaaggaaaauagcuucuguguauaacccagguguguagagccaggccauaaacucuugacauuagcugaugggagaagagcauuuucauguuaccccacuuaguacccagaucuaccuccccuuguucucucuggguaaggagacuaauccagaagagguuuguccugcccccaaaaugacaacuagugcugaggguugaaccacaguccucccgauccccaagaccacgcacuuccuaaucccugagcccaaguaggugcucccaagcucugggaaguuuauuuaguauuaaaaaagcuucauucccugguagaacugacauucuagcuguaggaugaagacguuugaacaugaaacaagugcuccuaccaggaagcagagaaaaucauggagaaacauuuacaugggacucauuuaaucauaauaacaaaccuucuggguagguacugcugcaaucccccaagcuucuagcaagguuuuuuugcuuuuuguuuuuuguuuuauuuuguuuugucuuguuuuuaaggcacaaagaaguuaagugacucaccaaaguguaaacagauggugaggggauuugaacucaggcuaccugucuccacauuccacauuccucugugcugcauuuaggucccugaaagccagaagaagcaaacugauucuccaaguguucauaggguggccuuuugcaaguggugccagaagaagugauacugaaaguaagcagaaugcagcacacugggacuggucuagcucgguguccagcagcuucaaacccagagucacucugauaccaccaagggcauagggcagaggugcggacagaacuaguaaggccaacaggagugucuuucaacucccagggacacaccucugccuuaacuaacaaccucaagccacugugccucauggugacaccaucugucccuuagagucugucaggaaguccccgccuuccccaguaucauuucuuuaggucucuacucugucauauacccaauaagagacucaagagccuccaucugucugcuuguauauaagcauaugcuacccuuggguaccugcaagaccgugcccacuccucgaguaugacaguccaugguagucaccuaagaucucaaucccuugaugucaccugcauuguaugaguccucccacagaaacuguugcauccagcucauuucagaaacacucuacgaugcuagaaacuacaucagaguccuuguuggauuuuuguuuuguuuuguuuuguuuuuucaguuugcacagcacuccaguaagaucucaguuaauguuugcaauugccaguugggcacaaggaaguuucuuguauauuucacaagacuaaaucuacaguagcuacugucuguaauuugaggcaacuuguaaggaacagcucucccuagauacagcuauguguagucaguccucaucguuugcagguuugguguuugccaauuccaugcucacuaaccccgagaucagcucuugugcuuuuucagucauuugugaacgugcagaguggcaggaagccuuguccuccuacgugcaccuccccuccccagcacugggaucuuaggcauggaccacauugccuaagacuuugagacuuguauuuaucuauuuauuuuuagauuggggucuccucuuguuauguagcccuagcuagccuggaacucuucugugcagccuaggguggccuugaaugcagagaucucucugucucccaauuccuuuaggugcagugucguaugccuggauaauuccaccuucuuguuuuagcucucagaguauaaaauuauucucuuugugaccuguuuagugcuuugaguuuugcgaaaagcaaugcuuucucuuaguaguuuuugccauaaaaaaaugguuccaagcaagagugcugcuggcauauaccuuaaagaaaaaaaauacauauuaccuaacggucauucaggccugauuucuuaugguacuauugucugagagcucaauguaaugagucagugauacauauuaaauaacguaucuuuaaauagaaacacauuuagaacaagguuagauauuaaucauuugacaaacagguaauaauaggcuacuagguuccuaaagcuuuuauucucucuaggaauagugguucaggauuuucuuuuuuuuuuuucuaucuuuuuuuuuuuguuuguucuguuuuguuuuuauguuuucuuucccuuuuuucaagaucuauuuauuuuauguauaugagugcuguaucugcauguacagcacucauauacauauacauguacaaagagggcaacagaucccauuauagguaguuaugagcuaucaugugguugcugauaauugaacucaggcccucuggaagaacagacaguauuuaaccucugagccagcuguccugaaacuugcucuguagaccaggcugaccucaaacucacagagauccuccaccugccucugcuuccugaguacuggauaaaaagcuuguaccaccaggcccagcagaucaggguuuucugauucaguguucacuuauaacacuaccguggcuaauaagaacggacugugcaggcugaggcugcaccucaguaguagaagaauaaccuaguaugcauguuacccuggguugguucccagcacuauaagaagaaagaaaaccaggcauaauagcauacccaggcauaaaggcauacuccuguaaucccagcacuugggagauggaaggaucuaucucccaagaggaucaggaauucaaggucaucccuagcaauaaagugaguuugggcugaccuggguugcaggagacccugccucaaaaaaaaggccuaaaggucaguaucuagccucuuuucucccucuuacucucacuguaagcaugucuaguuacacagcugccugugcuccugggcucaagugagcuuccugccucagccucguaaauauuccaaguagcuugaacuauaaaucaacacagccguccuuggcucucuuggggaaagugaggaggaaaucccagaaguuggaauccuggagcuaaacaaagaauuagaaguuguacauguguagguccuguguguuaagccacagauuccuagcgaucagucaaaaaagaggaguggaggaagcugcacauacacuccacccugugagcucccuguuuaaccugugcucaugaggcccauaauugucuaugccaauaaagugucacagacuuccagcaucuauccaggccaaaguaugucuaggaaggugggccuauagcaugggacuugacugcagagaccaggagccuacagaaacaguagccgggccacuuucccccaagagccuuuguuugauugagaaauuacugucauuggcagcuauaaugaaagaggaagcugggccccacuggcaacagcuuuaucucccucuacaaccccagguagaaccgguggcagugcacugcccaaggccagagauuucucucuucugcugcuggcugggccuggggacuugucaagcccaaguuagcacaucgauugcagucagaagaaagcuggauacauguggucugggcuugcuugccagggagaguccacugcuccuugguggauuggccccagguauauccacgaguuguagguucuccccagcaagcccuggagaagcaucuggauucuggcuucagaaaacuuggucucaaugccauguguagugaggucugagcguggcacuguguaggaugagagagauuguuccugccugguugccucagcaacccauuucuguauuucuuacaucagugccaacagcccaaccugcugcagaaaaccacacuggccuacugcaagcugccuggggggggggggggcugccaaaccuggaggggugcuguguggccauauagaggaguuacccucuauuuugcuugucuguuugucuguggugggggaaacacuuggcuacuggaaguguagaacaagaugggucagggagggaggagacugguaugggcuuggauuccauguuggcugggaacugaaccagccccauuugcuuuuggcugggcacauguccccugagcuuccaacuacaaggcaaccagccugucuguucuucccgcugccgcccccgaguuccucugagaccuacugcuuuuugaccuuagucuguuugguaaaacuuagcaaauuaagacaaaggaaagguggucuucacagugacaucauacccaucacauuuuuaucuuguuacuguaggccugauggccucuucaacucacccaguucucucccugcagaacacucaggcuugcacggcccugggcuuuugcaagguggaucagagcaucaaacucuuauguaccaacuguucuucuucacuagcuaauugcuagacucagagaaaggagaauccugccucagcaucuaccaggcacuaacugcugguugcucccacuacauguagcucugaugaagaacuacagguccuaagucuggaugcuggaagggccggcauuauuaccucagcagaaggagggacugcuccugagacaagcuaaauggagucagggagagggugagcuuagccugcuggaggcagcauaaaaagacaagcugccugcggguuacugguucugccauccgaccauucccucucaguaucccugcaaaacucaaccagaaagccagcuggaaucugcauucuuuuccucagacguuaguggacucugcauauccccuuugccacacuccaaucuaaacugccauuucucuucagaggauuaggaaugggccuaaguggugaaagcuaggaugaggucagggcccugccuccuggucuugccccuuugacccuuugaggauucauuaucuuguugcugccccuccccaggcaucucugucuacuuuauggaguaacaucacuagguacuucccaacugcccacucucacuccuccuagcccucugccacuggcaccagcucaggcuuugagaauucccagguauuuagacauucauuuuauugcuuaaucgagcuugaagccauuuaaauuaauacaaguuuuuacacuuagcagcaaaggcuuuuaaaggccccuauagcugaggaagaacgagggucuagagagacucaaaaagggaauuuaucgugggcuacugcuuuucugagauaggggcaggucagccuccccaaaagacacaaccauggaccacccucuugaaggaacugagucugugccagcucuggggcccuaggggcaaagcccuccauggagagugucuaagauuccucagacucugacccagugucaugacccuaccugucugcuuugcucccccaaacugccccugugcuaaugagacuccacccacacccuccugccuuaccuguccucuccucucuuucccuggcuuucuggaagccuccuuaauugacuccauuaaacauuaauccuuucaguucuuccuggaagaauucagccucccucuccccagggauuaucuuguuccugagcuugccugcguuccccacaagagcugggguggaugaggaaggguagggugcaccacauucagcuuguuucuccccucacuccugcgugugugcgcgcgcgugcacucgcacacaugcacacucacacucacaggcacagcuaagcagagggccuccuucagccaaagugagucaguugcaccccagcagcucucugccaaaaggaagggggaagagaacccagaacgaugagucucgagugcugcacucugcacagcugcagggauugaccuaagugggucagugaggacauaaagaaccgacagacaacacaacacagaaagacugggauccgguggcaugcccucucagauggagaagcugaagcacagaguguuuuaauucuauacaguugaacccagacgcaggguuauugaacugcgauaaacaggaaggcaggauuuuuacauucagcugaacaaggaggcagguuuagcuaauuuccguaggagcagucuucaggcgguaaacauggguggggagaaagcgacaguggagguguucuacacacugucagcauucacacucugacucaagaaggcuuugccaucccucugagccucacucggggaagguuuugccacuuccacagggcaggggcauugggguccuuggcauggcugugcccaugucaguacauucacucaggacuucucugguucuagcugcuucugcuacauagaaugaauauagaagugagcuugguaccauucucaagccuugaacuugcagaacugugcccgugagcugacacguguacccucucuuuuguuuccagguggagguagagguagagagcauggauaaggcuggcaacuucauuggcuggcugcacauggauggggcuaaccugucuguccugcugguggagcaagcgcuguccaagguccacuucacugcugagcgcagugccuacuacaagccucuccugucugcugaggaagcugccaagcagaggaaagagaagguaccaagaacagacugugacagucagucgcuagcaugugcucuuuucuuaccugccccuucccauacaccaaagggccaaggaugaggugccagcuuaggcaccuuugauccuaagccagacacagaccuucagugggccagagcugucagucuggaagaugacauuggagcaguggaagcacuguccaggacaccacuggugaaagccuggcggucaaccugcccuucucaggcaguguccaccaagggaguggacaacccaccucugaauuuccuuacuacucccauuuaggguggcaguccaaagagaugcauggagcccuuagaacaggagauuuacaaccagucucagauacugcauugaagagacaagggagguggauccaaagaagcuuuuggaaacaaauugacuauuaaggaacucuguggcuuuggggugggagcugggcuggacccuucccacacuagccugucuccagugacuuauagccugccuaauaguaggauaaaucagcuggccaccaaucugucagagcuccucugugcuugaagaggguuucgugggacagccaugcuaaaccauaaauuguuccaagaauaaauauguucuuccccauagggcagccaucuggcuucagauucacuucccaaagccaagauaaccugccaauagguguuugggggcuuugugccccuaaacgcgccauauucuuccucaggccaaagcagcuacccccuggcucagggccgcucuccuugucugaaagaacccaaguugucguuuuguugcugccacuugaugaugcuaaggaguaauuaccagugauuaaucaccuacaugagcugcacauuuuauuccaguccaguuaaaaugcaguacccaacccucuauacugggccaccuuccucaugagucucucuacagcaaagcccaguucacuuaagauccagaggagccagcuuggcccuccaccucccagggagcucauucuggggaacagcucuguccgcagagccuuuuaguacccuggguuagcuguugaugagggguuuggaagccagcugggugacaguaaccuggguaucucagguguacucagcaucuuccacuugugaccuccugaaggcugcuucacugcugaggaauaaaagauuucuucacaguguguaaacguuuauacauacgggcuaaaccagcaagggaaaugccgagagccucugagaccagguaugugcagaacuguuuggacaguggcuugugugugcaugcauuagugaguguauauaucuggaggaaccugaugaugcugaagccuagaagcugccuccucaggaccuuagcugccucucugcuggguuuauuuaauuccacccagugucccauacaagccucccuuuccucuauacuuagugguucugggcaggaacaaggagggaaucacggguggcacauauccacauacagauauauacucucucucucucucucucucucuccucccccacccccguccccucccuccuccuuucucaucccagcagggccuugaacagggcuggauuggccauugauuaguuuuauugagcuuggccacccugcuguguguuugaaggccucugccaccauggcuccaugccagccacacccuuggagccuagugaguagggauauuaaauaggauuuagacagccaauggagucccuuggcacauuucucuuuccugucaggaggagggucuggggcucccuggaaaaagcacaaaauagagaaaggauggagggccagaaaccaggaggagacacagccucugcuccucgccuauucugacuuauaccugugcccagcacaauaggguccuucccugugacagcugcagcaacaaggggacccuaguaaguuccagauauaguaggaaccugaggaaaucagaaacuugcuuggcagaacagccugcagcagaagcagaggagggaaggguggaagucuguagcuagagcugugaagggucucagcagugccuugccccaagacagauccaccgugcccccagcuuugcagcagaagagaaucuuucuuuagccuggccaccauccgaguucaagaagacaucaccacacaaaugcacucacaagugacccaagaucaggggaaacuaauuaccaggcuccucaugugccuaggcccugcugcugagccaagauucauagcuccuuggccauaaggggucuuucccagccccucccucccucugccaagaaccugggagugacucuguacacuuacugcuccuucuagaaaagaccuuugaauuuuccuagucagcucgcauggguccaggaaaagcagcauccaccccaaagauucccucaaacaagaacauagcagggaugugagcucagaagcuuccugaggcugugggcaaauagcaccugucugccaaggggccuuuccagugugucugucugucugucugucugucugucuuuccucaugagcuuguucuacacaagagcauuaucagucaauagagguguguucuaaggaugaggaccacacccauccuagagaacugguuccaucacgccaaaaagauacgcugcauuugccagcaugcccaggaccacugggcaccaagucccaaggaauagcuuagcugcccccucucccucccaaaaaaacaaggaaccaaagagccaaauccaaagagcugaauucucacuuagacucaagguuccuucccugaggagcagcucucccucuucuagcccugauucucagcagcccacagcaccugccacuccauaggagccagcuaggcaccuuguuuucauugucuucucaucccagguggcaguauguacucccucugccaggugagcuauccgaccugggguuggagggggagggaucugucagacuuucauuugcaucauuggugaccucagccuguuaccccccugagccugagaugaacaaagcuccgcccccucuccccagggagggaacccggugcugucgccuagggcucuuucacuugaggacucauuagcaguuucugcucucacccugucagucagcuccagauucaucaacgcagcugaggagagcccuccccagcagccacagcccaggaaguagggugggggaggguuggucucugaauggcucucagauccucuccaucagccagcacugaggccucgucucuuuaccaagcugcaagccuggaaagaggcagcuagaggaguaggcagagcagggaggggaggaaagagccacugcagauaacccaagcaggcaugcaccagggugcugagagaucgagggugagaagcaugggugcuggcaggaaggagaagacuccugggucagagagguggcuggcaguggcucagcccauuuaaggcagugaugacaggcuugucuuagaggcugugugaguccuauugaucuguggaguuccaagagcccagucgauaagaaugacugccuaagcugacccauuccagccagagaagccuagaggaaagaccugaaggccuuguuugaaagcuuccaugacuguccuguccugucauagggaacuugacuaacuugagguguuagugaagacagugggcauuagcacccacuggcugcuucuccuggccaaccagggcuggugcuggugcuggugcaugucuuaagucccugggugauggaaugagaacgacaguaguagugauggagacagauguuagcagcuagaaccuagccagaguaagcccuacacguggcauugugaaaggcacuucuuucucuauguggaaugauggaaaacuuaggccuagguuuagccauucccuucgauagccccuaaacucuugccucuccuuuugguagaaaggcagaaguguaagccuggggugacucaaggagguuccauaauuguagcaugccugccuuucagcuccuuccaggggccacccaagaaccugcucauuagcugagaaugucagugacuagauguuaauguucuaaucaaaggaaguagacccagggaucacuuguuaaagucaacacgagguaaaggguaaaugugcaugccgcuaagccuuccccagagccccccugugcugccucuugccuccagacacccaaccaucaccaagggccuacuucugacugcacaccuguguaccucaguuuccccauuugcaaaagaggaauaguguuauacucauucaaaaagguuguuguaaggcucaacuggauugauaccuagagaguguuuagaagguucguggcacuggugagcaagaagguuucaggcuaauaucauccucuuccucuguacacgucuucaugaugccaugugugguccugucuccugccuccccauccacuuccugcuacucagcuggagagccaccucccuccccugcgcugacaggccucacuacuuggcuaaucuccuggccgcaggauuggacuugacgcguugucacgucgaaucaacuucugagcugcugcagcucuggcacagggcauggggaaggaaggaaggaaggaaggaaggaaggaaggaaggaaggcaggcaggcaagaagagagggaaguguggagaggguggcccagccucugagcugaggucagagcaaccugcuggaggugaggaauccagagcacaagaaaaacaguucuucacagagccaagucccccauucccagcugcaacuaggagugccucaggaacaggaguggccauagaaaugaccugcagagugaccuugcagagcacugugggaagggagguggagguuugaaacuagagggacugagcagacugcccaaagccaaggcagcucacuggugggauccuuacacucuacuccugggaucaccuggaacucgguuugauucuaauuuaauaagccuggggugagauccuggagccuguuuuuaaauaagcuuccaguuugauaucugucagaaucaugacccucuaaccuggaacuucagagacuccagcuuuccugcucagaaucagcccugcagugaccccagacuuacccaagggcaacaccuauuuacccaaagccccugguuggggguccucagcgaugucccccucagcuacccugucuucacuaccgcaccugcaggucugggcccacuaugaggagcggccuguggaggaggucaugccugugcuggaggagaaggagcgcucugccagcuacaagccgguguuugugaccgagaucacagaugaccugcacuucuaugugcaagauguggagacuggugagugccugugugcugcccccucacagaucccccacggaacuuacaacugcuacugccccugccuccaucgcacugggacuaugucaccucugcuacccacaagugagcccuggaguggacauguggcaggccaagcagguccucugaggacagguggcauuauagauucaucugggugguucucugagacucuuagguaaugguuuuccucucagacaccccuggcagcccugagcgugaggauuuguugccuaagugugucaggaaucauggagcagauugucugauaugaucagggggcccucuucuuacagaggaccagaaggguacaagcuugucccucuccuugaggugguuucuccuacagagguugguuaguguagaauuguaguggccaguuuccaugacaacaagcagucucuaggggaagcuauccccuggcauucuuugugaaggaccuucuccuuucuccuaugcucaguccaccacccgauggccaucucaguagagaccguucuagcggcagccacucuuccuuccccugaccuccuuccucuucaaucugcucuaggcaagaagcaguuuuguugggaagaaagggucaagcucuuagaccuuuggguccaaggagccaaaucccaaccgagggauaugcagauaugggcagccccaggaauggcaggauaugguuuuugccuagcuuccucaauucugccuccaagccuucuccaaguugccagcagccugucucagccacuuccccucuaaugauauuucccaagcagcugcuuuguggugcugucauuucaccaggaaaacuucucucuuccuuauccuguguaggcucugcuugggaagagaaaaggaggagggggaagguugauaaggggacucacuucuccugaaggcaaccagcuuuccggacugggcugccugauggaaaaggcguguuaccucacagcgucuaaguagacauuaggucugugggugaccgcaagaacagcuacaguggccauuggaaagccugagagaggauugcccagggacaagauccacccacaggccccaccuagaaggaccuccuuaacuggccccacugcguucagaggcagagcuugaggguacacauuuccugccugacucccucaucagggaacccuaucaggcugucucuggcugcucagaaagccaagauacuuggagagaguggaguccagggaagaaaugggaaagaaagaggcccauagaaagcuagcauuccuagaauguugucacuggcuucuaacaguaccaggaggcugcaacccucagguggcucuguucaauccaugaaaauaagcccagggucuuuagccucccucuuugaaccuugggacuccucaaggcacauccucucacccugccugccccucuuucuauuaaagcccaucuucacacaggaacugauagaaacauuaacugcagguggccaggcagacccuauauaaggaccuccaggaggcuguggcugcuggcaggaggcaugagccucuuucuuucuguugccugggaaccuaaaaauccaauaaacuaaaaguagaccgaauucaaaccugucaauguaaaggcugcuucccagugccuagagcuuggguaucugggcagggagcacucuggaggagcccagaggccucacacucaguugacugagugccaggaccgugggugcacagcagcccaggaagaugacauguguugcauaugcagagaucauuucagggugguugaauuauuaagcacccugcaugcacuggggauccuaccagaccugugcaaguaaacaaucaagugagcuauggucugugcccugaaggagcucacaguguaaugacaaaaacauaaacacagacaaggaacuuagacaguggaugguggcaaguuuaaccuguuacaguguggccucagcccugaagggagagaagaauaccacacauagacuauacaucaccagcccuguucucaccuaugaggcagaagagagcaaagaggcugugaggcugaaguagcaucugggucagaagggccaugaaaggacaggccacagggagcugaugcccagcaaagccgggcuagggaagaaggccacugcaggacggagccagagaagggaggugaccucaggaacugccagggcuggucacguagcuauagggaaguaacaagggcuacaacccucagccagggagaccaggcaggagagcaggcacugagagggcccuggccuggcagcaccuggaagugcuguuccacaugaauuucacagggugacaggggucagagugccugugaguagguagagccucugggccccacucagaauuacuugccaucuuucaaggcucugacucugagguccuuuccugucugugguuguaagugauccaucuuuuugcccccaagagacauugggcagaucggcuccugcuaaucaugggguccagagucccagcccuguucuagaagcuauucugccuugcucaguaucuauuuuccuuccuaccuucucagucaagaccuagccacaagaaauguaccucagcaguaggauaguucccuagcaugcacaggcccugugcgccauccccacuacuugaaaaagaauuuggaaggcccaggcaauuccccagggcuccuuuagccauggcuagugcauuagaacauggccaguacagugcaugcaagacccugguauuagcaggucaccaaguuugcuuuugaauauggcugccaugaagccucuugagugagagccacaaagaacucuguugcaugggcugagggagccagugcuugagcccccuggaacuucacaccaugcuuaguccccaggucaccaggagugggaccccaaguuucacugcccuuuuuuuccugcaggcacccagcuggaaaagcugauggagaacaugcgcaaugacaucuccagucacccuccuguugagggguccuaugccccccgccggggagaguucugcauugccaaauuuguagauggagaaugguaagccacuuggaacagcagggcaauggggcuuacguaggauggagaaauauccuggggcacggaccuaucaagcggcaggcauucacacaagcauuuccuuucuguggggauguugguaacagccucugccaggucuucaagguaucccucugcagacgggggccaggggucaggggacugucaucuaagcagccuccagagguggcaggauaaaguggugucacucccucuccccugaggacaccaggauaguaaugcuggcagcugacaccuuccaacccagcccuugcccucacaggaagaaugaugucaggagucaggcggagguuuguucacagugagcacagaccagccagccagcccuccaccucuccugucugggauucaagcgguuguacaucuaggccggaaggucacucauguaugaucuaccaaggguagagcccauggccuuccaagggugacagagugacuuggauguguucccugcugaggccucccagacagaucugccagcuaauuacaacugccguuuggugugcuggguuuaaacagcaggcaucaaucuagucauuacucuuguugcuuuaugccccaaggacauauuaaucugcugcccgugcuccuccucuuccuccugugcucccagcucuacuccagcuccugugaaugcugugcacagcccccugagccugggcuucccugcucuaacacccagagacccugggccggaaaugcuggauccacagggaggucggguucuuagugcuaucguacaagcucuaaccuugaugccauugcagguaccgcgcccggguagaaaagguggaguccccugccaaagugcaugucuucuacaucgacuacggcaacgugagugcugggaccaggguggaaaacaggcaaggcagggaccauugggcacaguagccuccuugaucaaguccuucucucaaaugucccacuaagcuuacugaugagacauauauauuggucaccgccacucuucauaaaacaguccagacccccugaacaacuagaaagcagaguaaauggggccaggguccuagaaacacugauagaucuuaaaggacuugacacucugagguguggcaguggcugucuacuguccuuucaucgcuuaaggauaagacaugaggaucugcuagcaggaaguccagaacgagggucaugcucucaucuuguuaccugagagcaugcagugaagaggcacugccaggcuggagugacuccaccuaccagggccagaaccauaaacauacccagcacugccaggcuccuucuugaugugagcacccugccccauggaguacuacagggagcccauguggcagagggaggaggaaugaggaaacccagguaucugcaugacucguaguuagugggagccaauaaaggguccacugugagacuagcaaaacggaacugagccaaagaacaagcuagagaggcccaaagcagacguguccagcagccuggcacagaggguugugcuugaagcaagggggcaccauuauaugugugauguuguccuggugcuuccucuguagagagagauccugccauccacccgccugggcacccuaccaccugccuucagcacgcguguauugccagcucaagccacagaguaugccuucgccuucauccaggugccccaagaugugaguacagacacuguccucuucagaggggacugucaacacagccauugcuucagcucacugccuggcaggagaagauggaaauguauugcauugucuguugucguugguaggaucaggaguugugagugguagcuuugacucuggaaauugagggaagaugccacagacaagauggcacgguaccaguucagguaguucuuuaggguagaccugaggaguuaggugugcuggaauagacuccauucccacagcuagauauuaaugaguagcggacaguggcaagaaagaagagaaaagguaacauagggccuggacauugugcucuugucuguccugacaagguauggaguuuauucuccguaccuuaggcagggagggaagugugacauggucagauguguuucugaaagcuuuguaagugggaggaaugguuggagauagccauaacaggcuaggcuagagauaagggcagccaauccaggcccauuuggaggguuagggaggggagcggagaggagaggagaggagaggagaggagaggagaggagaggagaggagaggagaggagaggagaggaccagucucagagacacgugacaauaucagagaggugagacgagacagagggagcuaagaugccacugaguuccugacacacagauguguuguucuuggccgagggaaaggggaucacuuugagcuuggaggaucuccacaggccuccacaggguccaguggagaagagaaagaagaucuagagcucuggaaggaggcuggggcuuuagccucaaggaggcaccuagugcucagagcaaaggugugugagcagcauguguagagcugccuccagcagcaguggaaaggugggggucaucacccuuaccucccugccugcucacagaaaugugccaaggggaaaagagaccacaaaaggcacggugagcuggcggagugacugugaggcuggggagcuaugacgacaauccaggaugcuagugugguaaagacaacaggucugauagggucugugugcuggagccagacuccagagcuuuagaggggccagucauuagguaagucuggggcagagaaaagccacuuuuccucagaaacaggccaggugaguggguacccaaaacuuggauauaagaguguuuucugugcaauugguuuggguagaagaaggguuucuucauguccagggccuguuugucacucacagacaccacaggggacagucacagacucugcuggaggucacaggacaggccuugagacccagguagcuguuguuugaccuucacccauccccuucaauaacauggcuccauccauaucuaggaggacgcucgcacagaugcuguggacaguguggugcgggacauccaaaacacucagugccugcucaacguggagcaccugagcgccagcugcccccaugucacucugcaguuugcagauuccaagggcgaugugggacugggccuggugaaggaagggcuggucaugguggaggugcgcaaggagaagcaguuccagaaagugguaugugauuuggagagggccccauccuggaagcaggcccuuagcacauacccugcaucaucagcaguaucacagaugagggacuggggacuacacccagugccagugaggaagcagagaauccaccagccuccugguccugcuggggaaagauaauggauuuggguuuguuggguuuuuaaaaaaaaaaaaaaucuaauuaaagcacaaauuaauugacugcggguuuggcugagaaugcagcugcaaacuagagcagaaaguuucccucugucugugccccagucaacaggcuagggagcuuugccaggggcgaugcagagggucaaaacuuggcucccucccagucuuuuuuguuaacauacagucuccaaguccuauuacacaggaccacccauagccauguuccaaaagacucuaucucaaggcuccuccagccuacuuggaaagucccaggacccagguuacugggaacccccacugaugagaugaggguucaucguugagaagcugggccuuaggcucaugagaugaagagacuauuagcugcccucuggagcugagcagucaguuccccuugcucguuucauuucuugccuucaucuguggauucugagucaucugcagugccuccaugugguaccaugagugucuagcucccuagaagcauuagccauggucucacuauaggccagccuaucucccagcuguggcaaaccuaugaacguucuaaagagagaaagacugcuaggaugcucagcuccauaguucucgggccggaacugacuagacaccaagcagguagcccccacuucuuccccauggagaaacauggugugaggaccagcuucuccaguuuucagcucuucgcucagcucauugcuccccuucccaggccauucuucugccuagccucuguucccugccccauagguccacaugguguuuuguuggugggugggucagaggcauugguuaucuuacuguccucauguaaagcuguuuauaaugucucugauaccuagaauuccuuuugcccacuaucuauaaugaaaagagacaagccuuaccccuaccuugcagaacuucuauuccagcaugagacggugaacauaaguuaaauaaaagggggaaauagaagucuaguccagaggaucaggggcagaaaugcaugcuuuacaugggggucauuguacuugacaugaagaaggaaguguuuuaucagagaguugagggguggaauagauagccaggugggacaugaagggaaaaaaaccugugaacacauggauuagccagugcaaaguugagcaaacccagagagcaauguggcuguacagccugcagcuugcucuaagugcuagucuccucugggggccacccaucuguagcagcauuuuuugguugcucauucaagagcaccuccaucuugaccacuucccaucuucuuaugucccucagaucacagaauaccugaaugcccaggaaucagccaagagugccagggugaguucuugccuggggucauggagggguugaguuugagaggcguggccugguggcuuccauuggguaacaggucccuuaagagucguguccugucucccucucucacagcugaaccuguggcgcuauggagacuuccgcgcugaugacgcugaugaguuuggcuacagucgcuaaggagaacuugccuggcccccagcaccgcugaugccagaccuucucccgcugccaggaagcuguugucgacuccagaccugguugagggaguauagauugggucuagcuugcuucaguguacagaaaccuccucugucguggcuagcauugaagcugggguggagaacccgagguuaguugggggcagacccgcacagugguaaugccguccagucucucccagaugauuuuguauuuuuauuuggggagagggggcugguuuuuuuuuuuuuuuuaauugucuucaaaucaggaaagaaccaugaaagacuuuguguuagugaaggguauaaccgugacacagaggcagcugucagcuggcacccaccucgucccccagaccacccuucuucccaaguguugauuaugugacuucugauacauccguucucaaacuccggugugcccacaucugccuccucaccagccuggucuguauuuaaagcuuuugagacccaauaaaauaguaccugcugucugcagccuuacugucgugguggagccagaacacuguguuccugaccccagccagggggaagucugaccacaguccugaaagcaaggcugcguauagaggucuaggcagcccugaggccugcuaaguccaaccaugccaugcugcaggagagcagacgucuccuuggacucacugcaugugacuguccuccaggaccucugccucggagucugcauggcugcaguacccagaguccccaaggcucacccauagcaugaucccagugaggacucucccaguuccuacugugggcucacauuggauugccaauaagcugggcuugguaauucgggguauaccccaacuucaggagacugagacaggaagaucauuaauuaauuuaaagccaucuuggacuauauuguguucaaggucagccugagcaacuuaaaaaaguuuuaaaauggccgggccuauaccuuaaugauaaaguugcuugccuagguucaguuccagauagauagauagauagauagauagauagauagauagauagauagauagauagauagauagauagauagauagauagaugcccuuguagaauagggcuaaaguagcaggcaucucugagagggaucucagaucuagugaagaaggcauguugcuguaacuggcucuugcucuggaagaccuguugccucaagcuagcucugacucuaaugaguguucucagaaucuucaagguuuaguccuauagaacuaucuauaguccauaacugugggcugggaaaagccuggaacagccaugugauggcagagaaaagcccaccucaugcauguggcccuacccuaacugcacacauacuuugagaaaauccgauggcuugaccuuccugacccugaugauacuccaaagcugccuuggccuucguuugaggcaccagugaaaguaggcuggcuaucccucacaagccagacaucccacccaaacacugggcagcugucacaugagcuucugcucaggacacaucuuuagacacagggguguuccucuuggucuuggugccuguguagggcgagaggcaaaaaugguaagaaccaaguaggaagggcuggacaggugucucggcaauuaaaagcauguacuguucuugcagaggaucugaguucaguucccagcacccagcuaagacagcucacagcaucuguaaacuccagccccagggcuccuguacugucguggccguacccacacacagacacacgcacauaauuuuaaagaacaguaaauccaucuuugagcuuggugauggugauacaagccuuuaaagcccagcacuguggagggagaggcaggcagaucucuugaguucaagaccagccugguccacaagugccaggacagccagggcuacacagcgagacccugucgugaaaaaaacaaugcuagcacaucuuuggaaaugagaagcaagggaaugguugggggaagcauggggucaguccgggaauccuacgggcgcuugcuuucucucuugagccccucagggcugcucggaacaaguaccaguacuccugucucagagccucugcagucaagggaacugcagccccaggacucugcacagcucuugggguugucugccaaauccucagagugguggugacuuaggugacccugccgccccccaguaggcagucaugcuuuuaccauggcuuuacuuugcuugguccacagagaagagaauggaugcccagcucauuucuuuaccuucuacagugcucccaguaaggccucaaggcagggcgcugugcauucacaaugagcgcaaucggcagaggggcaagaugccaacccacucuuuguaaaagggucugaaaucaucuccccaucguaacaguugccuugguuacaucugcacccaaggauaagccuuccauaguuuuccagaugaaauuacgccugagccuucccacuuguuauuuccuuucucuuccaaggcuaguuuagacaaaggucagggcagucgccagguaggcagccucugcugcaggcuccagccugcugcgccucucucugccacggcuguugagcugcuggggaguccguguuaaggguacacaugaaggagacacucaugugcgaaugcacuggcguguucugucuccguccaugcugguccugcaucaguacuugcaggcaagccccagaacgcccagacuucuggacuugcucuauggguuuggaaccauggauuauauaccuucccugugcuuuuccaguuuugcccccaguuguucauucccuucuugccucccugcuaaacagauuaauacgcagacagcauuuagcauggcauuggguccagcaaagugucagggcuguuuugagguccucggagccuuacaacagcccaggaggcagccagugcuguacacgaaaacccagucauguccuggaguuucaagggucuuaagccccuggcuugaguggcuugagaaacuucccagggggagaagagaaaguuggucugacagaugaggaaggguuugcucaucucugacuuuguccugggaauuccuugaacucugggguuugaugaccgacagggagauacugguacgugaagucccuuugcagugacaucaucuuccucucugcuacacacacggccaccagagaaggcaggccguggaggaaaggccucaccagcugccucccuucauuuccgggcuugauuauucguacguccuggggagaguuagucaaaaggaccccuuuuccuugcauuagcccauggugggaagcaucagggaggggcaagagugcuggagccucaagagugguuauugauguccuaauuacaagaggaugcuaauuuaauuugaaccuaauuacagugcacuacccuggguggcauguguuuuaauaauuaacguccuucagaugcgugggaguguaauaauauuuacacuagguuggccagcagccuggggaggcgggcugggggcccguacaccacccucuacccggcagcuuggcugcuggcaggugggggagauggcauaguagucuugguccccuggugucuugucauccuucccaggggauaugcuugggucuuguuuccagccacuuccuugacccagcaggcugcuucacacugcagggugccaugcuggccuucugaaagccaccaggcuucagcuccagcaguacucccauaccacaccagcaaggcugcugauccugccaucccugccuacuugagcccucccagggaagggcuuguguaaacagaugccccuuaggaggauggaaggagagcuacuugguauugcuccuucccugguuugcagguguguaaggaacacauucaggaaagugcaccagggguguagcucacacauaaacaaaacuccacaagcugcaccacacucaauagaggccagcagcagcucccucccagucagccacaggcagccccucucugaccucuguccgauggaugacuuugcccaucuugugcuuccaccucucggcucccccuggcugugguguuuuauguagaggacucccgcugaacagaccccucccugugugcucacuucuucaacaagguggcauaagcauccucgguugcauucuccucugcguucucugaacacacuacuacgaaugguugcuacaaagagggcagagcgcagcagucugcuggggccauagccacaccagucccugaaggagaaagcuccacguuagcaccugaaggacuggaggcacuucauaaaggggggugggggagcagaaugauaagcagaacaguuugacagcccacccaaccccagagcaauguguguaaccagaacaugcagggguggcaaauaucagcacaucuagaagccaagcagaaucaggggucagcccugggugcagagcucagcugugcaaggcucaccuaacaugaagaggggccugucucaaaccccagcacugcaaaagggaguugggggagggauuggaagaagccuacaguuaagaugcaugggagaacaugggugccuacugaaaagucucccggggcaguuuccucucaaagcauggcuggcagacccacucuaucagaaucacuuggggugcucauuaaaauacagcugccaaaaauagugucagaacuauauugggaacgggguggcacaagggagcuaaguccccaucuaucagagcaggaagacaaugggcuguguuugaagucaauggaacaagagcuggcguauuauuuagcaauaagauaguaacccccagaagaucaaaagcagaugauuaaaagugauugccuguagauagcacuacagggggugggcagcacuauuggaauuuuuaaccauaggcaagugcuucugaugcucggguuuuuuagauucauuaucauauaaauauuguacugauccaucucacucuggacugcugccccaagcuguguggcgcuggggccugggaaucuacuuuuaacauguuuccucugugguucugaugaguucucaaguucaagcauuagcuaucacuguccaaacucauuuuacaagaugagaaaagagacaaagugacuuacccaaggucacccagcuuauuaauggcaggcccaggaauagaaaguagcucuccuggccccaggccugugauuuuuuuuucccuacaucauggcucucaccuugguggauguccaucuccacaaacuugaccccuggggaccuccgggaugagcugggguccuggcucaggugggaaagccagggugcccuuguccauauacaaagcaggcaguucuuccuacagaccuagaguccucaaacagugccuagcauguucgcagcgccugcagccuauguggagccauuguggaaaccagcacauguaaaacuauauacggcuacuuuuacugccagccaguagcaaagucuugguggguuuuguuuguuuguuuguuuguuuguuuguuuaccugaaaguaggaaugggccugccuauucauuuaccaucuccugugcugcuaguugcaggaagcuauuguucugaggguuggggacauuaccucacaguggggcucacaguggggucagaugaagggaggcagauauaguagguggaugagcaagcucuagcucaaagugauacuguaugccccaaaaguuccuucacucaugcaagaaugggcaucacagccaugaccauguggcaccauggagaaaccuuuuaaaauguuaaggcagcucucagaggacuucaucucacuuaacaccauuauucaaagaaaaagaaaaggugguauguuacuuagauaccacaugguguccaaguugggaugucuuugggauucaaaguaaauauuuaaaaguccauguguuuggacgaccaccacuagaguacacuggagcauauagagaccuacucauggauaauaagcugaagaaagcagaggagaaagaaagauggcugggaagacuggaagccacuguccgucuggcaagcccaaacacagaucauacguuuaugugcuacgugggagcucaaaggaaaagagacuuccugggagauggggguagaaggacucaucuggggagcuguggcagguuucaagggaaggggacuugagccagcaguaccugauaaaguccagggucugacaaagcucuguccuuggagaagguugcccacagccuaguggcuacaaagccagggaccgucaucaacuagcaaagccucaccuauagggagaagacagcuucguccucccuucucagguugcagucuaauuccaguuaagauuacagaucuuaagucuaugucuuguggguuucagcaaacccuccacuugugccgcuaccgugcugucaagcuagaugaggugcauuccaguagccccugccaagguuuucaaccuuggucacaaucaaauguuggggaccccagucuuuuaagagacauuucuccuggaacaguccuaggggagcaaggggccgugacauacuggggacuuugccagagccacugaccuuggaucuaaaauugacagugaguaaggugggauccuuagaaccucaccaagcuaucacuggacccuggucaagacuaucaggacacgaggguccugaggccugccucgggggcugacagugcagagcuaucauccagggucugugaagucauuauuggugcccuugggcagugacugugccagggaacggguacuauugaugcaaaucagcgagcaagcaaucucaaucuacagaugccaucugaugugcuggcuugugugucuggcuuugcuguguguucacucgcccagcuccucuggucaggagugucucacuguagagggagagaacuacacugcaggagccugagucaaccuccucucaggcugccuucucucccagccuguacuacauacagcaaguggucaaagaauuucaguuucaaagaacgccucacugagccuugggcucuggccagagacugaucuagcuagaugucagccagaauacacguguucgcacuagcugagaacgugcaaaugagguuugccucaaggagcuucgcaacacggugcucgaggacauugcuuuaaugacuguguccuucgugucguguacuagcugaggacccuuaacccagcuaaucagccucuccaggcuguuuacucaucuguaagaagcugaagaaaaacaaauucuuaggagugggcugcauggcucagcagggaaaugugcuugcuugccaccaagccuagcauccugaaguccaucucugggacccacgugguguaaagagagaacagacucuugcaaguuaucugaugaaugcgcgcgcgcgcgcgcgcgcacacacacacacacacacacacacacacacacacacacuuuuaaaagaauucuucggauucacaaagaauucggugagacauuuguaaggcccuuugcauaggaaccagugugauccagaacugagaaaaacagugcagccucccuuauccccaagugaccagucccuggcuuccuaccccgggggaggggguggugaagcagcccugaacgauccaguaugaggaacuagugaugucaugaaaucuaaacucaugggagcacugugugcccaaagccagaugggauccagaguguuaggaaaggaggucccggggugauuuggcugagccacuaggacucuuggcugaucuggaacuacagagguaagucagucccucaacacugaacauuugucccaugccaaacacaguuuaggugcugaaggaacagcggcaaaagagacccugaccagucagaaccugcccauggacaucguucuugggaccuaaaaucugaacccagcaggcauagggguagguuacuauugggcugguguguccugagcugcuuuucugaugauagcccugauuaucuggaucugaugaggccucaccgaugcaugggucccucccaagaaagcccugccucagacagcaugggaauucagugcacaugggagcacacacgaaggccucauuggcuaugaaaggaucuuguuuccaaggccaaggauaaggacagcaaauaaaggggacccacaugaccaucccccuuccccacacucuggauggacaccaauaauugaugcuggcucucuuucuggcauggccuuacagcuguguaaagggugccuaccaggcacaaacagagguaccaugccaggcagaaauguugacacccguguaaggcacuuuuugcccuucuguguucauugcccaaagcucuggggccugagagacaccacagugaaugagaguuagaaguauugcccuuuaucaggacaacagacauggggaggucaguaccugggugaggguauauacgggguaugagaagagauuaggugugaauauagaaagcuacauggaggccuguauugaacugcauaugugaguuugaccuauagaggucugugugcaaaggugagccuggcugcacucacuauucagccuugaacagcuggggaaaggcuguuuaugaggcccucccugggugcagccgugcacagacacaauaggcagcuugguggaagugggagccaugggcaucccugggcucuagccugacugccuugucuccugugcacugaucuguggagggcagcucccaggagggagucccgaggcaaagaucacaaacagugccaugucugaucaauugauaguuguucccugggguucugugagaaaggacuggaaggucaugccacaaagucagcugucaucaauuauugauguccacccagagugugggaaagggacggucaugugggucccauauauuugcuguccuuggcuuuguguauucaugggcagaagguucaggauucugucaaaaauaucguuuccugggcagagaagacucgguggguaagggcauuuacccucaagcuggaccaccuaaguucaguccccagaauccacauggcauaaggcagacggacucucugacuccauacaaaugcuguggcuacccauauacguagacagaaagaaauguaauggcgauuuuuauuuuaaagacuagaaaccacacagcauccugaaagcagacaggggcuuaugaaacagggcugggaaccucaaagcagugcugcccgguccagggagcccuuacccugccuggcacugcugucauguugcauuugccaggaauggaucaguaaacaugggcuaaggcccucugcuguacugggcacagacccacagcugaguccaucauggcuucuccccuauucgguagaugucauucguaggcuaucaauaauccacaagauauuuucuuggggaagauucuaaggacaaggauaggaaguucccuagaaacaaaaacagugaagguccugaacagagaggugacugaguucgagcaucaggcauuaauugaagacccucacuuccauuuugucuggugggagcaggccguuccagucagcagacacuagaacagcuuccuacacuggaucagccugugagucauugcggggaggggacuuguuaaaauauaggcucugauccagaaaggaugcugcaaggcuaacggauucccccauuuuuaguuuuuuuuugggggggggggagagugcuuuguuuuaaaauauggucuuauuguguaacccuggcuagccuggagcuggcaguguaaaccaggcugaccucaaauucgcagagacccaccucugccuccggagggcugggaugaaggaccugccauguuucuaacaaauucagagggugcuuggagccccaggcucaccauaggaggaguuguugccuuccucccaacagaucagaaacuaagagcagggcgggguguggggagggauuaaguagggagucuggggagucagacaagaccugaguuuggaggcugagagcaaaggaaacucccuacauggagccagaaaucucggugcaaggaccagacccuggccuggcuuuccaagauaaccucaccuaggaaaggacccggcugcuuaggaaccggggacagcacagugguggguggcagagcuacauucuaguguaagcucaauggauuacaaaccuucagaugucugugacugcaguuccagcuagucucugugcccggcacugaacuaaaacacuuaacagccgcuccuacaagggaagacguuuugcccaauuuaacaaauauucuacaagaugauccaccuuuuguguccaucagcaaguauuaagcaagcaauuaugaaugagugaauuaaugugauucgugcagguagauccagaaaggagaagcaaggugccccucacccccaucuucaauaugaugccacacuccugaccuccaaaccagaccgaggcaggaacuuaaucugcaccagguggccuggaagccuguaaccaggcuuuacuuguugggauaacaugcuccuuuagcccuguguugguccagguugaugcuuucccaagucuuuugaggaaauccuaggcaugucugcugcaggaccuagccagauuuagggaugguuagguccccacuaauacagauagcuguauccacggggcucuucccuguguggugcucugugccaaacacaucccacgccuguaucccaccacugcccugcuguggcuuuacaggguauauucuggcccaaggucgcagacccgauucugagccaggcaaccacgcccuugcucgggagacagcgcccccuagagguccaggagaggcaaugggaugagcagaguguggggccauggaugccuggccuguuuguaccaaaucaccaaccuggggaguggggagucgugaaugccacuucuuccaaagacacccgcugcuggguugggaguaacaggaaagaaccaucuguucgagggugucucugugaaguuaauguccccacagccccaaacccaaccaaggucccauucuacagauggaaacagaagcaacuuggccaaaaucgagggacaccuuaacgacaaggagggacuggaaucccaccccuuccucccucaguaugucccugccuacaggagcuugcucucagcacccagggguaaccacuugggaccaagccuuggcuagcugugcgcccugggaaucuggcgaucaccuuggaccacugagcuaugcuucuguguguguaugugugugugugugugugugugugugugugugugugugugugugugcucgcgcgcgcaugcaugcacacacacaugucacccaucccacccccacuccaggggguuuugaagccccuggcccuccaccaccucccgaucucuugcugcauggcccaaccucucuaagccaugaaauuuugguucuugcuccacuuuaacaauggcacaugacacaccucaaggcugaggagccccugucuacacuucaguuggucuacacugcacacgacccuuuacaauugacagauagaccgaccugaacucagcaaguggcccucaaagugugguucccagguggcaagcaucacauuccagauuugcucccgaucugcuaaaagaagaacccuaaggagcccagccgaugcuucuaaaacacacuaauauuugagggcuacuggccuacacaucccuucacguacucacuggucuaccccgaacugucaguagaagaggggcacccaagcaccagcugauuaucuggucacuuuggguuagcacacagaggugcuccacacugguccaaugcagucuuggcaucaggaaccauagagucugccucggaugcaggcuaagaagggucuggauagaagggaagggcucucgggaugggaagaaguugccugguuuugccuccugcuuauccuuaguucccacccccaaaacugggaagacagagaagcaucccuucuugguccucacgagaggacacucuggaaguggggaugggguggaugaaguccugagugaaugcauguuguuggcaugaacacaacccugucaaggacccaaaugccucagacccauggaaauggcaaagccuuccccaagugagacucagaugacagagccuccucugcuucaaguauauuuguugaccuuuagcuaaaauuuccuucgcucagauguuuucaaccugaaacuauuccccugcagagacuucccaccaaacuagcuaagcccuccuggugcugaguuccugggguuugauaaugggugcgcuccaucagagugagcucagccuaccucaucccagcuuucuauacguaugucuguuguuucuuccuuccauccugaguugccccagucaaguuuccaggacagacccaugcaggacacaaugccauccagggucuuuuguagucuuccuuucugcagaagagcaguaacaaaaacagaagcuuaacugcagggcagagcuuugacaagggaggccacacaucugugucucccuaguagagcuuguauaggcuucuccuuuggaaagaacccagacuaagaaaagacggaaguccuggcagagaagcuuuggugggacgugugguccccauguaaugaggaugggcagcaucauuagccagaugggucaagccaguguggcuucggagcuacagaccagaguccagcuuuccuuggcuacauucaggcaggcaaaggccaaggagaugaggcuguaaugcacccuccagggggggggggggagaaacagagacccuucccauuccuaucacacacacaccaggacuucagaugaauaugaaaugcaagccuuaaugccuucccccaagacugugguaucacaaagaaccugguauuguuugauggcauccugggugccccagaacccugccugucauaaagugauagcugaaauguaugcuuuagccuugcucugaucuuaggcagaauaucucaccauaaauuggcaugccauggcaaacaauuaaaagagaaaaauaaaccucggcgcaaucucagagugcuuggaaaugaggaauuacaaggugguggcaugaaaaaauuauauaaaaaucuauuuuuacaucacaauaaugugcuuuuauacgggcaguaauuucuggaugugcaauaaaguggcuuuuacaucaggcaaaaucagaguuuauaggcaaucggugcuuuuaucugggaaaauauaacucacccuucuucacaccauccaucuugcaggcagcaggccucaucuucuccagcaccaacauuacugugaaaauaauuaugcaauuaaagugucagaccucuggcccccuaggaucccugcacuacaucuuccagcaucugucauuggcuccuuccaaaagugggacaaacuauggguccagacaggucagggagaggcaaacguucaccacgggugggcucagggaaaauacugcaggcccagcaagcucucugugaucguucguguggagagucgaccuugggucacacacugggagaggaaccugggcacucaaacuuggcuuagaggcaggcagcucucugaguucgaaggcagccuggucuacagaggacguuccaggagaaucagggcuacaccgaaaaaccuaucuccaaaagcaacaacaacaaaacaaacaaacaaacuagagcugacaauccuguaaccaccaugacucaggcaccagaguccaguccuuggcagaggaaaucagugauuugaauggagccaaaugagggggaugaggcagagugggucaggauacugaccaaagacggcuuuggccucuggaagcgcaugaagauaagugucucucagaggggaagcugccucuggguauuguugacuggggauuggagggaggagcuagaucuaggcucaaauaucacccagacuggccugucauuuuguguaccccguuaacacucuuagccaaaaugccaagaagugauuguacauugcuuuaaguaucugccacugucaccagccagguccccaugggaagcaggucacacagugccuucagugaaggaaugugcacagugaugagugaguaggguuuagggaaagaaaaaagggauguuccaguagccuacagugacaagagagaggcacugcugccagagaggagagagagagagagagagagagagagagagagagagagagagagagagagagagagagagagagagaucgcaagaugacagagguaaauccucauuucacucuccugucucagggucuucuucuaguuccccuucuaacccccagugcuagcccuaaauggccacaaccagucagaaagccaagugagucucccacacaguuuagcuuagagggucaugagagugggacuuaccagguggagcaggccuggguaaggguaacagguggagcagggaggagcaggaggagccagauggagugggaggagcagagggaggagcaggggaggagcaacaggagcagauggaauggaaggagcagguagaguaggaagagcaggaggagggggagcagaggaggagcgggaggaucagauagagugggaggagcaggaggagcagauggagugggaggagcagguagaggaacaggaggagggggagcaggaggauuggauggagugggaggagcaggaggagaaggagcaggugcaauagagugugcaaacagaagaaacucggcauuuucauagccauggauuuaaggcaguccuuugagaauggagcaguaugguaacaccaauauuugcuuauaucuucaagccaacuucauaggcuuucucuucucauaucauuggcucaccagaacuuaaccucagcaucaauauuaacaguauggugggacaucaugcuucaugacuagggagccugaaugacaaguguggaaaagacuccugaagguaguuccugaggcugugugcacuccauccucuccagacccacaugucugaauacuugcuacucagcaagugacagagucuguagaaccuucuagacaugaugcuuaacucugcccccaaggguugagaguugcugacccugucucaggccugcugauacaauguaacgacugccccauugccacaguuaagaacuaccugccgccaugccuuucccaccacaauagacugugucccugagcccgagccaaauaaaucccuuaagcgauuccucuugaauacuuuauuauggagacaagaaaaguaacaauugcagcauugcaggaagggcauggaccaaagugaccauucuagaauggagguagcuaugcugaagccaauaaaagccaggcccacgcuguagccccgcuguuucugcuccuggcaaaggcuucaaaggaagccccaggaagagucccauaaugguuugggucucagggcaucuguggcacuguuucuuguggugagggaugaagggcucuugccuaggagauuaaucaggacaacaugcaaaccacagcagccucugcacagugagagggaaacugcucuucaagguucuggaagaguuaaaggcaacauggagcagcaagagaaagaacucuguaauucugaaugagucaaguagauuaaaaaccacgcacacuccauuuugcaagcauccuuacaaaccccaaacacgugagagcaguuggcuuuaagagagggaacuaggaacacuggcucgugccuguaaucucaguacugaggaggcugaggcaggagaaucgcaaguucaaggccagccugggccacauagcaaguuugaggcuagccugggcugcaugagaccugucuaacaacaacaaaaguccacaaaggaagagaacaggaggggaauggcaguggaccaagacaaguacugggcucacgucaaagcuucacuccacaacaccuuguagagaaugucaucguugcuuuagccuguaaaagaaacagcagugaguagaucuguagugugcgccgugugacccagaccugucugaaaugcugguccauggagacuuguucccgggugagguuccacaaagaccucuggucccaugugugcaggguaagagacugccuggacagccucacccuggcucccuagcaggcuccugggugaauguguauguguguucauggggugggggugugaugugugcacacaccugcacacuuuggggaugugagcaacacacaggagaugagauucagagccccaaugaagaucaaaguuuuaacucacaggcagaagaaauggcucagcauuuaagagaacuggcugcucuuccagagguccugaguucaauucccacaaccacaugguggcucacaaccaucuguaaugggaucuggcgcccucuucuggcaugcaggugaacgugcagauggagcacucguaaacacuaaauauauaaauaaaauaaauaaauaaaaucuuuaaaagaaauuuaagauuucuuuggugguuuugagaauccccaccaacauuaauuccucucuucagauuccaaagucccuucugcuugaaaaugcaaacguguaccuggcagccccugugugguugguuggcugucucaacagcuucccucauuaacucccaggcgguuuuguguuuguuugucuggcagauuagcgccuaucaccuggaaaacugagaaaaccaagccuaaagggaugagccacuagaucuggauaagagcgggggcaguggagggaguguguguggcgggggugggggaugggggguggggggggguaauaucccagggagcuagguacaagguaggggccaggcuucccagcagaggacuucagacuucaggauauauguauguuccagcuggugagggggcacagaaggcaaacaugugaguuugccaggggaugcugggaucuggaggcaucaacccaccuccuugcccaaaucaggcaguguagggauuggggggagucugcagcaccugaaaggguuccaggccucuuccugagccuugguuuauugcccucugucucugcccuauuggcacguguucuaugggacucuguuugguuuaaccccauauucuucacguucuucuguuucccuuuacugugggaggagacaggcuugacuucaugcucauggcucacauuucccguuuacaucaggagagcuggugagcaccucgggagagaagcugcuuccuggaagccaauugcccucugacuucgugcccucugaccccacgccucugucacaugccacacuagggaagagaaccuagaagcguguccuuuuggacuuggccuggcagauugaauaugguccucuaaaagauaugccuaagucagaccggugccugggacugugcccucaucuauggccuacaagcacucucuagcacugagcuauauccucagcccuggaaacaggguccuuacgaacugaguuaaguuagugcuuggcuuaguccauuugagcugucaguuggaacagccaugccauauaccaaauggcuuauacacuagaaauguauuacgcacaugucuacaggcuggaaaugcucagugaagaccacucucugcuccuuucuguguccucacaugauggcagggcaagagcccccucuggggucuuauaagaguucucccuucucuccugaucacgucucaaagaccuugucuuccaauaccuuccauaacagcauauuggggauuagacuuccacauacaaauaaggggccaggguugaagaauuugggggcugacacaaacaggcaggaacugcggucaugcagacaacagccaaggaaggccugccagugguaccagaaacuagaagcagcaaagcccagcccccagugcuuucccuaagggagcauuuuguacucccuuucguacucuacucauuuugcagaaaagagaaaucccuuggguacgaagggcugagcccccagcuacaucagccagguccagcauggggcuggaagccccaugccucgccaugcuggccuuccuuuuguagcaccuccacaggagccugaaguacagagcaguguggggaggcuggagagcccgagguccuuggcaggagucacccugaugcugucuucucggcugcauccuagagucacuuccagccaccuccugagcugcauggagggcggugccaagcccaccagcucacuucaggugguuucaugccccauaagagagucaaucagaaauaacacacgcggcagccggccuggggccuaacgcuccagugggcagcugcugaggugacugccgagaaaauaaacuaauucccagcccugguggggagaaauaacagcaucagccaugagcacaagcaaagcccuggucugcagagccccagccaauaaagagagcuaaaaauauaagcaggccaugcgccuucccuucccuaccgcuggccacaucgcucggcuugcugagagagcuucauguccaggcaagugccugucugcucuauggccuugccucaggcguggccagaguggccugugcuggaggcacaggccugaagaagagagaaggaaaagaugggguggucccucuggcucccaggagcuccuggugagaccugacuuggucauguagccccaggcuacucccugucggcucacccgagugcuaauuguuacugaugaaggauuccaaauaccuggauuggagcugggcacuuggagccugucugucuucgugugagggagcaagcaaccccacauugguucucugugaaaguggccugugacccacagaaagcagauccuaucaugggccucuggcucuugacacagccugugguggcauccagcaggcaagauguguagccuugaaagaauaaacuuaagcaagcuguggugguaccuaccuauaauaccagcacuuggaagauagacuuaaagggguccagggguccaaggucauacuuagcuacacggauaguucaaggucagccuggacugccuaaaacacuuuauuaaacaauaaaaacaauccaccaaagcaaaaagagcuaguuaaaggaaaaaaaaauuaucaaagugcuaaguaaguuagacagacuccaccuccccacaccccccaagacucccacagaaguugaauucucagagucuuaaguuagugguauuaaaaaggagaagagagcaaaccuggagagauggcucagcaguuaagagcauugacugcucuuccagagguccugaguucaauucccagcagccacaugguggcucacaaccaucuguaaugggaucugaugcccucuucuaagcacaugaagccagagcacuuauaaauauaaacaaacacauuaauuaauuaauuaauuggucucuccacccccacuguugcaguucgugagggccaugcgagcagagagucagggguuccaaugcccugugagagucuaaggugagcaaaccacccugggauccacaacagaucaacuuacuugagggugauuuaaggcuuauaaaguuuugggggacugaggguagggacauccagccuaggcaaaggucauuggcuggggacuuaggggaccuggagugccucauuagcauggggcagcuugucaggaaucucaggugcuggcugcacagguuucaucaggagaaaggacauugauccuauaaacuuacugagacuacaugauauuccucaaguagaggugggugugagggcuuagaauugcccagacagggucugagaaggagaaacccuaaggaaagggagucucccauauuguacuaagccaggaggccguuggucacgguggacuucgaccuuaauuagccaaguuuucacacaauaaauaaacaaacaaauaaauaauuuuuuuaaggacuagaagaggggcuggagagauggcuguguagucaaaagcacuugcugcucuugcagaggacccagguucaguucccagcacccacauggaguccacagccaaguaacugcuguuccaggggagucugacacgggcuucuagccuccaaggucucgcacaucugaguacaugcaggcaaacacuuauacacauaagaauaaacaaauccuuagagagagggcuguagaagcuuaguccacacacaggauggccauucgaggcuucuggggaaucguuaagaaaggcuagaccauuagcauugagaccccagacuaaaauacacaaacacggcugccacggucugaugaaacccagugaacccucucuagcgcacgugcccuauaagguaccuccagaaccaugagcccagauaaaacuucaaucuuccuuugaccaauuuacacauucaugugugugcacaugugugcugauguaugugcaugugugcacaccaaggccaaaggcuggauguccuuguccaucacucuaucuuauuuuuuggcacagcuccaucacaagagcuuagaagcccucacugagccugaagcuagcugaauuuggcuaaccuggcuggcugguaagcucucagaugccccagucuuuaccuguccagggcggggaucagaaaggcauguugucaccaugcccaguuuuuauguggguucagaggaaccacucaggcucucauguuugcacuacaaguacuucacugauugagccauuuauuuccccagccucagccucugcucuucauaaaguagcuggccugggguauuuccuuacgguuaugaaaagcugacuaauaaggagagcucuguaaaagcauccaccugggguuaagugcggggacguggauuuaucucaauuaugcugcuauugauuaaaaacccauuucaauaauuccucauucacacugaaucugacugaauuucagucucauagaaaaauucuuuagauugcuauugggcucuaugcuacaugaauucucggcuggaguuggggagggcggggaccgcuguccucucccauccugggaccauccaacccucagcagcccuccccagguccucgccugcuuuagcaguugguauucaggcguacacuagcucuucuugccuauguagcugugagagccaucuuccuucaacucccuuuuaaagggccguugagcccaaccuaacauuuaaugaagaguucacccucaccucaggaugcuuggauucacucuuuacucucuaggguccucuuacagcugcccucucgccugcccauccgcucuguuccccagccaccugccuccccuaacugacccugcaccccuguuaaggauggaucccacuuuuagaacacacuagcgcucuuugguguuuccugaaaucucauuuuuuucccccaaagcucagcucacuugcuacccuaccucaguucauccuggugggaauggucacucguucucucugaccccagcacuucggacaacucuugcguuucucacuaaaggaucuugcacaucuuuccugcuggcggcucaugcugaaggucuguucaaggucagugcccggcacagcacagcugugugaucaauguaaccaagcugcagguggcccucagaccccugagagcagcaugugcuguuuuaagccguggcagcuucggaaugaugguuugucacacucuaugauugugcugagggauggcugggacaccugcaucccgggagccccaggaacaaugagcccaggcuuguagcaccgacccaaaguucuaucgcacgcgcacugagcaucugggugcugauguuaugugggaaauggggcugcauuugauggaaugauaagaccacagacgacgcgcagcuaugagcgggucucuggccgggugacucagccucuccguggcucgguucccucaugugacgaagggcuggcaaagcugaauguguuggcauguccuguagccuaggcauuccagaggcugagggggaaaacugcuugaauccaggaagccaagacaaaaaugagcaauggagugaugcuacgucucaaagaaaggggaaggaagaggagggauagcgcaaagaucugucuccauucucuggugagaaucaagaggaagaauaccaggccugaugccgggcacauagcgagggcucugcggaguguuugcuguugguaauuacaaauaauuaggaaggauuagccaucaucugcugcuuccucccugugaguacugugucuguuuggaagggagcuuacagaggaugagguggcuuuucacugcucacucuccucuuucuuucaagcuucugggguggagauugcucgggccaugcuuccaauaggagaauuaaguacagaugcagauauucuccagaaagaguggaaagaaagucuuucacuucagaaaaagcaugacgaaagccagcgaugugagaguggaagugaugggugcaccuuuauuuucccuguucuugcgcguccugcacacccucuuccaagaccaccagccuguggauacagaccagaaccuucaaggguccacagucaccgucuuaugggugauagccucgcaguuacauccucaggaacugggggcauccagcaagauggcagcauaaaccuugccuucugcaagcugucuucuagcuggguggccagaggggacacaggaaauaguugaacaaaucaccaugcuguuuacugaaaggacucucaaaguuagucagcagaacauccacaagaacgccagaaccugggcuggagagauggcucagcggcuaagagcacugacugcucuuccagagguccugaguucaauucccagcaaccacaugguggcucacaaccaucuguaaugggaucugaugcucucuucuggggugucuggagggaaccuggagaaggccugggcuugaguaaauggagcagauggcuuugcugcaccccagaccucugggcucccuacuguuccuccccagguagcccggcacugucugcaacacuaagucuggcucauuuuuacuaaaggucaccaaagggagacacacccccuggggagccacuuaaagacucccagcaccccugaggcuccuauguuugaauaccugguugccaguugauggaacuguuugggaagggcuaugaguuguggccuuguuggagaaaguuugacacagagucaggcuuugggguuucaaaagacauugagccaacuccaaugugcucuagaugugagcucucaaauguuccugucaccaugccuucacuacaccaucauggaauuccaacuucugaaaccguaagcccaaauuaaaugcuaucuuuuguaaguuuccuuggucaugguguuuuaucacagcaguagaaacucuugacuaaaauaacucuaaagguagaaacgagggggaagaagggagucaacuccuagagacgucuacauccccuaggcugugaucugguaugaguagacucuucacucacgggacucuugucuucaccgauaccacagagaacaaugccuguaucuauagucugccuccaaggcuaugcuugcagccccuaguaagcugcugcuucuccuuuguggacuucccugguaaguccuagaacugucugaucaacucuuuuuuuuuuuuuccuuuuuuuuuaauuagguauuuuccuuguuuacauuuccaauguuaucccaaaagucccccauacccaccccccacuccccuacccacccacucccccuuuuuggcccugguguuccccuguacuggggcauauaaaguuugcaaguccaaagggccucucuuuccagugauggcugacuaggccaucuuuugauacauaugcagcuagagacaagagcuccgggguacugguuaguucauauuguuguuccaccuauaggguugcaguucccuuuagcuccuuggguacuuuuucuagcuccuucagugggggcccugugauccauccaauagcugacugugagcauccacuucuauguuugcuaggccccggaauagucucacaagagacagcuauaucugggugcuuucagcaaaaucuugcuaguguaugcaauggugucagcguuuggaagcugauuaugggauggaucccuggauauggcaaucacuagaugguccauccuuucgucacagcuccaaauuuugucucuguaacucuuuccauggguguuuuguucccauuucuaggaaggggcaaaguguccacacuuugaucuucguucuucuugaguuucaugcauuuagcaaauugugucuuauaucuuguguauccuaaguuucugggcuaauauccacuuaucagugaguacauauuguacgaguuccuuugugauuggguuaccucacucaggaugaugcccuccagguccauccauuugccuaggaauuucauaaauucauucuuuuuaauagcugaguaggagcuaaaaccauccaguggaaaaaagacagcauuuucaacaaauggugcuggcacaacuggcgguuaucauguagaagaaugagaauugauccauuucuaucuccuuguacuaaggucaaaucuaaguggauuaaggaacuccacauaaaaccagagacacugaaacuuauagaggagaaaguagagaaaagccucgaagauauggguacaggggaaaaauuccugaauagaacagcaauggcucaugcuguaagaucgagaaucgauaaaugggaccucauaaaauugcaaagcuucugcaaggcaaaagacaccgucaauaagacaaaaagaccaccaacagauugggaaaggaucuuuaccuaucccaaaucagauaggggacuaauauccaauauauauaaagaacucaagaaggugggcuccagaaaaucaaauaaccccauuaaaaaauggggcucagagcugaacaaagaauucucaccugaggaauaccgaauggcagagaagcaccugaaaaaauguucaacauccuuaaucaucagggaaaugcaaacaacccugagauuccaccucacaccagucagaauggcuaagaugaaaaauucaggugacagcagaugcuggcaaggauguggagaaagaggaacacuccuccauuguuggugggauugcaagcuuguacaaccacucuggaaaucagucuggcgguuccucagaaaauuggacauaguacuacuggaggaucccgcaauaccucuccugggcauauauccagaagaugucccaaccgguaagaaggacacaugcuccacuauguucauagcagccuauuuauaauagccagaagcuggaaagaacccagaugccccucaacagaggaauagauacagaaaaugugguacauugucugaucaacucuuuaccauacacucuuaauaacuggcgggccagagauggucucaggccuuaggggucaccacggaaucauuuuugcugugcacugcucaguagauccacagagaagggcuugagggugaguggagaggcaacacuaagaggcuggcaaaugaaagagagaggaagaggcauuuggaggcagacuaaauggucugaaaccaacagaugcauguggagcucagagcaaugagaagccagggacgguggggcugggagcuggagcgagagaaaauguuccuuucaaaacgauuuugaagggaagggacaagaaggacccuagagaggcagauggaugggaagcaacaaauggacugcaugcagacugccugccccaugaggccucagcucugcuuagccugugcagccuggcugcccccagaggccccagaggcucugauuagcucacugagccggaccucagcucccacccagguaccaccagaaaagaugcuucaaugugagaugcugucucaggugagaaagguuggguagagcaggcuugcuggucagagccuaaguacagggucuggggcuccagucaucgacuauaggguucccauagacaccaaaggcccuguugucagcccucaugggcuggcucagggggauucaagugggagggaggaaguguuucuuuuuggcuaggcagugugcaacuaucucuaccccgcauggcuuccuaucuggccuggccucugaggagacagcacagugaggcgaggaugccaauagucaugucugaucugugguccaggggucaguggggcaaagcuugagcuguauaguacagggacacacaaguguccccccaagccugacacuuguaucaaugugcucuggccuucuuauguuugguacagccuggggcugggagcuaggguuacccaaggcuccuuuuuaugccuguccuucauggcuaugagcucagcugagguggugagucuuucugugugaccaucccacaugggucguuguggacuuccucacagcaucucagaagccucaggacuuggugcccaauugcuuacuagcagucgaagcuugccugaguaagaacucaggcuagacagcaagggggaaacugcagugccuugccagucagguaaauccauuuacauucucagccagcaauaucuuccagccucagagcacagaggucuagauccaggggaaggaaggagacacuuccuugugcguacuauauguccaaggccauauaguaagagcuuaugggacaagagacuucacuacaacugacccuggaaaguagaaccuauacuaccagaugauauccacaagacaaggaagacuuuuguauauaagugagcauaagaauucuguuguggaacguugucuuccaggccauuacccccccccacacacacacacacacaagaccugcuaacauuuccuaauguguuggugcuuacacagcucauaaggcucuuccuuuccacaaggaaucuauaaauaguuaauaauugcuggaagaggagcuggagagguggcucagcacuuuagagcacacacuccucuugcagaaguccugaauucaguucccagcacccauauuggacaacucacagcugccuguaacuuuagcaccagaggauuagacgcccucuucuggcuucuacuggcauugcacucagguacacauaucuacacagagauacaaauacacauacauuuugcuaggagagggagauuuuuuucuucuguaauguaacugccuauaaguucuacaacauauagcuaguaaguaacccuucacauauacuucuguaaguaaacucaggcuaauguguuuagucaagcuguuaccagucggaaucauuucuuuggacugucacugaugcccuauaugggugaauaaauauuuguucacagcuccccagaaaaaauuaugccauaaauucccagcccaggcuagcuuccauagagcuggaaggugcugugcagacugcuggagagaacaaguuauuaauggugcuguucugcuaugaacucugccagguaagguguguccacugguguaguagugguguggccguuauaggagcaaccaacaaccuuguaacuggauuuuaggcccacccuacaucaaagacucguaccuaguacuguaaaccuggccaaaaguccauggcuuuaggaggaccuacuacugcuacuuugcuaaauggguauggauagcaucaagccaccuccuaaacauuuauaugugugcccauagauuagugcuggucuucagccuuggucagagaagcuucggugugcuguggucaggaguaaaugugcagacuaaugacucgucagugugcugagaauaagugaccuuaaagagaaugucucuauaaccaccuccaagguucagaaaacauagcaggagaggggacagaaagaaugaagaagcuaaaggacggaaaggagugcugugacacguugucuucuggauaugacagggcuguuguugcggcaguaaaucuccaaccacaauaagccuucacaaaaacacacaacucaguuauaauauuuauaagcugcaugccuagauugggcagaucuaccacuacacuauucuauuccgcagcuaugcgaucccuuguuacuugcugcuucuccgggccaugcgguugugcuccaucuuccuuccaccuccucuuccuucaucuuccucuucccuccuucccucucuucuccuacucuccaaaaccuccagccccaccuuucccuuccagugcgcaaccacaggcuccagucuuuauuugaccaguuaaaauggggagaagguucacacgagaucaccugauccacuccucaugggggggggggaggcagccccucuugaggaagcagaauuaacaucagaguacaaacagcaccaggacaccccacagcauguuauccccaugagcucacagcagcagugacugccuaccuaaacccugcauaggauugaaugugccagaacccagcacaagugggaauguguccugagggaaaagugaggaugauuauaggagagguagaaaaaagacacagagacaagagauggguucuggaagguuguuagugaauaccaaagcagcccuguguuuauuuuucauagccuuuuuauccccccacaguaccgugggaagcaaagccacaagcuaacagaaacaauugcuggaguauacacaggacaucuguuguuauccagaggccucccuguuccuuccaccaaggucaacagaacguucagccccucgccuugagccucaagggcaccucuuucuauaguuccaagccucagcaggccaggaaaucugcgggcagacccugaccugccucgacucugccuggcaggcagacauuuuacucggaagcaagcaaagggcuccagacaaaauaaaaaaaacgaguccauccacaucucuucagggauggagggggggccuugagguugcacgcugcccugaggagcuguaggcagucggugcuugcugggagagaagaacucagacucuucagugauacagccacugggaaguucuucuuauuccaguaaauaauccucugcuggugcucaugcagacagcccuagggcugaagggaggaaauuacaggaaaguaggaagugucuaaucaggaagaaagguuucaguggggaggcgauaggagacagugggggggguggucauccagguacaugauacguguaugaaauugugaaagacucaaaaaaaccaauagagcucccaucaggcauagaagugcccuguaagugcuucagggccacuccaugucacauguuaccuagaaaaucggcagccgagcaguggucacguaugggacagaaagacucacagaacaaagaaccuucacauuauccaggcuagaccgacuggaaacagccauaauggagcgaagggagaccggcaguuaaaacagagaugggguucucguggagaggggggcacacacauccccaguucuaggacacagggcucacaugaccuguuuucuuguuuucagccuugucugaggugggguggcuaggaaaggucaaagggaacaagacgcucagcagagagaaagucccuggaauccagccccguuaacucaggcuggggagcacaccuccgacccucccuagcccaucagccucaggaacaacuaucuguuuccuuaaagaucugagcccguugaugcuuuauuuaauuauaaaagucauuuuccgcaaggaggcuuaauagaacaucugggauguuuuaaguaaagaacugacucacuuucuuaggcacaggacauguggcuccagagaccgugaugccggaggguggcugaacuaagaugcugugagcauugagugggcgagcugccucuccucugguucguguacuuuggggauuagguaccuugcuauuugcuagcuucauauccuauauaucaguaauguucuuuuauucucucucucucucucucucucucucucucucucucuaagacaaggauuucaauauguagcccugccuguccuggaacucaccauguagaacaagcuggucauaaacucauguaaauuuacccaccucucucucccagugauggugaaggcaugugcccccacacuucacuugcuguaguggcuaauacugauugucaaugaaucaacuaaauccugagcaucuaggaauagcugugaggaauucucuugguuggauuguuugggaugggaagccgcacucuaagccugggccgcacugucugguggcagcccuccuugaaggagauggaggaaggaagauuuuugcuuguccucacucucacugguaaguuuauccauccuguugugaaggcaguccuucucugauauuaggaccuauuucuaauaaauaucauauaugauuggucuuauuuaacaauuccauguguauauuauagacucugagcauaucccccacuguucucuuacccauucaacaucccaccccucuucccagagaagcccacuuccuccuacuuucaugucuguuuuucucuuuuauuccacugcauuuaauuaguguauaauguuuucauauauauaacauauauacacauguauauacacacauauauauauacauacauguauauauacuauauuuacacauauauauguguauauaauauguugugcauauauauguauauaauauauacacacauguauauauuacacuuauauguauauauaauauauauguacacacacacauauauauucauucuaucaguucugucccuucaaagaacccagacuaauacacagaguaauauucucacugucauauuauuuuaaucuguucaauaaauguauguauauacuuuaucauguuucacuaccauuugcuucuauguuucauauuagaauuuaauaucuauuacuuauuugugagagaguuuuuaauugugccuuuggacuuuugauucuucugcccaaacccccgaagugcuaggguuauagaggaaugccaccacaccccauuacagaauuuacuauucuuaaagcagcucacacacuuuacauagcacacuucucaagguguuuagucuugaacuaugucuuccagucucugcucuucuguaugccuaggccuguucuaauggcugugacaaauacccuuacuccagucucggucagugaccucucuucuauucucuggcucuuccucugaaaccuggaaggggcuucuuccagcugcauuggacauggcuguccuuggugcuaacaaccccucgccugcuccgagcagauuggcuuccugaccaguacagccggccuccacagggcagagacucacucgcugccgcccagagacuauuccaagcagagcaaaccagagcucagcacagaucucuccauucccaccugagucugcucauugccuacagggccagucaugccuuuugaggaagccccaggagguugugucugacucuggcugucuggcaaugcucaucuggagacuuccugaugcaauuaagucucuguguaagaucagcaaccucucacccacuucucagcuagaucuuuucuuccaacgaagugagaacacugggcuugcucuccucuccggccacaugcuuacuucugcuccuaucuccuacaagcaaaugcuucuauuuaacucagccaugcaaccuuuguugcaucuccgcuaugugccuggcauuacugucagccuaauugauucagcaguauugauucagacaaaaugccugaccucccacaccacuucuacugggggagguuuauaauugaaugucucacccaaaauguguauauugaacucuaauucccagugugaagguauuuggaauacaucucuggggguuauaaggguguggcccucauacagaagcuuagugccguucugagaagagcucagagauuuaacuagcucuuccaucauggguuggagaauaaucugcaaacagaagccggucaucaccagaccugcuuauggucagacccugaccccagaccagaagccucagagcuguaugguacaaguguuugcuuacuggcugggcagcaaucacuaagacagaaaagcacacaagaugccacauaaucuacaauguguagauugagggucgcuaaggcacaaauucuaaaucugaaaugcucgagaauucacugccuuugagcaucaauaggaugccucuagucugaugcuuugacaugcacaagcuuucuuacgccugcuguguguuacagcauacaccaaacacaaaugagguuuguguuuagacuugagcuccacaccgguaguaucucauuaggugcucaaagacauuccuaaaugugaaacucccugaaaucccaaaccuuguuugcauuuggauaaacagcuuucgcaugccaugacaagggaugguuacuaugccaggagaaagaauggagucuagagguuagcacuuugagccgcaaauuuaaagaggguagacagggaaggucucacuuagaagguaaauauacuugucagguuucugcagaggaacagaacuaauagaaugaaaauagauagaugauagauagauagauagauagauagauagauagauagauagauagauagauagauauacacacacauggaauuuguuagguuggcuuacaugauaccaucuaguaguccaaaaccagauguuuucauacuggaaagaauagccugcucauucauucaacggacugaaugcagucggacacuggaguccaggaggauuccugcagaaccacuggucuucaguccaugucaggagacugaagagcuggagucugauguuagagaaggagggcgacgauggcagaaguaaaguagaugcacucacaagcaagaggcacaggcaaguaggcaaaaggcuuuuccuucuuccucucuggcugccagcagaagguaccacucgcucuggggagggggaggggguccuccacucuguuaggugagcagcaccaccccauggaccagaguccuagacugaacaugaaggaggcagugagcugagcaccugaguucaucucucugugcuuccuggcuauggaggcagggcgaucagcugccucaccuuccugcugucaugccuccccucccccaccuucaugauagacugcagccucaaacugugagccccaacaaaccccucugucucugguuuuuuuuuuuuuuuuuuuuuuuuuuuccccaguugcugugacaaaauacccugcugaaagcaacuuagggguggaaggguuaguuuguguucacaauuccugauggcagcccaucacagcagucaagguggcagaacuaggggcugagugggggagggacggucacgggggugggguggggaauuggucaccgcaccaaugacccagagcaacagcaguagauucuuuaucuuagugcuuaacucaauuuugccacuguuuaaauguuuuccuucauuuuuauuggauguguuuggguguuuugccuacgugcaugucuguuugcuaugugcauguugucucugcgcaggccagaggagaauguuaaacauccugggacuggcguuacagacaguugugagccacuaucuugagugcugggaauccaaccuagggccccuagaauaguagucagcacuguuaacugccgagucaucucuccagcccugaguuucaacacuuacaaaguucaggguucccugccuaagaaguggugccuccacacugggugguucuucucaccuuaauuaacguagcaaaaauaauuccuuacagacgaguccucgggccaacgcaaucuagauaguugucuuaguuagggauuuacuguugugagcagacaccaugaccagggcaagucuuauaaaggaugacuuuuaacuggggcuggcuuacagguucagagguucaguccauuaucaucaaggcggggcaacauggcaguggccaggcaggcuuggugcaggcagagcugagaguucuacaucuucaucuucaggccgcuaguagaauacuggcuuccaggcagcuagggugagguccacacccacagugaccuacuccuacagggccacaccuucuaaucgugccacucucugggcugagcauagacacauuguaauaguccuccuugagacucccuuuccaggugacuauacuguguccacaaccaaaacuguuacaccuuccuuccuguugucccagcaagaaaauaaauaaucaauacagcaugaaaauguuguaacgaaaugcauugcuucaugugcuaucuaaacccuuuuugguaaaaagaguauuguccugauugcacugggaaacugcaguucagaacaggcggcuccagcccccaugcuugagaacacacagcugucucuuaacagagcucacacccaugcucaacuggcuucguuaguggucgccaucugauuaaaaugccuuucuccagagcugauguuggagauucaggcagaagauccagagagccaagccccggaagccucucucacugggaaggaugcccagggcuuccgacugugcccggugacugcugggcccucuacccuacggcugcccaaguuucugggcauguuuuccgcguugcuucuccuuguucuugagcucuuaguagucagaggcuguguaucuuuggcucuacugccuggccucggagccgcaguauggucuucguggguaagggguagguuuucugcgcccuccuggugagggcagugaagaaguaaggcaauauggagcgcuggcccguagcaggugccagucaacaguuagugcugguacccucugcgucuggguaauaaagggguccaucagaggugacaguccccugcuaccccuccaucuggccuugagagcccaagagggcacgcagagcucagggguaggggguguggugguggggcuuggaguugaguuggcuccuccaggccaucugaccauuuucuaucuuaucuuuuuucaagagauguaauaauuuaacaaccucggaaugagaaaagauagcugggagaguaaaugcugaauggcuuaaauuaaaauauaauugaaauaaauuaaauuaaacgggcaacuuuccggugcucaucucucaggccaaauuauugcggagucuucaagcugcagaggagcccuggugacagacucggugcuugcuguggcucccccugaggccagcagaggaggugaccggcagcccuagggagacugcaguuccuccuagguuggggacguucugggggacacagggagccagaggcucagggcuggcuauggcuaccucagccucucucauacuaugaagauccaagcaguuccagagaagccccagccccagggccuuggggaccuggcuuggaguguuacuugucagauuggucacugcaggacucagagguccccuaaggaacacacuauucuugaugcuuugguuuuucaagauuaaaauuagaguggagagucaaaacugcaggccuucucagcugcccagcuccccucagcccacagcaagccagauccccugcugggucggggguuaugagccucggguucucucagcugcccaccagguucccuuuggguccaaggcuggaagagaagaugcccgaagcacagccuuuuccuccacguuucagcuuugggugaaaaauucauaugcauuuugcauucugcaacaaaaugcaucccuguuuguuuuaaugugcaacguuuuccaauauuucccagugagcagaagugacaagccuggaggccaugcucuuuauccuuuaucuuccugggagcccuuggcauagggcuggcagcgccugccagagaaacaguuucaugcauggcccaggguccccucagcaacaccccaccacacacuucuccccacccaccccagccggauuccuagaaggaagaaggcagggaagccuccagucauggucgugaugagguggcugaaccuugacaucaugcugagccaagccaaaccaucacacaggguaugugcugugcaugucugccagccugguguacucacguuacucaaauucugagacccagaacaucggaaggcaguggcuaauggcuuuaagggacagagggauagggagguguuauuagacgcguucucacgaccggccaggaagaacacaacaaccagaaucuucuacggcaaagcuuuauugcuuacaucuuuaucgggccagaguguaagaagcaagagagcgcaagaagcaagagagagagaaaaacgaaaccccuucuauuuuaaagagaacaaccauugccuagggcgcaucacucccugauuggcugcagcccauggccgagcugacguucacgggaaaaacagaguacaaguggucguaaauacccuuggcucaugcgcagauuauuuguuuaccaacuuagaacacaggaugucagcgccaucuugugacggcgaaugugggggcggcuucccacaguucccccuuuuucuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccuugcaacucucucgggcugcugaagcacacucacucuaucucgugcaaugagacuagccucgugagauauaagagcugaguggccagcgaccuauugccuaagcauagauauaucaggggaagcuccauguucuaguccugcaagcgccugggcaauaaccaccuugucucuccuaguuugggccuuaagcuuacagaccaaucaaagaagcaacacuaauccacagcaacguguaucuccaaauaauauuaaucccacccaauuuuuuaaagaaagaaaaugcugaggagauccaauuggguaauccuuuggucagcgacagguccaagcgcguggaguugaccugaagucucaauucucgaaggaucuguaacauauacugaaaaagacuuuuugacaaauuagcugcccuaguaaauuuaacauacugaauggaaauaacacacaaucccggaaacuuuuguucacaucccugcugaguuauuugucauaauacaucuaguuguuucuggacaagaucuaugaguugauuaaccagcaugagaccucucuguaucuugacauuagcugaggccuguucaucuaugacuguagucacugaggcugacaaaguguuaauggugucagucaucuggaccuguccagacagaaccaaggcugucugaauuaaggccaaacccaguucccaguuagugguaaaaaagcaggagaauacuugagcauuauacaucaccgucauugggaguggaaaugucgacauuaucccccaacgcugcucucucuuuauuauugacgcccuggacaucaccaagacgagggacauuaguauucccuuggucagucuggauuuuucgggugagucuuucugguacccaaaauggguugucuucauucugugggaaaacacagauagcuccccuggaucuuaucaagauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccaaagacaccgacacucuuggugcucgggguacagucuccucaaaaguuccccucuucuguuuuauaagauaggcuuugagggugcgaugcgcacgcucaacaauacccuguccuugaggguuguauggaaguccagucagguggguuacguccaucugacggcagaacugcugaaauuuuugggacguauaagcugguccauuaucagucuuaaggagucuggguuucccccaagcacuccaugccucaagacaauguugaaucacaugugaggcuuuuucuccaguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucaaggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggagaucuucuagauaacaaaacuaauuguaucugcugaaaaauauuggcaacucuacuggaaggcuuaaucacuccagccacuucuaaaagauuuacugcauuuaccacauaauaggaaucugacacaauauuaagggguucuaaaaagguuuuuaaaacuucuaagaccacuaaacauucuaccacuugaggugaauuuucauuauauuguuuggauaccacuuuaccauuagccacauaggcaccuaugccaguuuuugauccaucaguauauaccacaaucccauuuuuaaguggguuucuuacuguuauuuguggaaacacaacagauugauuuugggcaaacuguaagauuggauguuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaaggcugcgaauccucaauacguuguaauugugcauucuguaaggccuuuuccacuuuuuguaaggccugguuagcagcuagaguaagaguccuaggggaggagauaugaggaucuccuucuaaaauacuaaacaaaggccuuaacucagcggaaggaaucuuuaaaaagggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguagaccccacugacuuaaaguuuuaaguagaaaaggauaugccuuuuguagcaugguaaggucuuuauggcacaggaggaugucauccauguaaaggagcaaaauuaaagaggggaacuguucccucauuggcaaaagagcuuuuugcacauaaagcuggcacauuguaggacuauuggacauccccugugguaagaccuuccauugauaccucuuaucagguuuagcagaauaagcucucugacccguuaacaaaucaaaaguccacucucucugcucuggaguuaaagcagcagcguuugcucgggccugcgccugugccgccuccugccacagagcucgccauuccacauauuuggccauacuagggagagcggcuuuugcaaucauuugccagucagcaggcguuagugccauaccagcgagccugucuaacuguaccaagguaaaauuagcauugguuccguauuuacgaaccgacucggcaauuuccuuaaucuguacguauucuaccggagcguggacacgcccacccucggcuccuucaaagacuggaaaugccuguucuauuuucuuuuguuccucucggggaaugaaugagucugcgcacugccucucugcgcacugccucucugcgcauugccccucugcgcauugcugacgcacuacgcagggcgggggcuccgcauagggcggaccuugaaaccgacugccgggagguugaacaguacgcugacuuucgccagccgcuuuuggcuuuuuucuugaccaauuagcuggcugguaaugggcugcuucuuccucccagucuguuuccucagaggaggauucuucacuugcuucagagcuacuaagagcuggcuuccugagcucaucuagugacgaguaucuccuagagaccuccgcuaaucgaucuuucuucuuuucccuuuuuccucuuuuucuucuaaucucucuccagguauucuuaccugaccuaaacuuuuccucggguucaagacccuuggaaaggccuguauacuuauuuuguguaccauacuuccucuuuguuccuacucuuucuucccgcuuuacuucugauagcuuguccugaauuuccucuagaauuuucagcccuaucuuaaucacuugauagcaugugaaaaagaacaaaagggcuccuaacaccagaaaaaauucaaggccaaacauacucacugguacucucguuccccagcugaaaaguucugaauucauacaguugaauccuucuuaacagucugcuuuacgggaaccuuuaucaccgucguuccccagcugaugaguucugaauucggcaguugaauccuucucaacagucuguguuacgggaaccuuuauaaacgugauccguaguucugcuucugaaaugaaguaucccuccugcgccaguccggaguuuuuucucgucccggaauucggcaccaauuguuauuagacgcguucucacgaccggccaggaagaacacaacaaccagaaucuucuacggcaaagcuuuauugcuuacaucuuuaucgggccagaguguaagaagcaagagagcgcaagaagcaagagagagagaaaaacgaaaccccuucuauuuuaaagagaacaaccauugccuagggcgcaucacucccugauuggcugcagcccauggccgagcugacguucacgggaaaaacagaguacaaguggucguaaauacccuuggcucaugcgcagauuauuuguuuaccaacuuagaacacaggaugucagcgccaucuugugacggcgaaugugggggcggcuucccacagggagggguuauguuuccuggauuucaguuuggaaagugaaaacaugguggguacugaagguagugaggucugcgaguguugcguccgcucucgaccagcaagaacgacacaacacggucggauucuucucaacagccuuuauugcaggaaggucucaaugcugcuacggggaccccgggcacccagggaggucugcuuauauacucucagccccccauccacucacagcaggccacaccaccucaccaggcacgcagcuucagccaaucaggguggcaggggcaugucuccaccaaauauggacuuguuuacaccgccagcaucauggagcaccugcgcagcucucacgauggucguggcuuauuuucagguguaugagaaagucaggugcaagucauaagacuuagcugcagucucggggggggggggggggaaucuugggacugcugccacacccgcuccucacaugcgagcagugaggguaugcugguuuguuuguugguuuuuguuuuuuuuuguuuuguuuuguuuauuagauauuuucuuuauuuacauuucaaauguuauccccuuuccuaguuuccccucagaaaauucccuaucccuucuccccuuccccugcucaccaacccacccacuccugcuuccuggcccugccauuccccuauacuggagcauagaaccuucacaggaccaagggccucuccucccauugaugacccacuaggccauccucugcuacauaugcagcuagagucaugagacccaucauguguuuucuuugauuggugguuuaguuccaaggagcucuggggguacagguugguucauauuguuccuccuauggggcuucaguccacuucagcucccuggguauuucucuggcuccuucauugggaacccagugcuccauccaauggauggcugugagcauccacuucuguauuugucaggcacuggcagagccucucaggagacagcuuuaucaggcuccugucagcaagcucuuauuggcauccacaauagugucugguuuuggugguuguuuauggaauggauccccaagugaggcagucucuggaugguccuucuucagucucugcuccgaacuuugucucuguaacucguuccauggguauuuuguucccucuucuaagagaggugcauuguucuucagcgggcugagcacagugauaggcuguucuucaggcuacaaaaccauccaaggaggggugucugggagaguuuggagggagaaaagagaaggguaaaauuauauaauuauaaucucaaguauaaaaauaaaccauuaaaccaucuacaaugguaaguuguauauuaugcaaaagaacagaaacuggaccgaugguuccccgguuaagggcacuuccagaggaccugcaugcauuucccagcauccauggcgaccaguucacaggcaccugugacuccagcucccgggcaucccacacccucucuggccuccucagcugccugcauaugcuuaggauacagucacgcagacacauacacauaaguaaagagaaggggguggugcaaacccggugaccuaaguucaaccuccagaaccauagcauaaccgacuccugcaaguuauccugcccuucacauacaugaguuacgcaugugcagauaacaauuaaaaauagauuuuuauuuaaaaaaaccaaaguuauuacauuaucuaaaaggcaaaaaaaaaaaaaaaaaaaaaaaaaaaggugauugaaggccaggucucuggguaaaaccaaacucuccuugcaagacaggaggggacauacuuuuccuagaaaacucugcccccucuucccagagagcaggcacauauggcccucuggccgcuggggucacaaccaacaucgaagcugagaggcauccuggaaaacaaccaccccaccugaguauuucagaguaggaaacgcgcacacaaggaagccagccuuccaagcugcauagccaggggcuggcacaaacggaugcuucuaaaggcugggcccggagcucuguuuggauggccuggccccuauuaagguccagagugggccaggcaaagccuucggcagagcaccguuuuuucuuaccuaaggcaccccucuucuaaaggggugcucaucacccugccugcuccccacucugcgaaggagcugguuaauuaauuaauccuuguuaagggcucaggaacaggcuaaugggcgccaggcauucucauuauuauuuuuaaucagacuuugcaauuuuauagcucccaucaccaagggcuaucgaguguuuuguggaguuaauuaagccugcgagggaugggcuccaaaggggggcugggguggggguaggggauucaggcugagcuguaggagagcccagaaguccugauucgucucaaaccccccccccccccccacacacacacacacuuuagagggagaggagagaugaguagcaggacaggacagcuaccgcuaagcucuggcaucauccgagugggcccccaagagggccgggaguggacaggaagggaaggcuauggggcucgcacugcagguucugccucucaucaggggcaggcuuccugcugaguagggaggagagcuagugguuagaaagaccugucaccaccccccaacacacacacacacaccuaaccucccuccgcugaggcguccuuucccuucaugccugcccccuccccacucccccccccccccuguauaguaucaaacaggaaauacuuucuggagcauccugugugugacaagccugaaacccaaacugaggauugaugcgguauaugggcuuagcacaaguugccuggcacugagacccuuacgucuccuuccucuccugagcucucagcacucccaguucugccuucugcuugcauucuuucuuccuuauccuuuuccuuuacccaaccccugccccaucccgccccccgcccccccccccccccccaaggcacuaggcuugggauccgggaauucuggguaggaucuccugagguccugaggcaagacaggaacuagcuuguucuggcuucuggccaggaugaacugcagggguucuggagcgcuagguugcggggaggggcguuccuguucaggccgcacaacccuuacacagggaggacuccagauccuccgccugccccugaccuccaagcccugcagucuucggaaugaagccuucaaguuggcaccagaucauucccagaaaccggaggcagagauggcaugacccacgcgggcugcaucccagaugcguuucuguggaggcaguggcagggaaacgcugucacugacuugggguguuuggaaagcggcagauaauugggaacuggcuauucacagaacucagggcacuaaugugaggccccgcagugaucauguuaauggagggcuugggaguuucugcugccagacacccuggugacugcuguagaauuuuggcagacagaaggcaaaggacgcacuguggaaaucacuagagcguagagaagccggcucccacagcguuccccagcagcuguaugugagccuuggagcguguguucucccaggcaaggucucugugcacccuucuucaaaucccugccucuccaguaagggaacccaagaagcagccuggagaaauggauucauccguaaagugcuuguccugcccuggcccagcucaaaaaauaaaguggagagcagccgaggaagagaucuuugaugagcacacaugugugcgcacaagcacgcgcacauacacaaacauguacacacaauaaauauauacauuacacagaacgcauauacacauaaagagauuugcugaaaacuggagcaggugaggacugugugugguuuauuauuagacaucggguuaggcacgcuaaacugugagcaauauguagaccacaccaauauaaauaucuaauaauuuuauuauccgauguuugaguuccuuuuaauuaccaaacgcucagcaguacucuuguguuuucuuucaguuacuugaaauuaaucaugguccgaaaauaucaaauggaaaauucuagaaaugaacaaguuagagcugucgagauaacccagugaguggcaaguccauucaaugcccaagacugagcacgagggaugaagagaagcaacauuccugugaccucucuaugcuugcucuauguggcaugccuaugccacaccauaggaaacaaacagacuguacacuaaaaauaauuuacaugauuuaaauucuguaucaucuugagcaacgguaugaucaaauuucaagacgccugcuguauguugucugugauagaaaccccacuuucuguucggugugcccaccccuuacauacuaugguaggacuaucacucagcucuugucuugagacugaaugaagggccuggugcucagugcuaacguaacaauggcccaggagugauaauaggacugagacauguguuccauagggaagcugcagguguaagaagauacugagaagcagaaaacuacauucauacaaguuuaauugccacaagccuucgugauuuuuuuuuuuuauaauaguaguucuuaguuucauccuggaccuaauuuauaaauuaaaauugaucauuguacgcggauagaaggagaaauguagugcaauauguuuaaggguuaagauacuccccaugguuucagacaccacuugaggucuugggcagaucccuuauugauaagagagaacugauagaucaauacuuagauuguauugaaagugggacugguuucaauggcccagagaguaaaggcacucaucaccaagccugaugaccuaaauuugauucccaagacccauuaggaagaaggagagaacugacuccaguaaguuacacacacacacacacaugcacacaaucacacacacaauacauacauacauacauacauacauacauaaaacuuuuaaaauggcuaacuaaagggcuggagggauaguuccgugauuaagagugcuuacugcucuuucagaggaccagaguuuggcucucagcaccugucuugguuagggauuuauugcugugaacagaaaccaugaccaaggcaacucuuauaaggaugacauuuaauuggggcuggguuacaggcucagaaguucaguccauuaucaucaugacaggaacauggcagcauucaggcaggcauggugcaggaggagcugagaguucuacaucuucauagaaggcugcuaggggagacuagcuuccaggcaucuaggaugagggucugaagcccacacccacagugacacacccacuccaacaagaucacaccuccaaauagugccacucccugggccaagcauauccaacccaucauagcacccauguuaggcaccucucaacaacugauaacuccagcucugugggaucagaugccaccuggccucuggccuaugggaaccuggugcacauaugugcacagagaaauucauaacaaucacaaauaauaaaauaaacauuuaaaggacuaaauagcuauaauaauuagcaaaccuuauuuuuagauuaucaaaaauauauccaugcacaucaccuuuucuuuauccucugagauagcugcuauuacaauuguuguggguuuuucaaaacaacaacaacaacacccuuuuaaucccuucuagaaggcccaggucugaucaaagcacccacagggauagcaaccaucuauaacgccaguuccaaggguuguggcacugcacaagcuucgaugcagacaaaacaacuaagaauacacauagaaauaaauaaaaguaucuuaacga

SEQ ID NO: 2865 - RNA, 3626 nt, Mus musculus
ucucuaaucgcccccuccccaccuccuucuccagauggaaagaggagcuccuagcucacuuaagccgggguaaggcugguucucuuuuccaagccaaaaucccaggcgauggugaauuaugaacgugccacaccaugaagcucuuguggcagguaacugugcaccacaccuggaaugccguccugcuucccgucgucuaccucacggcgcaaguguggauucugugugcagccaucgcugcugccgcuucagccgggccccaaaacugccccuccgucuguuccugcaguaaccaguucagcaagguggugugcacccgccggggacucucugaggucccacaggguauuccuuccaacacccgguaucucaaccucauggaaaacaacauccagaugauucaggccgacaccuucaggcaccuccaucaccuggagguccugcagcugggcaggaacuccaucaggcagauagaggugggggccuucaauggccucgccagucucaacacucuggaacuguucgacaacuggcugacagucauccccaguggggccuuugaguaccuguccaaacugcgggagcucuggcugcgaaacaaucccauugagagcaucccuucuuaugccuucaaccgggugcccucccucaugcgucuggacuugggggaacucaagaagcuggaguauaucucugagggggcuuuugaggggcuguucaaccucaaguaccugaacuugggcaugugcaacauuaaggauaugcccaaucuuacaccccugguggggcucgaggagcuugagaugucagggaaccacuuuccugagaucaggccuggguccuuccauggccuaagcucccucaaaaaacugugggugaugaacucacaggucagccugauugagcggaaugcuuuugacggacuggcuucccucguggaacucaacuuagcccacaauaaccucucaucuuugccccaugaccucuucacaccccugagauaccugguggaguugcaccuacaccacaauccuuggaacugugauugugauauucuguggcuggcuugguggcuucgggaguauaucccaaccaauuccaccugcuguggccgcugucaugcucccaugcacaugcgaggccgcuaccugguagagguggaccaggcugccuuucagugcucugccccuuucaucauggaugcaccccgggaccucaauaucucugaggaucggauggcagaacugaagugucggacucccccuauguccucugugaagugguugcugcccaaugggacagugcucagccacgccucccggcauccccggaucucuguucucaaugauggcaccuugaacuuuucucgugugcugcucauagacacuggaguauacacaugcauggugaccaauguggcaggcaacuccaaugccucggccuaccucaaugugagcucggccgagcucaacacccccaacuucagcuucuucaccacuguaacaguggaaaccacagagauaucaccugaggacauaacacggaaguacaagccuguucccaccacauccacugguuaccagccggcauauaccaccucuaccacggugcucauucagaccacccgugugcccaagcaggugccaguacccuccacagauaccacugacaagaugcagaccagccuggaugaagucaugaagaccaccaagaucaucauuggcugcuuuguggcagugacucuccuagcugcugccauguugauugucuucuauaaacuucgcaagcggcaccagcagcggaguacagucacagcugccaggacaguagagauuauccagguggaugaagacaucccagcagcagcaccugcagcagcaacagcagcuccguccgguguaucaggugagggggcaguaguguugcccacaauacaugaccauauuaacuacaacaccuacaaaccagcacauggggcccacuggacagaaaacagccuggggaacucucugcaccccacagucaccacuaucucugaaccuuauauaauucagacccauaccaaggacaagguacaggaaacucaaauaugacucccccucccucaaaaacuuauaaaaugcaauagaaugcacaaaaaagagcaacuuuuguacagaguggggagagacuuuuucuuguauaugcuuauauauuaaaucuaugggcugguuaaaaaagauuauauuaaaauuuaaaaacaaaaaaaugaaaacaaaacuauuuucuaacuuguaaguucuauuuaaaggggagggaagggguucuuggcaauguuguggguaggagccucaagucaacugcuguaagguggaaacugcuaagacaaaacaaacuaaaacaaccaacaccccuaaaguggcagggugugggcugcugggggcagggaggauagccugcaucugucaauuuuuagaagaugcuuuacaggaucuaggaauaccauuucuauagacaccuuucuuaagcugagagcugucuuuacagaucuaucuuauuaaacaaaauaauuuuaaaaagcaucacaaauuuguacugugcccaaagguugagcggugauuuuuuuuccccuacagagacaauggggaagauagaucuguaaauguauuuuaaguaggaaaaccaccaaaauuccaacuaauccuuccagagguuguuucuuuguacgugugcgcaaauccucuggguuugugccuucagacuggcaugugucuccccugacaaugcuucaagacagcuuggaaggaagggagcuggcguagcucuccaucaaaugcuuucacauugcaccagauuccugcaguugggcauaacccacucugcaaggcaugugucuauucaggguuucccgggaggaggaggcggccugaagggggugcggccggcccaggaggaagggaagcagagcagcagcagcagagggaaugauucacaggaggccauaaaucagcauugugcaguggccaccuguuguuccggguaucugacaaaugauuguagacaaugaugacauuuuaugauuuuucaaaaaagaucuugcuuguuuugagguggaaaggaggauaggcugggaauggggggaacuugggggaguggaagcuuuucucuugcuuaggauuuggugacuauucuaaaugcugauucauuagggauuauugcagcugaugccaacuaguuguggugauagagugagugggggcagaacaugaguagagaggggaaggagagcuaaaaagggcacaggcucaauuuaaagaagccuucgccaaccaggauguuacaagaacacugacaaggggaacacacaaaugaguugggcaugaaauucuguugaaugggcaccauugggggaagcuucccuccccuaggcuaccuccaguaguuacaagcaagggcaaggucucuuauucugguccauuuaaugauguaacuuucaguuauuauuuuagcuuuaagagaaaauuaaggguucagauuugaaagggggugguaugggugggagaugccaacaaaagaacacugauuguaaugugagaaaaguguauuuuuguauuuuaauaaauauuguucaauuuuuaauucaaugu

SEQ ID NO: 2866 - RNA, 41882 nt, Mus musculus
cagaaaaaaacuuauugaacacccacucuaugucagaugagggcaggcuuagggggaaaaugacuucugccugcuuuggugaauuuggggucgaguuccuaaaugaaagauuuuaagagaauuuuaagcuguugaugucaaguuucccccaguggcgggggcggugcugggacugcacagagaccgucguucaagaagcuccgcccccaggacgucauuuuucuuuuucuuuccggaacuauuccuuccagucugcguuuccucccggacucuuuugagcaaagaggacuuccugaauuucccggcaacucggcaccgccuuccugccagagcucaucccagcccucgcucgcgccggcgugaggugcucgcagccucacgcgcuugucucucggucucauggccggucugacuuuauucgugggccgucucccgcccucggcucgcagcgaucagcuggaagagcuguucagucagguggguccggugaagcagugcuucguggugacagagaaagguaaggagugggauggugcagagggcaugugcaaagguaugggaacaacccaauuucagggagcucuauaguuaugaucuguuuguuuugagacagggcucucacucuuuagcccuaacuggccucggauucgcuaccgguagcccgugugcuucugccuccugaauccuccgauuaaugacgugagccaucccagcaaguucuuugcucucuccagaaguacgggaccgggagcuaagauucuuuucuaaacggacucagcuggagaucggccaauaagguugauuuaugaaaggcaaagcacucacuuaacguuuccauugcguuuuccccuuuauuacgcguguucaggaguucaaacgcaggcccauuagcuuggaguaaugguaguaaucccagcaucugggaaggcuguggcaggaggauugcugguaauucgaggacagccaggucuauauaauagcgaguucaggacaacuuggauuacauagcgagaccccgucuucaacaaacaucccaaaguaacguuuaauaaagcaccagugcggcuuauugagauggcugcuaggccggaagagugcuuaguuugacauggguuaacuuacuuaauguucucaacaaucuuauaggacaaagagccuuaaccccauuuuuuuuaaauaaaggaauauaaucuuuaaagacauuaaauggucuggaguugaucuggcuagugagaggacucaguuugauuagcacguuagcacauccuaugcauucaucuguuuauuuauuuauuacuuguuggaugccaacuguauuuuagaacauugcuggcugcccuuaggauacaacaggugugugacacuaaaucacugacgcagauucuguucucauacacuuaugguuugaaagacagccaacaaauagccaaacuauauguugauaauggugauaaauuuaugcuaaggagaaaagucaaaagagggaauguguguguguagauaggguggcuagggaagaccuguuugaggagagugaacuaagaacuggggggauaaaacagucugaauucaggaaacagcaaccuugaggauauuaaagcaaguauguccuugugugagaagagagcuugguggccagggugacgaggaagugaaugaaggugugacaggagauucgaucacacugaguccucagauugugguguuuacuagaaaauccuauuucuaguuguguggcucagcuucagcacacaccuuuaaucccaaacaauuguagaaggaagcacccauguuugaaaguaauaucuaauugagagacagauaaaaugaaagacuuggcagaagaauaaauuauguccaacuuucacgaguacaucgagaagagaucucaggacccacuucaaccugauagacagaaagaaccaacuccuaccagauuuuucccauacuuuugcacacacauaaguaaauaaauguuacaacacuaauguugugccaggaguggugguaucugacuguaaucccagcacuuaguaaguggaggcaggaggaucaggaaguugaggccuacuuggguuauauaagacguuguccucaaaagacaaaacaagaaagaaacauucauuuaaaaggacauuaaugccgggcgugguggugcaugccuuuaaucccagcacucgggaggcagaggcagguggauuucuguguucuuggucuaaauccuuacagucucucauaccccuuuuaagaaaauguaugagcuuccuauccaggcaagugagauguacuagaaacaacuguugcacuccuguguagaggagagguggguguuuuauaaugggguuagcauggcacuuagaauugugagggucugaauguguguggcaguucuucguggagacacaguuacuguuuugccuuuauuugggcacuaaccucacagaugagcagcuauauuuuuauuguacuuauggagaaguggggagggucuuuuuuuguuuguucguuuuuuucuuauuucuugaaagaugagugauaggcuuuugugagaggaaguucuaagagaaaagaaaccaaucuucacguguuauguguaguuuuaaaaaaacacauuacugccuugcccaggagcugccaccccuuggcccuuccuggcucgcuuuugucucuccuggcuuagcucuaggaucugcacugccagcacuuaccuggcuucucuuucuuacccaccuuugcuccuggaggaguugaguuaucagcccacucccgagacccuugaauccguggauaaaagacacacacacuguuccguuaccuuuauaacuugcaucuaggcacaauuguugggcgcagauaccuccugccuggaaauaugugcccuuuucauuuaucaucucugucucuccuucacccuaaacuuaguggcuugcaucagcuagcccccaccaacauccuuggccccugcccauugcauaggcugcaggcccuagcugccucuagaccuuacaucaugacugcuguuuucuucuuguuccaaagcaugacagaaaagcccuucucucuuucccugugucuccuuuuccucuugggacccagaugucccaccuguaccuuuauccaguaauugcccuuaccccucccuccuccccucccccacaaccccggccuucuuuauugacaagucaagaaccaauuggguuuugacaagucaagaaccaauuggggagcaggaccuuagugacaguaccuccccuaacauucauaucaucauuuguuuucuggugucaugugucagccaugcaaccaguuuauacaaaugacuacccugugcuauaacacauguccucuggaggagauuuaaauggauuugaaagggaaguggaguauaagguuucuucuucaggccauggguagacaucuccauugguguguguguguguguguguguauguguguguauacaugcacgcgcgcgcaagaaauuacaguuuuacuauuaaucccccucuuuuaaaaauuaauuucuugggcugaagagauggcucagcaguuaagaacacugacugagggcuggagagauggcucagcgguuaagagcccugacugcucuucaagagguccugaguucaauucccagcaaccacauggugucucacaaccaucuguaaugagaucagaugcccucuucuggugugucugaugacagcuacaguguauucacauacauaaaauaaauaaauaauucuuaaaaaaaaaaaaaaaaaaaaaaaagaacacugacugcucuuucagaggucccaaauucaauucccagaaaccacaugguggaucacaaccaucuauaauaggauucaaugcucucuucuggugugucugaaaacagcuacaguauacucauauacauaaaauaaauaaauuuuaaaaauuuuaauuucuuaauuugauguccauggguguuuugccugugcaccguguguggugcucuggugcccugcugaccuuggaggccagaagaggucauuggguccccugggaacuguaguuacagaugguuguaggccaccauuuagguauugggaauggagccccgguccuguagaagaggaguuaguacuuuuaaccacugagccaccucuccagccccuuagcuuaguucuuagcacuguuuugacauucauuuauuuuucucuaucucaaauuauuccuuggaacaaagggauagucauacuuguuuuaccuagcuuggaguguucugaagcuaaaaugaggccagggauuuauaccuucuuuggaaauauuuaauuugguacugaaaugcccagguguugaugguaugauagaaacaacaccuagggauuucuaaaccagggucuauuuauuuauguaucuuuugagguucuuuuuucagccuuccucgcugcugauguuuucuaagagaagacugucuuaucaucuggguuuccagaucuaccacauguaauguccucuccuuucuggugcucuuucguuguuacauguugaauucuuuugugaaagccuaguguguaucaugagugcaccauagucuuaagauugacagggcugggguaagaagaggcgauaacagggacauugaaguggaagcaagaggaagauuaaugguccuccaagugaggaaggagcuuccgauggaggcucuuaucuccggggcggcucacuggguggcuggguagaacacaggcuggcuuagucuuugaugacuugguucagugcucgugacuuggaagccucuguccuuucacuccaguucccugccuuugugccuuguucuagggaguaaggcaugccgaggcuuuggcuacgugacuuucuccaugcuggaagauguucagagggcccucaaggagaucacuaccuuugaagguuguaagaucgaugugacuguugccaagaaaaaacugaggaacaaguccaaggaaacgagaaaaaauggugaguuucuaguaauucugcaaggguuaggaagacacugaaaauuccagaagauccgagagcugggagagagucuccggaacuugaguucccuaguuuucuuuuuguugccaaaacuccucuggugugcuuugaauaggcaggcaucugcuugcaucucugucugcaaagucugguucuuggauauuucaugcucaaggcaaaugcugucuguauugguaccuucuucauuuaugucuggccuagaaauggguugcaaacuuaucccaugucucucgcuuuuuagaaaaugcagaguccccaaagaaggagccaaagcacaaaaaagccaaaguggcagauaagaaagccagauuaauuauccggaaccucagcuuuaaggugagugauggaacgaaguguguguuguaaaggaugcuggaaccagggcgugcucagugguagaacuccaccgagaaugggcaauauucuacuggggaauaaacccuugccugcugaguuggaaaauggaccuguucaugaagggcucagcggugaaagguucugcugucaacccuucugaucugaguuugaucccuagcucccacgugguagaagaauacugaccauugcauguuguucucugauuuccaggcacgugagcaugaguuguccccccuacccaauaaaauaaauagauagauagauagauagauagauuaaagaaauuacuaaauuucaugaagugugaagcuggaugcuuuccuuuggaagaagcuacuacugagacaaggaccugcguguucagccccucucuccuucccuuuuugagugagacagaucauguacaucucaaacuuucuagccaaggcuagccuuuuaaccugacuauauccugagugcugagaugacagcugugaaacaccaugucuggcuuuuuucccuuuuuuuuugacuucuuagauacaaaguaagcugucaucuguucacaguuguuugcuguucuaaucgugaaagcuuagcagaaaggaaugaaaggauacagaugcacugcagaagaugaacgcagcagcugcuauuucucaugucuccucugugguaauagucucuuuuuccuuuucuccuucugucuuaguguucagaagaugacuugaaagcgguauuuacucacuauggaacuguucuugaagugaauaucccaaagaagccagguacuugugcaucuccauuuaaugaagagaacuggagauuuguuuuuguuguuguuguguuuguuuuuguuuguuuucaagacaguaucauugacuguccuggaacucagucuguagaccaggcuggccucaaauuuacagaaaucugacugcccccucuuuccaagugcugggauuaaaggcacgugccaccguaguccugcuugauaaagacaaauuaaugugacuuuucccauauuauugaauuggaaauaaauuguuugcuauggucuuuuuggcccuagacaauaugaucuuugcagauugccuggcauaguacuugacaagcggggaagcccgggcgcuagcauuacucccuuggagacauuuuucaagagcugggacucagauuugcacuaguuuccucuggcuuugccgcacugcuuuccuaaggcuggaguuagaggagauaguaacugcugcguuagggcagggaucuccuggcugauuggcagacuggggccuagcuugucagccugaguuacuacagucuuguucugugccacccacugcugccucuaaccuucuugcacacuuguucacagauggaaagaugcgugguuuugcuuuuguucaguucaaaaaccuccuugaagcaggaaaagcucucaaaggcgcgaauaugaaggagauaaaagguagggcuucuacacucgcaccaugaccuuguuauuucuggugcuugagugaauuagcacaguaaccacauuuuuugguaugugugaaagauguuucugcugcuuagaaucucauugcuaaaauacuagcucguguagcccaggguagccuggaguuuccuaaguagccaaggauggccuugaauaucugaucuuucugccaccuucuaguccuggaaccacaacacuacaauuuuuggugaaaauuucuaguauuuaaucuuaggcuaaacuugaaaggucucaugacaggagcccuuucuucauuuggaguauccuggacaaagcugcuaauaagugcauauuaauucuuacauuccucuuuucugguugggccacuauucaucaauacccaugggcugauggaagaagggucagcuuaguucuuuccuaacuugagcaagauuuccauugauuuuugaaguauuuuuaaauacucaucuuuuaaaaaaagauuuucuuauuuuuauguacauuagugcauguguaccugcaggccagaagagggcaucagaucugguugugagccaccauguaguugcuaggaauugaacucaggaccucuggaagaacagacaaugcucuuaaccgcugagccaucuugcuggccccacauuuacaacuuuaucucauauuaucuaauguaugguggcuguguaaaaaaguggacuuucuguuguuaaaaggucaagaauuaaagagagcaacugggaggauuuuuaguuuuguauuuguuuuguaacagugucuugcaagaugguccagguugaucuggaacucaagaucuucuggccucucuucucuuuaagaaccaauaguugggcuggagaggugguucagugauuaaaagcuaagcucacagccaagagagccaauaaucucagagguggcauuucucugucuccaccaauauguuauugucuuucggugggugggaaguugggguauuagaggaagagagagucucugauuccaccucucuguuggacaggacggacuguggcuguggauugggcuguggcaaaggacaaauacaaagaugcccagcaugcuucugccccaggugagagguguugcuucugcaccaggugagagguguugguucugccccaggugagagguguugcuucugccccaggugagagguguugcuucugcaccagguaggaggguugugagggcaaaaaacuccuguaguuuuuuuguuuuguuuuguuuuuguuuuuuuugagacaggguuucuguacauaguucuggcucuccuggaauuugcuauguagaccaguuuggcuucaaacucccagagaucugccugccucugccuuccaaauaaugggauuaaagcugugugccaccaugcccaacaguuguuguguuuugauaaaaguauaucgaaacuuuccugucauagucuauaaugggaauguugggcuggagauacccagggcauagauuagucccucccacuccccccacuuaaaaaaaaaagcauccugggaaaucuccagauuucuguaggcucagcaaugcuugucaauugacguuggauugccuggugaucugaucgcugaacaucggcucuuuugagucuaaacucacuucugagguaugagugagaaggccuuaguucauuucccucacucuguucuuaccucauacuaaugaccacugagaagagagggcaggacuggaggacucgucaguuaagaacacugcuuucucuucuagggggucugaguucaguccccagcacccacacggcagcucacaaacaucuguaacuccagucccaggggaucugacaccuucugccuucugagggccugugugcucacgguacauagauacauuugcagacagagcacuuuuauaugcauaaaguaauaaauuuuuaaauuaaaauaaagagagagagagaaaccacugccauuaugucaccagagucucagagacuaucucacaucaaagcuaagguucauggaggccagagugagcggugugcuugcugugguguguaagugcuggucucugaagaguuuuggucgcuguuucucucauucuggagcgaguuaaccuucauucaggcuucugaggaggacgagaagaagaggaaucuauucuagguggugacagcuuuggguuuuuuguuuuguuuucuuuuauuuuuacugauauuguuugcugucauuuuuuggugucuguuaggaauugagccguagacgacucagaugcccaaacccucaggugcucaacucuccccuagaauugaugugauauaucugucuuaggguuccagugccgugaugagucacaugaccauggcaacucuuauaaagaaaaacauuucauugaggcuggcuuacaguuucagagguuugguccauuauuaucauggcgggaagcuggcagcguguaggcagccauggugcuggagaaggagcugacgagcccuacauccugaucagcaggcaauaggaagagaacugguuugagcuucugagcccucaaagcccacccccccagugacacacuucaagaaagccacaccuacuccaacaaggccacacauccuugaguccccuauggggaccauuuuuuuuaaaccacaccugcuguauaucuuaaauucucacuagauuauuugaaaaccuaauaucauacaaagcuacauaauaguuguuauucugaauuguccagagaauauugacaaaaauuuagauauucaguauggauacaguauuuuuaaaagaccguuuuuggucugugguuaguugaaucugaguauguagaacugauagaaaugaaagucugauuguauaggaagaaaaacuaggaaaucuugaaaaaccaaagaaacuagguacuugaauuauuaguuacuccucuuaaaauaaucuuguuuuagacaauacgugauuuccugucuuuauccuccccauagguguaaagaagagcagugaccggaagccuaaggaaucagguaagaagaacugcaggguggaagaacaaguagaagauagugaugaugaagaagaugaugauagccaugaugacgaagaagaaagagaaucaacaauagcuucuccugugagugugcacaagagguaugugcacauucugagaacuagggaagaccgcauuucuccucuugccuucacugcgaacuuggcccauguaagaaagcucagccgcuuacauaucagccccgaugaugagauccgaacugugcuguugcagagcagucaagagagcagcucccgaggaaagcaucgaggaagacgacuccuacgaggacagugaccuggaggaaggaggcagcuccuaugaugaggggacaguggacagugagagcagcgcugaagaucaagaggaugaagguuugcugguaucuuccuaaacaccguccagcuuugaauaaauuaacgagaaguggacaccagcucugcccaggcuucuugcaaauaguuucuaucaaauuuuuaacuacugaacagacaaccuucauuuucauuuuuuuuuucuaaugcuuuucuuccugucucugucccucuauccgcuuuccccuccccuucucuuuugaguccggggucucacauagcccaggcugacauuggcuguguagagaaugaacgugaccuucugauccccugccugugccuccuugguggcuuauguggugcagggaucuaacauacagcacaggcacugcugacuggcugugucuccgcuucccucugcccccuuuuuugagccaggucuccgauagcccaggcuggccucaacucaguauguaguauguagaaugcccuugauugaaccagucccugcugccuucaaugcgcucuaaccccagagccgggauccccggugugcacugcuguauccgcgucauguggcacuggggcuggaaccccggcugcaugcgugcugggcagucauuucccaccugggccacaaucggagaccuuuuguuucuuuauuguuugcuuuguuuuaaagaugaguuugaaaugauugagaauuuaucguuuuccuuagagaauuuaaaaccuagccuuaauauugaggguguuaccacuuuugucuaaguugaauaacuagauaaacaggauauaauacauguuuauauacuaaauaggcuuuuuaaaaacaaaacauaacaaaacaaaaacaaaccuuuugaguugauacguagauaaaauaaguuaaaaaaaaaaccuaaacaguucugaguuugagaugagguaaagaauuauaaauucagcacgggcuuccagaacacaauccuacagacuaguggcucgaauaagacagguuuauuuucuuauacuucuggaggcuaccuguuucugccuagaaugcugaccugcucacugucugcagauagcuuuaccaacguguggggucaaggagagcaaaacaaagcaaaucaaacaaaaaccccaaaacuccggucuugcuuccuccuuaauaaggaaacucguccuguagaguaaggcucugcccuguacaacuccacuuaccccugauuaccucucugaggucuccucaaauauaaugacucuaggaguuacaggguuacugugugaguuuuggagaggcacaguucaguucauaaccaggacuucugggagcaucuguagagcuaugaccagguccacguugcucccuuuauuaaggacaaguaaggcaggacaugauacagugcgaaacggccgagaguugauucccagggcauggggguuuuuauucagcuguuuugccuguauuucuguaagccugguguuuugguuuggccacagaagagacggaaaaucagcuuuuccguuccugaggauggagucaaggcuuucacacugaggacacaaugaaaccuacgacuuggauucaucugccuccugucauuuucuuuuuugaaucugaaaacuuagugggacucggauaagaaguuaaaaaauauaguacaaaggagcuuaauguagaaaccacaaguucuucaccagcccacaguucuccaaaguaaccucuuuuuuuccccagaaauuugucuguacacacauggcauagaagugguuuucuuaguuuucauuuugaagggucucacagugaaguccgugcuggacuugggcuugagaucuucauaccuuggugucucaagugcuggggcuccaagcaugaaccaccacaccuacuguaauguuuauucuucaagaagugaguuuccucuucauccagauuguuaacgucuuagaccauauucccagagacaaucacuaucauguuucuuguaugccuagagaacauuuuaacacauuuauaagcagaaacacacauacaugcaauuauaauauaaugugugugugcaugugugugcacaugugugaauguggccacagcaauauauggaaauuuuuuuuuccacaccaguaccacacuggauuauauugguguuuuguuuugccgacuuaaguaaaaaguaguauuuuuuuucuuaaacuaugccccuuccucucccuuucucucucucucuugaacccguguccuuauuuauguuaaaugcacauucuaccacugagcuacagccucagccccucugcuuugcucugcuuuaaauauuuuaauauaucuagucauuacacucuuaguccauuuaaacauuaaaaaaaaaauuauauggaauauuuaagaaguuacccuuugccauaugacuugcauuugucuuugaguuuuuuguuuuguuuguuuuguuuuguuuuuuuauuguuguuuacauuagauguuccagucucagagaaaaagaagaggaaguuacccucggaugugacggaagggaaaacugucuucaucagguaugcucgccuaauacaaagcuauguguccccuucacagguuccuugcugaccucgccuucccucacuugcaugccucuccuuuccccucucccccaccuuccucugucucucccucuuuuccucucuccuuuccagagcacuagaguuagaugcacaucugggggacacacgagugagaagugucagagcaagagcucaagugggggaagggcuguguuagggaaguagacugacagggcuggagagauggcucagugguuaagggcacugauugaucuuccagagggcccagguuuaauucccagcacccacgaaaaaggauacaacugaaaggauugguacuugucuagagucuguuugagaguucuugagaggagccagggaaauuuccauuggccgucugagguuaauuagagaaccacuguaagcagggucuuacuguguuggggagaacauaauuugagaggcuuuuguuccauuagaauagccuuuccuaggguguucagggggguucugaaauugaaauauuuuagggaauauuuuacagaugauuggggaggcucuugacacauggugagagggacggucuguuacaagguuugagguugguguggaaagguugagggaauuuggcuuugguuccuggguugaacuuggaugugauagggacaaguggucaguagugggggugaagcauuggcagcuggagugucgguggcgagagggacuguggcuaacagagggcuuuggagagaggagcagagaaaguagugggcagcacugaaggaggaucaguaggguuuaggggagcacuuguuggauuaccuugacccaagugagggcuuggccacugagcgugugugucagagaagagauggcugcggcuuuaguuauaucuuguaauugggagugugggauuuguucagaguguuuuugaugucugcggacaucucgacagcuaaugaauuuaggggagucagcuggcagugauauugggcaaucauuuaggcagaagaaaaguaggagugugagaagcaagaugagaugugugaggagcggaugaucaggagagaacaggauggagggugaggauggauucacaagacaggggcaagggagcauccuggacugaaggaggguuaggcaugucuggguuauguagucggggagccugcagggaaauggaacgagucauaaaaguggggcagcggcuugguaggcugcaagguagggguugagagagagauagguggggugggaggaagaaaguccagaaguggcaagguauagggaguguauccagugugaguauucaggcauccaugaguggagaacaugagguuagcgauaaggaguggagaugggcaaggggguuuacagugagguguccaugguugccaugacaagagagaacccaagauaggugacuuggagaggugagcuuuggaaggugagucagucaccucuggagcugaggaaacugaggagugagguggugucuuaggauuuuauuacugugaacagacaccauaacuagggcaacuuuuuuuuuuuuuuuuuuuuuuuuuuugguuuuugguuuuugguguuuugagacaggguuucucuguguagcccuggcuguccuggaacucacucuguagaccaggcuggccucgaacucagaaauccaccugccucugccucccgagugcugggauuaaaggcgugcgccaccacugcccggcuaaagcaacucuuaaaaggacaacauuuaauuggggcuggcuuacagauucagagguucaguccauuuucaucaaggugggagcauggcagcauauaggcaggaguuaagcuaagaguucuauaucuucaucugaaggcugcuagcagaauacugacuuucaggcagcuaggacuauaguauuaaagcguaugcucacagugacacaccuccaacaaggccacaccuccaaauggccacucacugggcagagcauauacaaacuaucacauuccucucucugacccccauaagcuugguuuaaaaacacaugagucuauggggacuauaccuagcuauagcauaauaaaaaaaguacaguuagucuaaauuccaaccaaagucuccacagucuauagcagucucaacaauguuaaaaguccaaaguucaaagucucuucuuugaugcauccagucacuuaacuguauuccccaaagcaagacaggaaaccagcuggccaaacucuaaacaucuccauggcugaugucaaaguggucuucagaucuccaacuccauuuucaucuuuguugacugcaaacuucuuuuuuccugggcugguccacucccuguuagcagcauuccucagcagauaccuuauggcucuggcaucucaaaaaucuuggcaucuccuaggcaacuucaauguuacagcuucuuguuucaauaccugggauccacacaugaucuucuaggcuccuccaaaggacuugcuucacuucuccagcucugcccucuguagcagucuaagcucagguugauccacuccacugcugcuguucuuggugaucaucccaugauacugacaucuccaguacacuggggucuucugcugcaacuaggcuuuacuaauagcuucucauaggcucucuucauggugccaagccuuaaauccuuugcaugacuccugcaguccugggccaucaacuggaacugaggcugcaccuucaccaauggccuucuguggcuucucacagugcuaagccuuagcuauuccccaugacuccuucaugccuucaaaaccaguaccaccagggugacucuuacacauuaccaaguacacuugcagcacaaaguacaaccuuggguauaucuggaacacagcuucuuugugcucucagaaaauaauucccagaagauuucacuucagugauacuggucucuucuuaaucacuguuauuuucuuagcuccagcuaaccaacaucaauugucccaauagucccuucuauucuggacucuaaagccagagccacauggccuaaacuguugaguucugcugccugcugggucagaaacauggccccuugguucuauuacauuaucaucagcuuuguguuuuccaauuccuuaacugccuaagcuggcuguccuggaacuugcucuguagacugacuuugaacucagagauugguaugccugucuccuaagcaccaggguuaaagcugugguccaccaagccuggauuuaaauuuuucuucaccuagaacauguucuguuuuaggcuggccuugaacucagaggucugcuugucuuugcccccugggauuaaaggcaaguacuaccaugccuggaccuaaaguuugcugggaaucuugccccaaggucacuacuuccuuaauucaguuuaauauccuugaacacaggauucagcuccauuucacuuccuggugccccuuuaaaacucaaaccauauauuuuauauuuuuccuuucuaagcuugcuaugcuuguuuaaaaugcucuucaugagacauaaccagagaacaaagucuaugaugggcauuucuaagacuuccuuugucagugcaauuaaucugagucucuucaccuuagccucaggcagacucuucagcaaagggcaaaaagcagccacauucuucaccaaaauaccacaaaauacucuuggccacauacugaaauucucugaaaccucuugggccaggucugcacaguucaaaucacucucaguaacaaagccuuccauauuccuacuaggauggcccauuaagccccacuugaagcacucuaccgcuuuccaaauccaaagucccaaaauccacuuucuuccaaacaaaagcacagucagguuuaucccagcaauaucccagucgcugguaccaauuucugccuuaggagguuauauacugaagccagugggaggaaaaagggagaaggccaagucuauaggagugacugaccaaaaaguuggggacuguuucugaaucccuggggaagcacugucccguugggauuguugaguaucaggauccgucuaugcgaaggcaaagaaagauaauggagcuggauaucaggaguauugaggagaagugucuuuaagauuuaggacugaaaaaugagagguguugucagggaucauggcgaggacagccuaaggguuagagacgugaaggguguacaggggcaacaguuaauggacugaaggcccagggcuagguggaagguucccuuagguuuuugacuguuaauaugggagcacuguagggugaugaggugggacauagagacuguuuagauaaaggacacugaaugagggcuuugaggccuaggcagaguagggagaacugggguuugaagaugugggcagaaggccuuugaguaugcuagagggauuuaugaugugcagcaagggaaagagggugguaucccauacagcggauugacuagaggaggcagaggauaagagguuuaggauuucagagagugagagcauguacaaauaggggcugaggaaggaaagaggaggggugcaggaguauccugggagcuguuguacgagaaaaauuuaugcuugagugugcuagaaaagacgcccuuuccuaauaagggaauagggcgugaucaagugaggaguaacaaaccuagaaaggaagguuaaagggggagucuggagggguguggaggacugcuguguauucaggccgugggacccaacaguagcacagagcagaggaaugaaguccaaaacagcuucucacacaccuuaaguuaaucacuuucucagaccuuuaugacuuacuuaugcuuuuguaucuucagaacuuaacacauuuccuuggacugucauaaugucagagcuguguauacuuuaaauuacuuucuuagaccuguauaacuuguaucacuccccccccccccccccccgagacagaguuucucuguguaacccuggcugucuggaacucacucuguagaccaggcuggccucuaacucagaaauccuccugccucugccucucgagugcugggauuaaaggcgugcaccaccacugcccagccuuuuuuuuuuuuuuuuuuucuuaaccuacauaacuuuuuuugucuguuucuuauaagcuuuagaaauucagguauuaguguguagccugucuauaggaaauggaccgagcaggcugcuggguguuggcuguuguuaaagcugcagcuacucaccaaugucaccagagaccugagagggauagauuugaguaagaaguacaguuuaaauuguuuuuauagcaauaaaaaugacaaagacuuacuuagucauuugaggcucacaugguucacugcagaagcaguccgucuucaguugucugaaaagaacugcauuuaauaguugucccagagcagcaggccuuuggcugucagacuagggcugaggaauucuuccuguagaggaagggcggccuugggaacauugaccuuauucugauaaggcaaaguauagcagucaauccaguguccacagcuuguguggauuccugcugcgggggaggggguggcaguuuuccccggggagcgguuaguguugcgguccagguggagucagcugcaguuguuccccauuugccuucuuuggagaccuuaacguuuucuuguuagaaggagcucucuauuuauugugggaaguuuuuuauugaacauuuuaaaugccauauucagcagaucucugaggaguuugagggccauauauuaaguauacccgauuuuaggcuuaaccuugaaaauacauaugcaugaggcuaaagaaaacuuauuuuuguaaaccauaaauguaauaaacuucuugucauuacagaauaugacuuuuguauggccggcuuuaaagcugaagucagugucuggcaggaaaugguuaauaaguugggcugauggugagggcuuugguggagggagggucaaaugagagagguaucugauaaggcaaccauaaauaaauuguauuguaguucagucaacaguggagaauuuggcuuuaggaagggagcugggaagaggaaguggaggcaguuguaacaguagcguagcagcagagggagagcuggcgucuggacgguagguggugggaaauuggcuuuaggauuggagugggcuugccaucaggcugaacggagggagcuuuuugaagagacaacggugagggggagggaggagcuguuagguugcagcuggaacaaguucugggggccacaguggcagaagagggagugaaggguaggggucacaguagcccagacauggacauaaagaagcuccaggacuuccaagaaggacauugcgcaggcccagagggacccaagagagcugucagacuuagcaggcagcucauggaggagauagcgaggaaaggaucucacugugagccagacauagggcucaggaagcugcaguuccuagggagacuggagagaagauacgggguuguuacggaguguuggagggcagacugggcugugcagaguggcagggcugacguggaaauaaguauagcugggcgggcaguugauggguaaggagaagggggaccuccuguagugggggccugaggaguguagcauccuugcugagguaggcucaggcagugugggcuguagggaggugugggugagguaggcugcaugagcagcccagcagcuggugagcacgaagugccugccagucaguacuccuaagacugaaaugcugcagaggcuuacagugucauguaggacuguucagagaguguaagagucacagcacagggcuuggagcagcagaagggaaagcagagaugcauuugggagcuaaagugcacuauuaauguguuuuacuggugcaggaaacauuucuaucaccaguggaggcccgugggucuaaguugagagacugggcaucuucauguauguaucuugagaucucugggacaaaggggucacagcagacucaugucaccaagagagagaccccagugggccuaaggaagaaucuagaaccuguggacaggguuuucagaggcggaggacuccagaucuuagcaguacaaccgcccaaagugaaaagaaagcuuugcuaaccacacagaacugaauggaauguacuuaucaaguguaggaauguagggaguuuggggggaaacuccccaguuagccacuguuggauggagaggagggugugcaugggagauucuguaggccaaaagcagauuuggccucauaccuucaacagcagucugcaacuccaguuccaggggcgagcuguaauaaacccuuuccccaccagcuugcuuuuggucauggcuuuaucacagcaauaaaaagcaaacuaagacaccagcaagcacucugccaacugagcuacaucccagcuagccucuagcuucucuuuuaaagucauguccagaauacagaaagauacgccuuuuguuuccaggggaauauacagaguggaguuagguccuacugcauuuucuaggucagguuaguuuacuaaauuguaggcagacugcugagugagauggcuugguacgaaaaggcuugacacagccugacaaccugaguuugauauucaggauuuacaugcuggaaggagagaacuagauuccuacaaauuguccuguaaucaucacaugcauuucauggugcacaugcauguauaugcauacuaaacauuuuaaaaauacacaaaaagcuuuagcuucucagauuaaggauauucaauguaugguuccugcucuuuccuuuucccuucccccuuucucucuccccuucucccuucccguuugccuagucaucucaccgugaccuagucaucuuaacauguuuuucuuuugcguuauuuugaaagauuuugcccucguuagaaaauuuuaacugagauccagauuucauauaaacauggcggggaauaugucuaauucaauaaaagaaaaacauguuucuuaccagacucccgugaaaacuucugguuguaauaagaaaaacuaauuucagccccagugagugaaagagaacagacuggaugaauacugguuuguucacagaaucgguguugucuagaugcaaaucuugaguaggcagugaaagucugggaaauuuagauucccgcugcuggagguugugggucuuuucucuaggaugccaucuuuaaaaaaaaaaaaugaaggcacaagguauuucuguaaaguguauuacuuuaaggguacagcuaagcaaaguuuucauuuauauagccacaugauuaucaggucaugcuauagcauaucuguaucauuccaguaucugugacacuucaguuucgaaguuaauguaucuauaucugcagcuuuuaguuuuuuuggcuuuuuuuuugucuauuaaauuuuaaauuuucaagugacagaaucugauauaggaagguugggacauagggccagacugauagaccaaggcuuagccacuaggggccgcucuugugugcuacugcuauuuugaagaagggagaauggaugugaacaaggcagacaucauuugucgaugucuaauucauauaccucagaucaaaacucaaggucuugcuuugucacugaaauucgugugaccuguuuuucuuccacagaaaucuuucauuugacucagaagaagaggcacuuggcgagguccuccaacaguuuggggaucuuaaguauguccgaguugucuugcauccagacacagagcauucuaaagguacugcccucggcugaccaggcccgacaucaggaaagagcauaaaccaugccguucuggucgguacacagucuguucugucucuggcuuggcuuccauuaaaagcccaaggacauuuugagauuguccuucgugacguggaauucagcaauuuaauggcuuugccagccuuaauuuugucucagccuuuaaagcucuugcuuacuuacuuuaagaaaaugaauucuauuuguuguucuccuuugcauuucaaaugugauagcaucucaugggcauuaaucauucuacauugcucagaauuaauagggaacuuuuuucuuugaugcuuuuguuagagauagaaacugacagaaacuuuguugcauggcagcagucagagggaaacuauguauaggaguggugcgggaauauuauccucauagugcuuguuacucuugagggaucagcacucauucuagcacagggcugaguauuagugugugaacagauacacauagaucgcauuagccuguuucuaagcucuuaccccauggacugcagccguucuguuuaagcuucccauuacucuguguuugcuuuauccugacauaaagaaagcauggcuuacucugcucccaucucagagcaugaagucuguucugaugggagcacaggcagagccgcucaucuucaugcugggccaagaagucgagaaaggguggcuggugcuaacggucugcucucaccgcauccuugauuuugcccacgccccuagaccaugaaguaccacccaccuuuagggaagaucuuuccccuugcuccuuuuggaaacauacucacaaauauaccuagaggguguggcuucggucuccggggugguucucugcccagccaagucacagggagguaaaccaucauaagccuugaggucaucguucacugacucccuagcagggcugugagcccuuuccucagaaaaacgcugugucugaggccuuguggcuucucaagaguuuauccgugguuaagaacuuccauucuaaaccuuacuuuucaacugauaggaauugauuagauaagacuuggucaauuuuaccuuuacucaguuaaaauaauguaggcaguacugaacagcucccuggagguagggacauuggcucacugagagcucggcuuauuugccugguaagugacuaggguaauaaaauguccucagcucugauggucacaccucaggaccuuuuucaguucugguuuguuuuucuggaauggacaacuagaaucucuuagaacacccagagugcgggcgcggcacuauuucacuuuuaucucuuagauuaacacuucuacaauguagccgacaagugauuugcuggacgucuuuucuguucccucagucuugauaguuaaucauuuuaaaaccauaauuuuaauuuuuuucaauguucugucauuugcuggcucuaacuugcuggaauuuucugauacuuuuucuguguuccuugacaguuuguuucucuuagcaagccuuuuuacugccuagaacuaccgugauccaugaccuuagggagaugcugagacugaaccagccagcacugauucugagacagugauuuccuuauacuguggacucucccucucccucucccucucccucucccucucccucucccucucccucucccucucccuccccuucccacuccccccuucuauuuucuuuucuuuucagacagggucucacuguguagaccaggcuguccuguaacucacagaaaucugcuugccucuacuuccugagugcugcgauuaaagguguucaccaccauaccuggccugauuuucuugcuaugggaugacuaggcaaucugccuguuagaaaucuuuuaccucuucauccuuuauuucuuucauuacacuuguccuucaguacccacugggucuuguucaagaccauggcaaauaccaaaauuugcgaguacucgaguucuuuauauaaaauggcacaguguuugcauauaaccuaugcauaccuuccauacacuuucaucucuagaucguauauguauuaaggaacaaaaauaaagcaacuuccucuuggauuaguugggcuuaguguaagccugauuugaauuguccacuugucuugugucuacugucugucccuaauaaaggacuuugccucauacuaauugaacaguacagaaagcaugguauggggaagcaaugagggaucuuuauagaaaucuuugacaggaauacuauuuccagcagacccaguauagcaacaggagcuauaguaacagauguuaccagcccaugucuaccuguugcuuucaguguuuauauuuguugucuaagauugcuuccacucugggcuggagagauggcucagcaguuaagaguuaagacugcucuuccagagguccugaguucaauuccuagcaauugcaugguggcucacaaccaucuguaaugggaucugaugccaucuucuggugugucugaagagagcaauggugucuauuucauaauauauuuacaccucaaaacucaaaaagaauucucucauauaagacuaccauaucucccagagcuaggauauuaucuucugccgcauacugaaaugaaugcaggcagauuaaucuaaagcauagauuaauauaguaggcuaacucaggagucaccaucuagagagaucuuuucuaaguccccaacacagggccaaguguuccuacuucuguguccccaaccucccaucuguuauucacauacuaaccagguagcaucuuccacaaauaugaaagacuuaaggaaucugaaccaccuacgacagcacagaccacuaacagagauagaagaagaaacacacacaguucagccuuggaacccauggacuacacaucaguggagucaaccacacacaaagcaaaagcacuuggggagaaagugguccauauugaacuuguauggccuuuccauucucuaugaacaauguaacuauuuuauguuucauagggguguguguaugaugacacauuuuaaugaaaaagucucuugcccccaaggagacugaauuuuuuccaggccuugccaucaaguuaacaauaugccuugagaucauuuagaaccauguacuuagccauuuauccuacuguauacucagccucuuuaagcuuaacugcuuuaaagagaacaugucacaaaccuaacugugccuugaauuucccagucagguuuugcaaccuaagcuaaaugcauagcuuuaauauuaaguuauguacuuuuccaggucccuccucauucaaaauaguaggugguguguguguguguguguguguguguguguguguguguguguauucaauucccagcacccacaccucagcucacaaccaucuguaacuccaauuucugacacccucacaaacauacaugcaacaaaacaccaaugaacacaaaauaaaaauaaauuauuuuaaaaaaccauuuaaaaauuauucuagagcauaagccaacaacugagcucaugacuuucccugcaauauucauagaauagaggccucuuuuaccccaagagaugaaucuaccauuauuugaugccucaggcaucuuaagacuaugaaauauaauuaauuucaggauuaaauauuucuagcucaucuuccaggguucuacuaggcaccccaugauguugaauuaagugguuggcuggauuucuuuaucauuuccugugaguaucauuaaggagauaguugggaccaauugccaggaaaggcuguguaugcuacaguaucuggcuaugaucccucagcacuuaacaugguaccuguuccccaagugcugcuuccccucccauuugugucaggcuguggguguuuucaguguuguccuuugcucacuguggaagcgaggguguaucuuacuacauuuuguaucuuuguacagguugugcauucgcacaauucaugacucaggaagcagcucagaaaugucuugcagcggccucucuagaggcugagguaaggaaagcauguccuuccccugugccuagaacacggcagcuucuguaggcaagagcugaugucugcaccagguuuuuauuauuauguauuuuuaauaaagugaagacuugagcacuuaauauucgcuaggcacugagcuuagccugcgugaccuuaauucaugcuuugagaugauugcagcugcccauauuucuuuuuuucuuuucuuuuuuuuuuuucgagacaggguuccucuguguagccuuggcuguccuggaacucacuuuguagaccaggcuggccucgaacucagaaauccgccugccucugccucccaagugcugggauuaaaggugugcaccaccacgcccggcuccauauuucuuaagugagaaacaaauuugauauuucuaguguucauugauuguugccuauguaucagccucuauucuacacuaauaacaugaagacuggaagaagguaucaaugcugucugugaaccugucugagugucugguagagguaguguagauacugagaaucuuucugugcuuuuuaaaugaagcauucaguuucugagauguuauccuguguuguccuugucucuuaaauauucuuacacaagcuuuagaauacuaaacauguuuacagaacaauuuccucaguuuaggccuacuuugggacugagcuacuguaaaguaaauuccuuacugcugaugcucuucaguacauacagaugugaccuuuuguacaauuguaaaaccaccuuugagccucaaggacccacguguagcuggccaggcagaugcggccuggggccuggccuccacggcacagugacagugugcugagucccuuuucuugcucuuccaugcuaucugcuuacuuucugcuugcucccuguuugaagagaagguugcaauauguuucaggguggugggcuuaaacuggacggccgacagcucaaggucgacuuagcugugacccgggaugaggcagcaaagcuucagacaaagaaggugaagaagccaacuggaacccggaaccucuaucuggccagagaaggcugugaguaucagaagaagauaggaaccaggccucugaguacccacccaugaccugagcgcgaaccagcaauuguguuucaaauauaaaacccaaauuuccaaauaaaacaguguuuuauugcuguuccacuugaguagaugcggcuuuguuaggaaccgucacccauucuugcaggcugagcagucucacucucugcugucugguugccuccgauuaucuacguagcaggauuggaagcacaaggaagaaaacuccuaaguuacuugcuuuugucuucguuucugaugagguguuuuuguuuuuaaguggcugaaaaauacaauuaaagugacuuuuuuuuugauuauugauagauuuuuaaauguuuaauagcuguaaguauuuaucagccuacuccugcguagaugcauaguuccagguaguaaauuuaggcugucagcuuuuggauccaaagccucugagaccauaauucuguucucuguuuuggcucaucuaauuaauugcugagugauugacagccacauacgugagcaccucaguuucaggggcagcuuguugguggaacauucuauauucuagcugcacuuagagcuucuuccacgccuugcugucuaacuugcagcaugaaugugaugcuuuuuggaggcagagaggaacaagauuacaaaauguucaguuugucuuuagagcaagucuaagucuagaacuuagccuuguagcuauuuucggaccuaacuaacuggccaacacaguccuuagggucuaguacaaaggguuugcaucauucaaaucacauucuuccuauugcucagugaacauucccuuggugacaucuuggcccuuuucccucuuucugcagugauccgcgcugggacgaaggcugcugagggugugagugccgcagauauggccaaacgcgagcgggugaguagaugaggcaccagccuuagcucucaugguuauguaagugagucagaaacaaucacugcugccacagugcuccugaagagccacguauaaggaccacacuuuaccauguuagaagcacauagguaaaggagaaaugacuggacaguacucuugcuguugugucagcauuccguccuguugucugagcucagucuugcucucuguuucuguaguacgcauguguguguucugaggaacugccgcuagcucacucaguagguguggagagagagggccuguguauaauuguuaucauaaauggaaaacaacaggauggaagcugaguaggcaggcuuacuaggaacaagaggagccucaauguuuaggagauggguuucagaaagaguagccaagaugccauucggagggauuguaucucuaaauuaauacaauuauguggaacaacuuccuauuauagguguuucuacuguuaacugacaccuuugcugcuuagcaguguuugcaguaguugcuuacuuuuguuguuuugagauaguuccauguagcucaggcagaccucaauguguagccuaauauuccugaauuucuaauccuccuccaucuaucuccugaguacugggauuacaggcccacuccaccaugccaguauccauggugcgaaguuuaaacuccagaugccgugugugcuaggcagacacuuuaccagcugggcucuauccuagcuuaugcaguuuuccuuuaaaaaggcagccuagagccagugggguggcucaguggguaaaagugcuuacugcacaagccuaguugaccugaguugaucccuagaaccuacaguggagagaauccagccucuaaaguuauccuuugaccuccagcacaugcacaguguguacagaauaacacacagacacacaccuuauaggaaaauaagauaauuaaaggguaaaaagccagccaagaagggaacaacuauggaaccuuaauguucaggagauggcaagcagcaaauaugcuauauugaucgguggaaacaaaugucuucucagcauaggguuuuuauaguaguauuuaaaaaauuuuuuuaaaguauugaauaucuggauaucaugguauuuggggaagcagugcaauaagauauacugaguuuuagaacuaauuuugcuagccauagguuacuggauuauuuccgugcauuauaaaaaauaagcuaacucuaggaaggaggcacuagaaauccccguugcugaguggcugaggacugagcauaaacacuaacuucaguauuacuuacaagaauagcugugccaagccgggcagugguggugcauacccuuagucccagcacugggaggcagaggcagaggcagguggaucucugaguuggaggccagccuggucuacagagcgaguucuaggauagccagggcuguacagagaaucccugccuugaaaaaacaaaaacaaauuugugcugggcacauuuugagcuaugugggguuuuuguuguugcuuuguuuguuuguuuuuugguuuugguuuuuugagacaggguuucucuguguagcccuggcuguccuggaacucacucuguagaccaggcuggccucaaacucuugagauccaccuaccucugccucccaagugcugggauuaaagacgugcgcuaccacugcccagcuuguuguuuuuaaucucauuuggccucauguccaugccgagaguugaauauugaccuguaguuccacuuuuauagaugaaaaauugaaucuuaaaaugucauuugauuucuccaaauggaugacuuuuugguucagcucugacucuggaguucaugaccauucgccucccugggccugcuuuucucucugcuggguacuguaaggcagcaggcaggcaggcgcacuguggccaugggaugggguuacgauucucuucuuuuggacaguucggagccugccuaacagaugugcuguauguuaagagcuugucuuuuucucuucucccaguuugagcuacugaaacaucagaaacucaagaaccagaauaucuuugucucgcagaccaggcuuugccugcacaaucucccaaaggcuguggacgauaaacagcuaaggaagcugcugcuggaggccacucgaggagagaaggggguucgaauuaaggaggugagugaugccuugccaugcacagccuucaggcacgagcauucauuucaggcuguggugccagcaagucaacagguuuucuucugggaacugucugucugucuuucuuucuuucuuucuuucuuucuuucuuucuuucuuucuuucuuucuuucuuucuuucuuccuuccuuccuuccuuccuuccuuucuuccuuucuuccuuccuuccuuccuuccuuccuuccuuucuuucuuucuuuuugguuuuuuguuuguuuguuuuuguuuguuguuguuguuguuguuugguuuuucaagacaggguuucucuauguagcccuggcuguccuggaacucacucuguagaccaggcuggccuugaacucagaaauccaccugccucugccuuccaacugccaggauuaaaggugugcgccaccaccgcccagcagaggacugucuuucauaucugacuaaauuacagcaaaaugugaggaacucugucaugaauuaauuuagcaagcauuuauucaauaccugcuguguggucagauuuauauaaauaauauaaugcaaaguuuguugcagagaauacaauuuauaugguuugguuccuaaaagaggggugggguguguguguguguguuugcgugcauacacaugcauauauuugaaagaaagggaaagggagggagaggaagggggggaaggacaaggagaggagaaaagggaagaaaauagggagagggaggagagaggaaguacacagagcacaugcagggcacacacggagaugucaggacaguccucacggucccccuggagucaggcucugguucccugcacagccaugcuuacuguucuuagagcuucuguuucuacagaagcuccuuaucccaccacagggccacugagacuacagacaccaccaugccuagugguucuuuuacauugguucucggaaucugaacucagguucuccuacuuaagacauuaaguuaggguucuaaugcugugaacagacaccaugaccaagucuuauaaaggacaacauuuaauuggggcuggcuuacagguucagagguucaguccauuaucaucaaggagggaacauggcagcauccaggcaggcauggugcaggcagagcugagaguucuacaacuucaucugaaggcugcuuccaggcagcuaggacuagguuauuaaagcccacgcccacagugacauaccuacuccaacaaggccacaccucaguagugccacucccugggcccagcauauacaaaccaucacacagggcaagcacugugccccugugccuuuccccuagcuccuacgguagcauugacuguguguucaauauuacuccgccguaagcacagucuucauguugacugugcaugucuucaguugaguuagaagacuaugaguucacacuagcauucaguucagcucugucucuuuugaaggccuuaccguuuguuaaccucuauacuggccucagacuuggugguuucuccagacaagcugagcucuuugaggauagauaguaucucauuauccccaauccuggagauacuuggcauaaucuguucaucuuuacauuuaaaaaugccauugccaauauuguaggugugcuuugcuguuuuauagcuguaaacuguaugccuaguacccugaggccucuuuaacauauuccuugguauugaggaaauagcaugagagaacaguaaugugucagagcgugucugacaccacaguuaguggugaguacccacaguauuuaauguaugcccauuuugaacucauuacaguuuagcgcacuucuacauuguacagucuauguuuugguuguguaacuauuuccucuaagauaaagccuccaucuuggaggaagguggguugguaagcuuagaaaggcucaggacauuucugagccugacuggauacucuagaccucuuacuccucaagcauauauaagcgguagggacugcuaagacggacucucaaacaggcugaagccuagaagaggcccagcagccaagcuccuggggagaggcugagaccugauaagcccagaccauugagcuacccagaaaagacacugaccuguugagcugccuucaggcugugcagugaacugcaggcgcucagcgugugagcucagcucgugggcuucuggugguggagcugucuuugaguccuuucugcuucuguaagucaccccgguaaagucuggcucggcagcuggcuuugguguugccuugacaaaagacggacaucuuugguuccugucuuggguaguagauguuaguuuccgucuccccaggaaucaugacaaaagcauuuuauuuuccccuuauguccuucauuugugagaugucuugaaugauauuuuaagcgagugagcguauugaagucaggaauucuuucuucuccucugcaguggacagaguaggaucuaugcacggagccguuguacuaugcuuguggcuuucauacuuagacuccuccgcuacagaagaacagcaugcugcuccaggcaguaauauuguauaagugguguauuuucucaaauuauuuucugugcuccucaugacccuaaggauauuuacgguauccuggcauuuagagaaaaaagugcaucaaagaguuucugacucuaaccccgaacagcugaagcugccuguauucugaggcuuaucccaugucaggacauguuuuuuaagucuaaaaccaucagguuuucuuuccucccgucuccauuaauuuccuuccuucagggaucgagucuuuggacaguucucuguucucagcaguaacaugcugagacgcugaagagucacgcaccucucauuacaugcauuaugaacagugaaguauuacagauuuuucucagggcauugaagagauggcuuagugguuaaguacauacugcucuuacacaggaccaguuucagagaaucuguugcccucuuguagauuccaugagcacugcauucaggugcacaugcauacacauggccauacaccuacacauaagauuuuaaaaaauacaaaauaaaucuuaaaaaauaaaauacauguuuuggauagcccuggggcuaauuauauuugauguuaauuccauucuccugugaguagcugugaacacggaaugagucaacacucaggugguuucuuguaaaccugcuucccaccuuaauuuguaaaacaaaggagagcugaagauugggcagaaaaagaggaagguggaguggaaaguugggagaagaaggagguuucagagagagaggacgcagaggcagagggggaugggaagagggaaggcggagcagaagcccguggccuggagaaaccgcaaguucuaaagggcaaguucauaggugggcagaucuaccaccacacuaccaucuuccacaucugugagacccuuagauguggaagauggcaguguagcaguagaucugcccaaccuaagugcacagcauguauuucauauuaauugaguuguguuuucauugcuggggcauauuuggguuggagauuuacugcaacaaauacauuuuucucugggcaaacaaauacauuauuucuuauucauaacuacuguuuuguuuuucuuuucuuucuuuuucuauccauaguguagagucaugcgggaccuuaaaggaguucaugggaaaaugaagggucagucccugggcuaugccuuugcagaguuccaaaagcaugagcaugcccucagagcccuccgccacuucaacaacaacccagagaucuuugggucccaaaaggugagucuccugcuucagagagaccuguuuucccagagucccugacaugugaguggugggaaggagcaccgggugggcaggguggagguggggacaagagauggugaaucugggugagaggcuccugaagagcgagacugggcacacugccugcagaacuggccuuuggagaagacaugagaaacagccucaaagcugacagaaggagaagcgggcagaggagcaccugggcccacugcccucacagacuguaaagucuuaggaauggcguuuucuuccucccagagacccauaguggaguucucuuuagaagaccgaaggaaacuuaaagugaaggagcugaggauccaacgcagccugguauggaaccuaaauuggguuugguuuugucgugugucugucuguguccgugugugccuauggaccugugccauggauucuagaggucagaagacaacuuggggaacucgguucucucuuucuagcauguguauccuggggccaucagacuugguggcaagugccuuuacuugcugagccaucuuccuggcccuugucucuagcucugacuaacucagaacucacagagaucccucugccucaacugggacuaaaggugugugccuucaugcccagccuuuuuuuuuuucaggggcuuaauuaaacguccucuuuuccacuuugugcuucugccaaguaggaguuuacuccguuuccuaagacucucucuggugguuuuuuucuuugcugucccucuccugagugcugcauaggagaaggaaaggggaagaaaagcaaaccaauauugugaucuacaugaguuucugcacagugugugggccaugucaagacaagugacagaggcugaguuccagaauccccaucaucaucugagacagcgucucccuguuuuguucaaccuugccuugaacucaaaauccuccagucucagcacagcugcuaguuuuagaccauuuucaacuuguguagggagaaggaagaucaggagcuguaagcucuccuuucuuagcuacuuucccuggcaaguuccuucucugaaccucaguuuauaaguggguuaauaacauccgcauuccucacacaaagagggacgugcuuacaugagcgcauauaccauugcucagcuugcagucacuacucucuuacccaucuucccuuggggcguacgugcuaggccagauuauuugcagguccauaauucuuauagcacucaucaauacucuacuacccuuugcaugcauagagaacauucauaguguucaguguaugcuaaacacacgguagccguggcuaaaacugaccucuguuggagaaccuggagucucacucuuggacauaacaaauugccuuuagcuacugcuugggguguuucugaagcugcagucacuuucuuugaagucuguucccugugcuuguauacauacuggacaaccuuucuccugacucauuucuucuucagagcaaaugaacccuuccacugagauaagcccucccuccuuacacaggcuuucaucaacuuccuugguuguuuuugguucuuauuuuguuuuauuuacguaugggucuuguguuaguuacuguucuguugcugagauacaacaccaugaccaaaagcagcuuagugaaagaagaguuuauuuggccucaugcuuccaaaggacaagagcccaccauggcagagaggcauagcaacaagcaaaggguaagaccacagaggaggaggcugagagaucacauccucauccuacaaccagagcagagagacagcuggagccagggccaggcugugagccugcggaggacauugcauucucacccugcugcuuccaugcugguagcccuucaccuuaucuuccuccgaagcuccagccuccucuugccguccugacuucacuggcccccgcucugacacuuuucccuuuuucaugcuaaccuagguuuugaaucuaugccuuuccuuucucuggaggaauuuguuuagcauuucucgaaaagccaguuccuggucacaauuccuuccuuccuuccuuccuuccuuccuuccuuccuuccuuccucuuuaaaaaaaauauuuauuuauuuuauguauaugagugcauugugacugucuucagacacaccagaagagggcaucagaucccauuacagaugguugcgaccaccaugugggugcugaucaggaagaucagccagugcucuuagccacugagcaucucuccagcccucccucccuacucuuucuuacugagagucucuuucaccuuugugaaagauaauuucguuggguagagaauucuagauugguaauuucaucuucuggaacuucaacuaccucauguuaccuucuuggcuucauaguuuauugcaaugagacugauaaauccagcuguggaguuugggguguuuauuuuauugguuuucuccuggcccuuaggccuauggcuuaaugucugucaugggucuuacauuuuucuagcugaauuacauuaaguaguuuugaguuguuuuguuccuucugcuugcguucaccucuuuuguguguuauacuuugguggagggcaggugucguuugaaacagggucucucauagcuuaagcuggccucaaacuccugauccauucauuccuuccaagugccuagaauucuagguguacauugucaugccuggccuguguuucaccauugacaauuguuucuuguuacuggcuuuugaacauugggcuacugcuugcugccuguuucuguuuccugucuuggcuccugccuagcagcugugucacuagacagcuugaaaacuguuugcuauguugggggacaaguuccucccugaccaagcucaugccagcccccuccucggcugcugcuuuccuagcaagcaaaucucagcuggaagucaggggcuauuucuuguuuuaugcagcaaaaaauggaauccaagccugugaccaguaagccccaaaaggagcaaaaagaaguuggaaaagacaagcaacagaaaguaguucagagcgccacacaggaucagaguaaggcgccuggagagcagaaagggaaagccggcuccaccucguggucaggcuuccagaccaaggcugaaguggagcagguggagcugccugacgggaagaagagaagaaagguccuggcacucccuucacaccgaggccccaaaauuaggugagaugcuuccuagugcauuggguuuggugcagcucuuugucuuugcugcauuugggaggacaaaagggguagugugcucccuuucccaugggaggauaacaggaaagucuccacccugggagggacccuccgaggaaccuacugcuaagccauacuugucuucuccaagcuuuuccugccagcuccgucagccgagguucccuuguucauuucucuuuggaacaauagauuagugcugugaacaaaugaucuuuaaagcauuguggugaguaaaugaagguuucugugauuucuguugaagucacaggcaaaaauacauaaacacagagagacaaacaaccgaauagaauauauaacuauuaugacuuaggauaugcuguuguggacucuauuuaagagugacugcuucugggcuuggaaacagcuauguagaaaagaagucugucuccuaugcucuuuuagauggcaaggacacuaaccagagaaaggauucuguaugacguuuccguggcuaucuuauuucaggcugcgggacaaaggcaaagugaagucccugccuucuaggaagccaaagccccagaugggccagcggaagcaaaagaagcagcaguuagcgucuuccgugcaggugaggucugcaggccgugugguuuguggugcugcagcucgguugggcugaggaggguagacuguggauagcugaguggacaggaaggcaagcucuuaagaggacgaggcacagugugaaaguggggaggaaaguaagcccuuggcaagcuacuugagcacuuagcuuguguuuccuuugcccgcuuccccccccaccagagugaguauaugaaagcaaaucccacuuuacauguaaauaugucucaagauaaauugcucagaaaaucuucagacagcguccaagucuacacacacauacacgcacacacacacacacacacacacacacacacacacacacaaugucauuaucauaucuacugagauuaaucagaaguucuuuauacccucuaaaauguagucucuauuaaaauuuuucuaauugccucaaaacuguuuuuuauguuugguuagaacugguuaggaugcuaacaaagcccacacauuacauugcauuauucaucccucccucccuucacucuaugggcuucuucucucuuaccacauucucucccacgcuguuaauuuguaggaggaacagaucaucuguccuucaggauauauuuuauguugaguucacuucgguaucaugcuuuaugucucugugaugacacuuuguugccugucagcuggugguuaggucuggagauguaaucagauccguuugcuuggaaagagcgcuucauggacguugcaccguauucagugcugcauugugguuguucacuguuaguaaugccaagaucagucuggaggugucagauugucugucugcuucauugcuccauuuuagaaaaccccuaccaccuuuucagguguuuuguuuuguuuuguuuuugcuuugcagugcuagggaccgaacccaaggcuggaagugcucagcuguugaguuaugucccuagcugcauaccuuugguuuauaacaacaauggauuguuauauagaucuauuauuucacuaugaguuacagaauggugauuuuccaauacaaucaucccuuuugcaccuaaaaauaguguucuaagaauuuuagaaagaaggaagaaucuuaacguaugagaaaggcaagguagaugauuucuuuucuucuccuugcuguauuaaguuuccagaguaaugaacuauugccauaccaaccugccuaugagacugauauacacacacacacaaacuacuugauauauguauguauguauuauaaaaucugaaauuuucauauaauguucuguguuucaaccaaauguaguuaaucaaaugcagccauuauucuuguuuugucuaagccaacagaaacaucucaaaucagcuccugcauccuucugaagagaucuugucugucuuugguauuguugcguucuuguacagauguucuaggcacgucuuacauguuucuuguuucccuagaaccucuaguucuuuuuaauagaaaauaauaguccuguucguccuaugcucucauucauauauuuuuuuuaaauuuauauguauggguaguuugucugcauguaugucuauaaacuacaggcaugccuaguaccccuagagaccagaggagggugcugaguccccuaggucuggaguuacagaugguuauuauggcacagugugagugcugggaacagaaccaggguccucuggaagagcagucaauucucuuagccucugugccaucucuccagccuccaguccuggauucuugagcauuugaggacaagcuuuuaucucucccaccccccuuuaagaauaaaaaagucauuagcauccuuuccuacucagaucugucucugggaaguuucugacuguaucauacuguagagaucuaguuucugaaauuucauaaauggacuucuuaugugggcaggagcaaacaagaauguccaaacuauucucccuugugaacauggucuuuguacccauguauguuuuggguacccuugacaggguugaaguuaaguggguauggugcuggcccuuggaaggagaaacucgagucaggaguucaggcucauccccaaggacacagugagucucaggcaugcggaaaggaaggaagaaggcaagggaggaggcaggaaagcaaaggguagggaaggaagaaaaagaaaaacaaugccagccaaccaacuagccagccagccagccagccagccagccagccagccagccagccaaccaaccaaccaaccaaccaaccaaccaaccaaccaguugucuguuuccuuucuuucacaggcgccuaaaagaaaggcuaaggagaauaaggcagaagcccgcuucaaccagcugguugaacaauauaagcagaaguugcugggcccuucuaaaggagcgccccucaugaagagaagcaaaugguuugacagcugauggcaccugcagacuguacaaaagccgugucuuucacugagggaagcagaucccagaugauacccacuuucuuggggacuguagguuguguacauucaugguccguucuccagugugguguugguuagccacacugaaaaacacuauggaguuuuuauaacuuacccaaucacagugcugagucugugauugcaacuuaauuucuaauuucuucucaaauggaaacuauuguaaaaaaaaaaaaaaaaguguuugagaguacugaauuguaaagaugcauauuuuguuauggagucuguaagugaggaacuaugacuuuuuggaugugucucauuuuuaauauacacaaauauaguaugaguuuuuucuaaaugaaccuuuuuaacauuuuuaaaucgguuacauagucuguaaggacuaagcacagagaaaaugcuuacuaaaguagucucugaaugucagagacacugggaaacgacugaaggccaugggccuggcagcaaguggcaccugagaagggucugcccccggaggggaauggcuggcugggaauaagauugcaggcuagaccccagccugaccauggauggcccagaugaauugcacagagcuccuucccccagggacugggagcuuucuggugagaaagcagcgaacuugaggccaugaccuaaagccuaaacucuuaucuagucauguugaauaugcaguuaacuaaaugcucuccuggucacucccugcacuacauacucuuaaacauucuuaccuauacuuucucuugccuaaagaaagcugggggucucagagucagggucugcaagaauucugguggugugaagagugggcuguugugaaagaugaagcucacuggaggcaaaccaacccccgugcuggacaacucugacacaagauguggaguacacugauagauucugccaccgcagagccuccugucugcccccuuggccuggagagcgucuccuuaggaucauuuguuucucagaucucuacugaacccucagcuuuucugguguuuccuucaguaucugaaauagggcuccucuuaccucuccaaccugacuccugacuggacucuccgacccuguuuguuuucucuuggcacucacuaaucaucaucucagauuaucuccccauuaaaacaucugccuugagacuuucucuuguuugcccuuacauaguggcuguggaauaaauauuuacugaaugaaaaagaaaaacaauaacaaaggaaaaggagcagugguagucuguagaaaaggcugagaacuuagcuuaacuugcuugggucccugaccuaaugugcugauuuaaaguaugcugucccaaaauaucgcugagccaagcagagagcuguuuuauggcauugucuugagaaaaccagcgagugcuccagaaagcccuugauggccuagagguagugaaggaagaaaucauggaaacauuuagacuguacuggcugguuuuauguugucaacuugacacaagcuggaguuaucacagagaaaggagccucccuugaggaaauggcuccaugagauccagcuguaagucauuuucucaauuagugaucaagcggggagggccccuuguggguggugccaucccugggcugguaguccuggguucuauaagaaagcaagcugagcaaggcaggggaagcaagccaguaaguaacgucccuccguggucucugcaucagcuccuguuuccugaccugcuugaguuccaguccugacuuccuuuggugaugaacagcaauguggaaguguaagcugaauaaauucuuuccuccccaacuugcuucuuggucaugauguuugugcaggaauagaaacccugacuaagacagaccauuuggauguauaucccaaggacagguguugucuuuaaugucaguucaauacagugaugggagucuggaacauuuuuacaagugcccagcaacaugucugucccagagaugggguagaaagugccuuauggauauagugucggaauggccacaaccugccggucugguuucccuuggccggcucagucugcuugccugacaccuuuccuccaguacacauauauccuuaauauuugaaaauguaucuuaacauuuaggauuacaaaaauuugcuguucuuucugaaaguguugccagauucuccuagauccagauauuucucuaacaucuuuagcaacccuggguguuaaaauaucagucaguugcuuggacguuauugcacaguucuuua

SEQ ID NO: 2867 - RNA, 15931 nt, Mus musculus
caguagaccccgcccacuaccccgcucccuccgggagcggacuggggcucuuauugccuacgccgguucgggagccuccacgcggagaggcucccgccgccuagagcugcggccuccgcauggcauggaggaaccgcucucacccccaccggaguccgggcugcucucgccgcugcugcagggagguggagcggcugccgcuccagagcccggagcccggcaacacccgggacaugagaccgcggcgcagcgguacagcgcccgccugcugcaggccggcuacgagccggagaggugacgcccagggcaaggcgcgcgggcgcauccggggcgggcggcagagaagggcgcggcaacgccgggagaccggguagcgcugcgggggaggccagaggcagguccccucuacugccauugcacuuccccagacgcaguuagacugucauacaccugacucuuggcuggcggaugcaggcgggcacugugcaaacaguucagugccgcguuacuccggggagcuggagagagggcgcagguuguaauaucgcucccuaacauuuuaucuaagauccgaccuauacuacacacucagcgacgcuugguacaaguggcuccgaccucugggguacaaaaagugcuuguuggagucccgguccaacggcgcuuucuccucagcuuucuucuuccuagaauguauucaauagguguggguguccggauugagugucucccuaggacuaggggaagguacuugcacuuucucaccaggcacugagauccagugaggcggcugcuguucacuccuuggaaagacuuguaccccaaugcagggggucugaaaggcaaugaaugagggucccuggagaaagaguuggggcagugaacugggccucaagggaacgagcugaaaaaagagacagcggcuaaucucuggauuguaucgcaguuugaaaugcaauccuacuguccuuccgguccaggggauuuggacuucuuucucuaccccaucugcuggugcucagcagcuuggggaggugaucuggcagcuggguuuugaggggaggguggucuggggaauuagccagguaguucuucugcccaggguuuggccgcuuauguaagaacuuuuaacggcuuuuggggcuacgaagcccagccccuccugccguugcuggcugucucuuuagaacugacuuaggcuuaagcaaccugccauccguuuuucuauaauagaaaucuaguuuggagggcuugggguuuuagagaggugccacuauaugggaggaagcgggccacgguacuugugagcucgaaggaaacuaggacuguagaaucucagaguucaggcaggugcaucucuuuuucagauguacugcugcaucaaagggacagugccaaccccacacuucccgccccccacuuaggcucagaauggccuguguaaacuuggaccccagccaggccaguauaaaauccaaaaccugccagcuaagaccucuaucugccuccaccaaccugaaugaagguguaggaaaaggcaaggguucucugagaagcccuaggcuucaguccagcagcauuacuggucucucuggcuugaacuugggugagcccugccuauuuaucccggcauaacaaugcuaauguugucuuuaccuuuuccccccuaaaaguguuguuuugaaaucuuguuccucuaaacaaccucagaucagauagaguccucuggacugcuugccugaacuuuagugcccugguggacacuauuccccuauuccccugagcagcugccuuaggccugcccccugcccuugaagcugugaggaggggagucucaggggaccagcugcccuuccuugcguuaaagaggcccacugguugccuggugucuccucccuguggaggaagcagcuggggaauugcaggaagagggaggggggaagccagggggauggauuaagucucuagaaaaggacagccuaacccagccuugagcccagcagcuuagaguaauaaagagcucugacauaggucaaagcaggagggagaauggggcccugaagucuguaaucacugggaaggugacccuccccauagcugccagucuccucucuugggacccaaaguccuaggcuggggcagaugacacauuaaaguuaccugaggugauggguucuagcuguucugggcaccaccagccuuggcugaacccugaaccagagccagucuugacucaugauguagggaauagugacccagaguaggcuccuuagaaacccagagagaccacugggacaggccaugcucagagccuaugauugauaugguggcuauuucuucugugucuaggaagggugguucagaauaaccagggugugucuucuggcuagucucacuguucugacuauaaguaacaagcaagagguucuagugcuggcuccccguauggccugggcuucuagaaugaagcccugagugcuggagaacccgagaggaucccuggcaagcagauaccaaucccugcuuugccaaggacucggacacucuccucuccuuucccaugcuccagggucuucggggcuuacaccaggcccuauccuuugggcuccacuggugcccaccucccaagagccaagaagacaucuguaaauccucuguaauacugagcuccaugggagacucgccuuucccuuugcacaugcauggaacagccucuguuuuccuggcagggucccggggguaccauuggggagguugggcaccccagagagccugguggcuuggaagccaaggcuccccugggccuggcugucaccacacugucgagagguaaacaaacccagccuuccugggguggggagaaaaggagacacagcagcucucaaggcagggagggagaagaguguccccaggacaccuaguuucuccccaaaugugugggaaugucaggagggcaggcuaguggcugggggagaggguaauggucugggauaacccuucuggacaccuccaccuuucuccaugugugaauggguuugcuaccuaaucuucuugucucccagauugaaaucuaggucuuguuaguugcucagaacuggccacuuagguucuccuaaagggaaaaacuuuaaaauugccugcuucuguccuuguuuguauguauacuuguuuaugccacugccccaaaccuuugaguuuuccccaguuuuuaaccugacauuauuaucccuacucaaaacaauuguucuucuuuagacuccuuccuggucucuagaucuuucaggagcugagaaugaaggcucuucccucccuccaccccccuucuguguguguguguauguguguguguguguguagucugggacugggaauagcccuuccccuucugcaucuaugcaugaggagggccaauuaauagauuguagaauauauguguucauuuaugaaaauugcuuugaagauggcagaugauucuaaggcuucucaaaugucaagcauugcugaaagaaagagagagagagaaagagagagagagagaaaugcuugcgccuuaggaauugcgugggguccgggcaagaauagugauccaaggcccaucuccuguguguuggggaauuuugaguucagacugauauuucagagcucuggggcuuuuuauuagaguugggagaauaauuacuggaaaaaggcaugaccauguuagagguaccccuaggggagguaaugggagacuaaggggcucaguggccuaaggaaucuaaggggcccagccaaguuaggggugaacccuguaagguccacugcugggguuccggggagcacguugaagagcagcgaagggggcgugucuacgcuuggcucuuucucuggucucauauccugcccgcaaccccuggccuggucgccagagucgaggugccauugcgggugaucagggcgugagugcagcagcggcagcagggcgagccgggcagggccuuugugcgacgaggggcggaggcagagauccccgaaggaggggcuggaggagagggcggcgcccggggccucccuccgcagccgcagcccccgcccccggcccacagcggcagcguggccucggugcgcgucagcagcagcagcggcggcggcggcggaggcaguggcagcggggcggcccgcgcggguguuuaugucgggucgcggugucucccagcagcauggcggacuaccugaucagcggcggcaccggcuacguucccgaggaugggcucaccgcgcagcagcucuuugccaacgcggauggccucaccuacaaguaagcgccgagauugccccuaccugggugagcacgccgccgccuggcggccccuggcccccgccccgcacgugcacggcuguuccucgcugacgcccgaaugcccucgcccaauaagagugacuuggggccagugggggcugggcaagggaaggaaggaggcucguaccaagaauagagagggacguggcauagcgacaucacugcccagggagccuugaccgauaacuggcuaagauccgaggccagccugcccccugggugucuuggccauccuggagaggccuugggacauguagaaagacgagaaguggcuauucuagggggucuuuaacuagcaugauccaggaugucguccuucgucaagccuuaccgugaaagcagggaggucccaggaucccaucucaggcagcugguugaauaauaauccccaggaaggggcccauuuggcaguaguguggcccuugucucuccauaucuaguccagccccccuuccacuugugcggcuuccugcccauagguugggacugaugcccuccaugaauauucugugccaacccuuuaagcccacuccacguggccuuuuggagaaagguagagaguuaccugucugccucaagcuuaguuugcauuuuccugugggcccucagccaguucucccugcaggccuggcacuagcugugucuccuggcugcaggacgacaucccugccaggaaggagcaucagaacccuugauuagggcagaguagcugcuagagagucaauagcaucuguggccugucaccugucaucucuacccuggcucauaaauuguccuguuugucggucagcuuuccuguugcucugaggagggcgcccuccugccggcccacgggugaagggugauuuuuaucuagagaaugccaacggccccagacucugguguuucuucucuggccucuaagugaaccacagaaggaaauaggcugccaggggaggucaaggugggguaaaaguucuuugcuccuugguggucuuugaugacuaaaaaggggcucuaucuuuuuuuuuuuuuuuuuuuuuuuuugguuuuucgagacaggguuucucuguguagcccuggcuguccuggaacucacucuguagaccaggcuggccuggaacucagaaauccgccugccucugucucccaagugcugggauuaaaggcgugugccaccacacccagcuuagggcucuaucuuugauaggaguuuuacuguacuccuagggaaguuugaaggggaaccauuaaaauuucuuuuaggccugguggcgaguuagucacagcacuccuaucugcccuguggcuuuuguuuccugcaugagaagugccuccugcuuugccuagcugggcucagaguguauuugaacuugggucguuugcuucugaguguguccaucuaggcucacugugacuucagguagacugugcccguagcaucccuggccuguggcaguguauaccuagaaguaccacguaggccugcucuuucuuccuaggcuccacuugacuguucaccucacucacguugacagcugcuaugcucuggcagguccuaauuguuaggacuucuggcuguccuucccauguauguuggucgcuccugccccagugccugcucugucagaacauguccugagcucaggucucuggggucccuccagcugcuuugaaccuugugugacucagcagccccagccuugugccgugcuggguugugcuugggucauguugcauugcaaacuuacuuucagauucuguguuuucuucuuucucuugcagugcugggaaucaaaccuagaaccuuguacacaauaggcaaaugcuuuauuacuaaguuccauccuuacccggauucucuuguucugcuacuauuuuguucuucugaaacagggucuuguagcacaaacuggcuucaaccccaauccuucugucucuaccucccuaaguacugggauuauagagaugagccccuccccugcaguguagcuucuguuuuuuuguguugaguuauucuuugcuuuuguuaggacuaaggaauuuuuuuuuucugagacagggucucuuuauauacuauuggcuggccuggaacucacucucuagacuagccuggccucaaacucacagagaucccuuugccucugugugaaugcuggaugcugggauuaaagguaugcaccgucacaccugucaagacagaaaucucaagccaggcaccauggcacauaccuguaaucucagcagucugagccaagaagauggugaauucaaggccauuugagaugccaguaaaauacuguuuuaaaggaggaaagggaagcuagguuucauaauuacaucacuugaagcaagagguugaguucaguguuaucccuggcuauauagcagauaacccggcccgucuggguuacacgagaccugccuauaaaacuaacuaaauaaaaacagcagacugagaaguccucagaggugugcauuguauguacugugugugaccauguaggaaacuuuuauguccuuucacaaacucuggguggucuccggaucuguagacccuccaucugccauuuuuuuggccuuaguuccugagguugaagcuacguuauggggggugugguggugguagugaggaagaccucucauggggccacagggucaguggauuccagccuuucugcuccucuacccacccccacccugcugccaacccuaggauagcagaccccgaugcuuuuggacacccugcccacuggucacucucauucugucuuuccagcgacuuccugauccucccaggauucauagacuucauagcugaugaagugguaagugccucuuccuuuggcucagggaaggggcugacuucuuguuccagggcagguugugggagaggcuugccuugggaaugcucuuuugcccauuaccuuuauuguugugggagggacaggcacacagucaagggcagaggcaucugggguugggggagaugcuggugaguuuugagugccagccucuggguuuagaggaugcucugucacugaagaaguuggaggguuggcucagaaaagguccugugaggagacgguuugggcguggcugcuuuauuauauagacaauaaggauuagcuguugucugaaaugcugagccagggcuaugcucuaaaauuaugaucacuuugaauacaguguucagugauugggcacugacccauaauggacaagaacuggcaagagggguugaggggguaggacugggcugggggggauggucagggaggacuuuggacagauacaggggaacacaaugcuuuccuuuccaugaggggcuagcacugagccaaaucgacgaauaauuagaaggcugagaaguugagaagaguagagaugaugguguaagaugauucagggaacagcagccaucugaucuugaacucaugccuccuuaaaagacccauggcugugguuauuucugcuuauucuuuccguucucacaaaaggccugagaaccugcacgugcacagcccuagauuacuuacauauuaaggaaacucagguuuagccuguguguacagagcugacccagacaagauuuuuagggggugggggaaauuugggcuauucuggucguucccuuuugauagcaaucaggaaggcuucuuguuuuagccacuuaguuuaacaaaguuuauugcacauccugggcugggcauccugguucuaugccaaacucuggucugacugcuaggaagagagggacuagaaagauaucugccuagucaugaggggucuccuuguccuacgcuggcugcuuggggccugacaggagaggagacagugugauugucugcgugugggcccagagcucugcucgcauguccugcaagggucugugagucugaaagguuucauuuagaguuuguuuggaggguuugggggcuagauuaguauuuaucagccugauucucagaaggguccagggucuagccauguacaaacagacaaccugcaaauguauuuaggagaagugucucuuauucaaaauacucaagaccaaaaugcuugcagauuuguauacuugauuuuuggggaauauuuauuugcauauauauauagugugaaaucaggaacgggucaaaaucuaaaccaaaauuaauuuacauuguauauccaccuuauacgcugccugaggguaaugucauagaguauuuuuccugcauuugaaggugacuugucacucgaggucagguguggaacauugcacuugugauccugucuguauucaaaauacuuuagcuuguaaagcauuuggauuugggaucuuccgaguagggaugugcguccuguguuaacaauccugaccuuuuucuugagcucccgacccuuagccauuuauguuccuaccuggcuaguaggugccucccugggccuaccuuugucaccagcccuuguuaucuagaacccaauucacccuguuccugguguuacuuggccuuggucuccccuccuuuccuuccuucuuccuuacaucuccuuuuuacuauucucuuuagucucguauaauccagacuggccuggaauucaguauuagccaaggcuaaccuugaacuccuaaucuuccugccucaucuugggauuaugggccuggugcucuuuguggcuuucaucucaacugaagugaccuugcccaugugccucacauccacuuucuuuucaaguggagugaucaguuccccaagagcuguacugcucacugcugggccucaaagccuggccuaugcaggauauagaugcuggcgaauguuuguccaguggauaaaacccuucaauggacugugcuucuauccuuaggaccugacaucagcccugacccggaagaucacacugaagacaccauugaucucgucucccauggauacagugacagaggcugauauggccauugcaauggcugugagucgcuugccuggguggggcugaacaggaacggggugugcagagggaagaggaggcuagccuuugcucuuaccauaccucccuucuauaccagcucaugggaggaauugguuucauucaucacaacuguaccccagaguuccaggccaaugaaguacggaaggucaaggcaaguacuggacucacccucaaaaacaugcagucuacuugauccucuaacugaugugggaccuagguucccuuccuuacaaugaaauaugggcuuagccccccauuuucccguugguucucacccuauugaggacucucacuucucaauggcccaucaggguccccuguguccuugguggccaggcuaugugccaccuuuggguuucuuuuuuuuuuuuuuuuuuuuuuucgagacaggguuuuucuguguagcccuggcuguccuggaacucacucuguagaccaggcuggccuggaacucagaaauccgccugccucugccucccgagugcugcgauuaaaggcgugcggcaccacgcccggcucaccuuuggguuucuugcagcucuuuucuucuucugucuacagaaguuugagcaaggcuucaucacagacccugugguccugagcccuucacauacugugggugauguucuggaggccaagauacagcauggcuucucugguauccccaucaccgcgacgggcaccauggggagcaagcuggugggcaucgucaccucccgagacauugacuuccuugcugagaaggaccacaccacccuccucagugaggugccugcagggcagggaaggcagagcugcaucacagagggaacucuacccccgggggccccagacuggugccugugaccagggaccauagggaggccuggcuccgucucucucaccugccaaccugcaggcaaauguuccuggccccacaggugaugacuccgagggucgagcuggugguggcuccagcaggugugacauugaaagaagcaaaugagaucuugcagcgcagcaagaaagguaccagggaguacacaccccagcuuccuguacagcagaauuuccauuauuccucagccucuuguguuggcccaauaaugucuuggaggaaacgugaauaacccuaggcagucuggagcagguuucccgauacuccgcuaccugcuuacagaagccccaguccuaauucagugucuucccaauguuuuuccaaucuaguccugagaggugcuugucauaguaaaagagcuuuccggucuuagaagucugggaaaggacugaggaagggggaaggaaguuccaggacagccaaaacuucauugggggggggggggcggggaacgacacccugugucaaaaaccaaaagaaagaaaaaaauuacccauugacuucucagagucuuugaaaagucccgcaguuaaauauauccgauagagcggcuguuuguaugacguacauuaaguuccugugggcuguugcuucccagguccccgguggagaguucuuggcauuugcuuugggcagagaggauccauguuccucccucagggcagucucacauuaagaccuugucuggguacuuuguacagugacgugcuccagcaagugaaaaguugccaggguucaggggcugccugucccaccaaacccgcaugggcaggaagagccuuaggaacgcuugggaagguucuuugcuuccugaucucugggaagagguccagguccugggugggugcugucaccuaguggcuagcuuagguacuucaggggucucucguuccauuuccuuccgguucuucuacccacuacccugcuucucucuccuccuggucagggaagcugcccauagucaacgaucaagaugagcugguagccaucauugcgcgcacagaccugaagaagaacagagacuacccucuggccuccaaggacucccacaaacagcuguuguguggggcagcugugggcacccgugaggaugacaaauaccgccuggaccugcucacucaggccggugcugacgucauaguacuaguaaggaggugacauaguacuaguaaggagguggcggguucccugcaucaggcuugugaggcucauucaccuccauuaagccuuugcucccuccccacuuugcucucuuucggcuucucugguaucagaacuaggcuaauuguagagcccagaacaaaccauggcccucccuccaaggcuuucuccucacauacaagcucauuuacccugauaauuauaacucacacucacugagaggccccauuugcccggcacugagcucagcuuuauacaugcucacuuguuucacucaguguuuaacuuaguuagcagcagcucucugagugcuggucccuaauucccgugaggggacuuggcuguuuagcuugagccuuuuugucccugcuaacaggauucaucccaggggaacucaguguaucagaucgccauggugcacuauaucaagcagaaguacccccaccuccaagugauugggggaaauggugaguguggaguggccccccucagccccccagaacuccuaagugaugucauucuuccaggcauaggggauaaaggguaggaugggcuuuggugagcauuuagguugggggagauauacuaagaucccaggacauuccugggcaggguggggacacuauccucacauuccucugucugcuuccuccauccccaguggugacagcagcccaggccaagaacuugauugaugcugguguggacgggcuucgugugggcaugggcugugguuccaucugcaucacccaggaagguggguauccgcaggaggaggaggaggaggaggaagggcugccauuuagaaccacucuggccucuucuucuauagauacaugaguaucugccccacuaggugauucucgggagcaggauucuggucugugcuuuacccugucuuggcauaguugugggaagaggcagguauaggcagaugaggacauguggcuuuugggaguggaccaaccugcuuuuuggacugguuguggggacgcuguugguaucacccucuaagguuggugugacacuuucuauaguguguguguguguguuggaagauagcugaggguuuggaucccauuugugaccagaucaugccaguggugugaaggauacaagucucugaacauccagggauuccauagacccacauugccacguguaacagagcagaauccaccucaccccacagcccccaggugagguugagagcaaagccguauuccaaaggaggccaucggaacccagcucugguauuagcugcuaauucaaaggacaucuuuacaggaagccaggccuccacagcagcuggugcuagagaccaccagucuugaggucaugugucugauggcucgcauugauccccugauccauauccuuuaugguccugcuaguuaguggugggugaccuaggaaccgaaaauggcuuucucccgccuuaggccucagaaacaccaucucuuaccauccuuucuccauuggcggggauagauacaaggagaccacugauccaucucugucccuuacauuccccuuuccccagugauggccuguggccgaccccaggggacugcugucuacaagguggccgaguacgcccgacguuuuggggugccgguaauagcggaugguggcauccagaccgugggccauguggucaaagcccuggcacuuggagccucuacaggugaggggaacacuugguauugaggacuagaagccgccagaggggcagucagacuccuguguggaggaggaggcauuuagcccucaaccuugaucucugcaguaaugaugggcucccugcuggcugccaccacggaggcgccuggugaauacuucuucucagauggggugaggcugaagaaguaccggggcauggguucucuggacgccauggagaagagcagcagcagccagaaaagauacuucagguuugucuucauguucuugaacucccccauggccuugacuuuagacggauaccugagaccgcauucccaaguuguggagacucacagacaugcaaaguggcagauguagcccgaccugaccagagacucggauauuguuucucuuguagccuaguauguggcuacaagagaaacaauguaugaggcugcuguggggauccucugggcgguauucuaucuguaccuuggagaggccgggugggguccucugagccucugacugcucagcucagccuccccaccuuccaugcagugagggggauaaggugaagaucgcacaaggugucuccgguuccauccaggauaaaggcuccauucagaaguuugugcccuaccucauagcagggauccagcauggcugccaggauauuggggcccaaagccuaucuguccugcggugaguguugcaacuugagggggcagcagaggguccugggagguuuuccucuuuccucuucucuuucucuuuucuuuauuuuuuggggggugaggaaggggguguuucugacuuauucaccuguccaccucucagauccaugauguacucaggagagcucaaguuugagaagcggaccaugucggcccagauugaggguggcgugcacggccuacacucguaaguggguagccuccucaccauggcugacuggugcuggguuggacagguucaaaggcuaagccgagguuccaggggccacauggccucucuugucacccugucuacagggcccaguccacccuggaaccuagucauggagccucguguaggcuggcuguuccccucccucccucccuucggguagcuuccaggacaaggcacgggagguguggccgcuagcccuacccgggcuccuagcuccugcuugcucaagaagcuugguggcugguaguagggcugcugguguuggggucuugcuggugguggccccaggcaggcaggcaggcaggcaggcagaaaaugggggcauggacccucugguggggaaacgggcagagagacagaugccaggccugaugccggugugacuguggguugggggccaagcucauuggcagcaguaguuguaggcaugcagcccgcccuggucgagaggacccaucucccuaaucauaggcgggcaucuaaccugugucucuuucugccccacccucccauagcuauaccuuucugccguguaaguaacugcgcugccggggccagguguagaauagagcaggggcagucugggugggccaugggcugggagaauggggauuggguggggggggggguagugcuggagccuaaucaggagacauggacccaaaugggcccuucugguccucacucccagcaccaugguggaggaggccaaucguggacccucauccaaccauggccccucaaccaaucaaaacacgaaucucauugugggguaccaagagaugccugugguuacaggccuggggcuaccccauugugaaaggcccgagucaccaucuauggggggcacgguggaaacaagaaaccaaagguugagcuaguugaagucugcucugugaggauggcugugcuugccugagcugucccccccuccuagccaccaaggacgauccacucagguguggcauuggcaggaaggagcacagguuccuuuagcacuggcaugguuuuucaugcagccuuggccagaggaagacagagguccagggccaccucugccuccuccagcccccuggcugagaggcaagcucugcggccccuugcccuaucccaaaccuggggggcuaugggcaagaggaugcugggaagagaguagaggccacacaucuucucuuagcccuguuuucuuugucuucacaguuacgagaagcggcuguacugaggacagcgguggcggccaaggcaguggagggggcgaaccccggggccccccucuaggaacagccucccuccagaacuaagugguccauagauuugcacuacggguuccccagcuccuuuccagggagaggaguggaguccuugaggggccuguggccccucucccgggcaaccccacagagucagguagccccccccccccgugccaggcugccccauaagaucuuccggguucccccuucuucaguucccugagcccagucagccuuggcucucaggcccugugccugccucaggucuuucucacugcagccugcucuggcccaauguccaacucugaccccuggggaagguagccccuccuggcuucuccuauagggcaccucucucucuugcugcccccuuccucccaggaaauggugcucuccugacccugccucuggcccgucccuggagugcuguccucucagccauguggcacuguggguucuggaccuaggccagggggaggucucugcccccuuccucuggcuugaggcucccauggggccugcuccucggcuuacuuccccaucucugagcccagggagggccugcugaugaccaccugcccuucauuccugauucaccaccauccccaaguguaccgucccugcccucucuucucagcugcaguugaaggcuuuaacuuugcacacuuuggggucacaauugugucauuguauauuaaauaaucugaauaaaucaagcaguuaucaaugccu

SEQ ID NO: 2868 - RNA, 2664 nt, Mus musculus
ggugugugcccacgacagagucugguaccaagggcagaguuaacuucugucaaguugacaucaaacuagccaacacaaagaccauaauuuuggguucuugaaauggaucuuagugccagcagaucauccaacuuuauuuauuuuauguguguaggugucuuucuacauguauaucugugcagcauguucaugcagugccuguagaacccagaagaaggcaacgaaucaccuguuacaaccugacaguuguaagcugccauaugggugcuaggaauugaaccaggguccuauggaaaagcaacccgugcucuuaaucacugagccaucuuaacagccccagaucaccaagcgucuauuauuuauuccugagaucgucagauguuaaaaaaaaaaaaaaaguauucaguguaagaauugucaguuguuuguuuucuaucuacucggccuccucgaacaaauugcccgaaggcaguaacucuucuugcuuucccagagaguugcuuuaugaaagcugacaauaguaacaaagcugaaauagaaaguguuuucuaggcagcagaugagcaaaugcgaguuagugcgugugugcucagcccuacuucccuguaaaggaagacuauaagcagggcaagacuagggucuuuuccuucaggagcuaguagccuguuugucuucccuggguagcaguauaaagaaauggugaggguuguugaauagguagggcuugcuggagugucccaccucucuugcccaggacuggaagcacuccaagaggccaugcaauaauaguucauuacccugguguuugcgcuccuuuuccucagaugaaaccaggagaaacucgaaggugcacgacacaggguacagcggaggguccucuucaguuggguccuugaagaacacaaaccucgcuccaccucaccaucugcucaucugcuuacuuuucagccugaguggcgucucaugggggcggaacagagcguagugccaagggcggagcccuauggacuccaggaccccaaaccagcucuuccagagccccgccucccaacaaccagccccgccccuuccaguagaccccgcccacuaccccgcucccuccgggagcggacuggggcucuuauugccuacgccgguucgggagccuccacgcggagaggcucccgccgccuagagcugcggccuccgcauggcauggaggaaccgcucucacccccaccggaguccgggcugcucucgccgcugcugcagggagguggagcggcugccgcuccagagcccggagcccggcaacacccgggacaugagaccgcggcgcagcgguacagcgcccgccugcugcaggccggcuacgagccggagaggugacgcccagggcaaggcgcgcgggcgcauccggggcgggcggcagagaagggcgcggcaacgccgggagaccggguagcgcugcgggggaggccagaggcagguccccucuacugccauugcacuuccccagacgcaguuagacugucauacaccugacucuuggcuggcggaugcaggcgggcacugugcaaacaguucagugccgcguuacuccggggagcuggagagagggcgcagguuguaauaucgcucccuaacauuuuaucuaagauccgaccuauacuacacacucagcgacgcuugguacaaguggcuccgaccucugggguacaaaaagugcuuguuggagucccgguccaacggcgcuuucuccucagcuuucuucuuccuagaauguauucaauagguguggguguccggauugagugucucccuaggacuaggggaagguacuugcacuuucucaccaggcacugagauccagugaggcggcugcuguucacuccuuggaaagacuuguaccccaaugcagggggucugaaaggcaaugaaugagggucccuggagaaagaguuggggcagugaacugggccucaagggaacgagcugaaaaaagagacagcggcuaaucucuggauuguaucgcaguuugaaaugcaauccuacuguccuuccgguccaggggauuuggacuucuuucucuaccccaucugcuggugcucagcagcuuggggaggugaucuggcagcuggguuuugaggggaggguggucuggggaauuagccagguaguucuucugcccaggguuuggccgcuuauguaagaacuuuuaacggcuuuuggggcuacgaagcccagccccuccugccguugcuggcugucucuuuagaacugacuuaggcuuaagcaaccugccauccguuuuucuauaauagaaaucuaguuuggagggcuugggguuuuagagaggugccacuauaugggaggaagcgggccacgguacuugugagcucgaaggaaacuaggacuguagaaucucagaguucaggcaggugcaucucuuuuucagauguacugcugcaucaaagggacagugccaaccccacacuucccgccccccacuuaggcucagaauggccuguguaaacuuggaccccagccaggccaguauaaaauccaaaaccugccagcuaagaccucuaucugccuccaccaaccugaaugaagguguaggaaaaggcaaggguucucugagaagcccuaggcuucaguccagcagcauuacuggucucucug

SEQ ID NO: 2869 - RNA, 954 nt, Mus musculus
cgaggccagccuggucuacagagugaguuccaggacagccagugguacacagagaaaccaugucuugaaaaacaaaaaacaaagaagaagaagaaggaggaggaggaggaggaggaggagaccagcaucacugaggugaaaucuucugggaagugcuuucugagagcacaaagagcuguguuccacagauaguaaagguuguaccuugugcuacagcuguacuugguaauauguaagagucacucaggugguacugguuuuaaaggcaugaaggagucauggggaauagcuaaggcuuagcacugugagaagccacagaaggccauuggugaaggugcagccucaggugcaguugaugacccaggacugaaggggccaugcaaaauguuaagacuuugugccauaaagggaaccuaugagaggcuguuggugaagccuacuugcagcgaaagaccccagcauauuggagaugccaguaccaugggaugaucaccaagaacaacagcagcaguggcguggggucaaccagagccuagagugcuacagagggcagagcugaagaugugaccuaaacccuuuggaggagcccagaugaucuuguguggaucucagacauuggaacaaaagcuguaaaguugaaauuaucuuggagaccccaagauguuagagaugccagagugugagauaucugccaaagagagcugcuaacagggaguggaaccagcccgagagaaaaguuuguugcagucaacaaagaugaaaggaguuggaaaucugaagaaugcuuugacguuagacauggagaugcaaaguuuggaguuugcccagcugguuuugguuuuguuuaguccaguauuuccacacuaugucauuuugaaaugguaauuuauauccugugauguuuaugguguguaucugcuugccuucccucugcauaucaaauauucaugguuu

SEQ ID NO: 2870 - RNA, 29895 nt, Mus musculus
cggggccauuaaccacuuccgguugggcggugcuugugcgcgggagcucacucccugggugagccgcagccacgguauccugcggcguggagcucccgggaaagguaaguucuguggugcuggguggguccugguucgcucuuauucuguccgucggcccuguuccccauucguaguggguguccucacuccggucucagugcaccgggaugggcccgaggcuccacucuggcccucagagugcgguccccgacuugcugucccgcagcucugcggaaaggguuguagcucccgggcccugcgcccuccugggcaccguuuuugugccugguuucgcgcguccuugaucuccuccccggguuccuccacucagugucccugggacuagagggucacuuuuguuuguuuccugaaggucggagagaauuggguagagaguuuuaguauccgcucccugccaccucgccggacucuugggagcugccaccccgccccaaggccacaucccgagaauugaguugcaagugccaagaaagaaaguguuagcugucuuacaggguguaggaacauggagaacaaaacgauugaaaacauaaugucauuauuuuuaaaacuucuuguuaauuagaaaagaacgucgcaguuuucuauguuuggcuggauauugucauuaauggaaauaguuuucacguguuaauuagggaguuaauuaccuuuaaguaaucacggguuuuuugcuugucauucccaaguguucugauuuuugauaugcuguauacagaagugagcuuaauuuuaauucgcgauaguugcuguaauuaagagugguuugcauuuuguaaaguuccuuuugcaugagugggaaagaucaguggaucugcuaagacuuuugguucuuugaucgaaauuccuaagcguucaaagccuuggaacaggguuuuuuaagaauugcauucacuuccugucaugaaccaucaagucagcauuaauaaguugggaaugauagcgcuccaguuuaauuuaacaugaagguagagugaccuggaguggcugauaauuauucuuugcuauaccugaaagcugacccaggagaaguauauauuugaccucauucaguuagauuuaaguaucgagcaauagucacugcuaaagaacuuguguucuucuguccaaaugugggaccagagagaaccuauuacuuguguguaagauaccuauuacuauuacuaugucugucugguccgacuaugaguuuggcaguguuucaggggucuccaacaggauauuuugaagauucaaaaggaaucaugagcucauaaaaaauauaaaguauguguguauucuucucaaugucauucucaaucaugguugggcgccauucauauagugauauguuaauugauguguuauaucauugcuucaguacaggagacuaauauguuaguauuagcuuaauuuuuuuuuguaacauagaugugccagggauguuuccggaauagccaggaauagucaugggaaaugcuugauuaagauccuggauucuuucuaaguucgaggccagccuggucuacagagugaguuccaggacagccagggcuauacagagaaacccugucucaaaaacccaaaaaaaaaaaaaaaaaaaaaaaaauaauaauaauaauaauccuggauucucucugggcgugguggugcacgccuuuaauccccagcacuugggaggcagaagcaggcgaaucucugaguucgaggccagccuggucuacagagugaguuccagcacagccagggcuacacagagaaacucugucucgaaaaaccaaaaaaaaaaaaaggauccuggauucuuucuauauaaacuugguuuuuuuccucuguggcuuugauguuguuuugcaugugagaaagucucacugguauccuuggcugaccuggaacucauuauauagagcagacuggccccaaacucacaggagaucagcccaucucuaccuccuguauacugagaagauuaaagggaugcaccaccacacccagcuuuucuaugaacuuuaaauauaaaugccguuaggcuguaacacauuagaauuaaacagauggaauaauauuuauguauggggacagguaaacccuaccuuggcaugcuuguggaagucagagagauggcucgugaaagaaagcucauucucacguuccaccauauagauccuuggguccaacucaaguuguuaaguuggguggcaaaugccuuuacuggcugaaucaucuugcaagccccuaaaaucacauauuugccuauaccuggcuuugggccagauccaguaauagaauuggaaguuggaaagcacaucaaagccaaauugcugccacauaucccccaauugauccaauaaaauguguugguuucuaaaaaguacaagacuuuagcuugggagcuauagagagacuuuuuuuuuaaauuuuuauuuauuuuauguacaugaauacacuguagcugccuucagacacaccagaagagggcauuggaucccauuacagaugauugugagccaccaugugguugcugggaauugaacucaggaccuuuggaagagcagcagucagugcuuuuaacugcugagccaucucuccagcccuagggagauaauuuauuuaacuuauguagcaauuguuucagaacugcagaaucuggugggugugguggcucgugccuggaaugcuagcuuuuagaaagcccaauugggagaauugccucaagccagaggucacuaagcagcauauggaguucugggccaguaugagccucagugagacccucugccuccacuccacuccacccacacaaacccgggaaagggaaaugucuuagccacugaggguguuugcugccaagcuugacagccuggauuucagauucaggacguaaauggugcaaggugagaguuguucucagaccuaagcccacauaugcccacaugcauguacaugcacacacacauacauaaaacagcauagcuuguggucauuauuguggaguaauacaaaugaguuucaagaaaaucaguacagcugggcagugguggcacacgccuuuaaucccagcacuggggggggggggggggcagaggcagguggauuucugaguuugaagccagccuggucuauaaagugaguuccaggacagccagggcuacacagagaagcccugucucgaagaaaaagaaaaaaaaaggaggaaggaaggaagaaagaaagaaagaagagaagaaaaucaguacaaacuucuuccaacuggcguuaucaaccaugguagcuaggucuuuucauccaagaucuuguuagauugcuuuucucccccuaagauauuaaaaugauuuaggcuucugacacugaaggaagauugggcuaaaauaauuacacauucuuuuaugcauauuaaacauaaauauacaguagaauccaauacuagacaccacagcuuuuuuaucccugauguuuugauagauuaaguuggccagugagucauauacuaaaauuucaucucagagaaccuuuccuacacacacaaguucuagaaccuuuuucuuguaguuuuuuuuuucuugaggugucauuguuugagauuuguuuuuauuuuauauuuauggguauuuugccugcauaugucugugcaccauauauugcaguuccuaaagaggacagaagagggcauaauuucuucuggaacuggacuuccagauaguuguuagccaccuuguggguacugagaauggaagccagagccucuggaagagcagucaauucacuuaaacacugacccuucccuccagccccauaaguaaguugauuguauggcuagagauuuuuaguuuguacuuaauugcuuugguuguagaacugaugauacucagcccucuuguauuucuuccacuugauugauuagaauguauugguaaacuagaguaaauugacugcacuagacaagugugaaaugauuugucauuaacaugccuuuuaagagauggagaguggaaugauuugacuugugugugacagucuaucagugguucuucuacuaacggcugcacuugaagaaugccaguaacaaggucaccuuuauuucuagauuuuacaucccaagucucaguauaguuaagauaauacuaucaaguuauuacccuugguuuccauuaaauaaaguagacuuuuaagcacagaguccucugcuccaggguggagaagugccuuucugcuggguauccuaacucagaaaacuggaauuuuaccaccacacccauuucucccacuugcuagcauugagcaaugggucuuugaucaaccagaguaauuguggaauuucuuagaauuaauauuucugaagggaugaauuuacuauagacaucuaaguugucagaaaggaugggugagaucaaggagacuuuauuuuugaaacagggugcauauagucaucuauaugaaauguaacacuucuaaucauaucuuaguuucuacuaaccacauuuuaaauguuuauuaguccaccuagcaaguggucaccguacuagcuagaccuuuucgguuuguuucaggacuuaaucuuagccaaagcccaggcuugccuagaggguaugacuuaacuguuuuuuuuuguuuuuguaacucuggcccuuuccaccuucuuguuccuuuugaggcaggcucuuugacugaaccugcagaaaccuuacccauucuccugucuucacuucccacagugcugggcuuuugagauaguagagauuuuagcuccggcccacaugcugacccagcaggcauccuugcccgauaagccaaaacaaacaaacauucggaauacaaguuucuuauugucuauugccgaguagacuggguagggcccuuggcuuugccaguuggcugguccugguuaggugcuuuauuuagugauaagauagaaaaccaaauuucaaagcggcugcagauggugaggagacagaaucaggcagcaguacagagaaugugggugaagauaagccugaagucaugaggcugucuggggaaagacugguuaguguuugggaaagucagaagagagugucugucauauugcuugggauuggaguuacagaccaagguagccacccuguggguaccgaggaagaaaccuuccuccucuagaagagcagcaagugcucuuaacucuccagucuuuccuuguucuuuuaugguugguugguugguuggugugggguuuuuaguuuggggguuuuguuuguuuuugguuuggguuuuuguuguuugguuuguuuuugguuuuuuguuguuguuuguguuuuugagacuggguaacccuggcuaucuuggaauucacuauauagaccaugcuagccucaaacucucagagauccucuucucucugccuccccagugcuaggauuuaaagcaugugcaucaggccuggccacuucuuuuauuuuuaaggacuuuuauauaagcacggucaccauuggcugugcuaaacaucuucuuaguuuuuguaauccagggggggcucuauaaagccaaauuaaugguuuaaauucauuaagcuacuauuugaggaugggggaaauggacauauugaggcuuauaauacacugacauuuaguuuccacaucccuaacacaguucucuuccuuuguucuacuucccaaaacuuugaagcagauccagagagagguguuuugggggugcaauuugauuaacagcuucucaauuagaugcuuugcugagagaauuuucugauuggauaaguauuugcauauacaugugagugcuuagacuaguuaguuucgauagugaugucccuaggaaaggaaaaccauuuguugcugagguuuaaucuuuagauuugggcagagugggcuggagagauggcuccgcgguuaagagcacugacugcucuuccagagguccugaguucaauucccagcaacuacuugguggcucacaacuaucuguagugagaucugaugccgucuucugauguguuugaagacagcuacaguguauuuauauauaauaaauaaauaaaccuuaaaaaaaaagauuagggcagagccauagauuuagccuucagaagauguagugucccugacuauucacuucuugcagauguaguaacaaauugcaacaaaccaagugguaauuugguuuuguuuuaauuacuacuugugugaguaauauggguauguacuuaugcaggucagaggacagcuuuguguggggucaguucuuucucuucaccuuaauguggguucuggggaucagauuccaggcuuuaaacaagaggcacuuuacccaagauggcucagcggguaagagcacugacugcucuuccgaagguccuaaguucaaaucccagcaaccacaugguggcucacaaccacccauaaugagaucuaacgccuucuucuggugcaucugaagagagcuaugguguaccuguuuauaauaauaaaugaaucuuuaaaaaagaaagaaaaaaaaagaggcacuuuacccuugagccaucucaccugucacugacugauuuuuuaaacugaaauuuauacccuccggcaguugagaaggcuaaaaguucggcacagauguugguugggccaucuucucuuugaaaggucuucccuuucucuucucaagucugguaguugucaacaguguuuggcagucccuggcucacguauguaucacuucaaucucugccugucacagcacagccuucuaauucuguguccagauuuccuguuuuguaggacaccaucuuuggacccacacuaaagaguaugacuucauuuuaacuugauuacaucuacaaggacuauauuuccaaauaaaggcacauucagagauaccagggauuaggcauaauagaggaagaauaagaaguauugugaaauugcuaaaaaacuuauuuucccugauagaaugguagcagacauucagcauuuccacaaugaaaagauuaauuaaaauaugaaagcucagggcuggagagaugacucaaugguuaaaagccuugacuguucuuccagagguccuggguucaauucccagcaaccacaugacaacucacacugucuuuaacucuaguuccaggggaccccacacccacacacagacaugcaugcaagcagaauaccaaugcauguguuagauguauaauaaauguaauaaaagguaugaaagcccaggaaaauuauuccuuuuguuuaauguuaagauuuuguuguuguuccuugagacuuuagccucucuaguaauaguauaaguuguuuauaaaguauauggaauugguuuuuguuauuuuuauuuuguuuugguuuucaagacaggguuucuccguguugcagcccuggcugucuuggaacucacucuguagaccagauuggccugaacucacagagguccaccugccucugcuucccaaaugcuaaguuaaaggcauuugcuaccaugccuggcaugaaacagguuuuuaacuguuaaaacagucaguuuuuaaacugacauugucucugggauuuacccauuuuucaguaguguuccagccuugugcuuauuagauucaccugugacuaugaucugagaauaagguggggguugggaguugagggggcaggucuguguucauggcaacacacagacacauguacacauagcucggaaucugaacuuuguauaguaccuggggucuuugugccugagcaagucugggaacugcaacuaugcagauagauaauguuguuguuacuugugaauggacauccagauggguuggugacaagauuaggcuauaugagagaccuggugcuauggggcaaggcagccacugugaaugugagugguucccgcuccagugguucugagucaccagaggagcuuuggaagccaccaaagccuggauucuggaggggugggacucuuaacucuuccaggugauauucuaauauucagcuguuugaagaccagaucacugacaaaagaacaaaagcaaagggccuacgucuuguccuuucaguuuuauuggcauuuugaauaaaaagaucaauuauuuuaguguuccuugaagaaaaacacuaaaguuguauuugaacuauaacuucguaauuagcccagagucguaaaggaaauagucccucuacaguaacuggaggucugauggccuacugugcuuaccuuaaggauuaaauaauguacuuggguaacauaaaagacuuagauauaaagacaucaaguuaauaauuuaagggagacauauuuugguuucuuccauguuaucaggcauacugcguucuucguuaacuaccuguucuuuuccuuuaugguagguuaucauggaccugcgucaguuucuuaugugccugucccugugcacagccuuugcuuugagcaagccuacagaaaagaaggaccgaguacaccaugagccucagcucagcgauaaaguucacaaugaugcucagaauuuugacuaugaccaugaugccuucuugggugcagaagaggcaaagaguuuugaucagcugacaccagaagagagcaaggaaaggcuuggguaagaugucuguucuugaccagggaagggguccagggguccagaggguugagaaacacuaaaaaccuuucuuuuuuuuuuucuuuuccuuucugguucagucacuuauaaaucugugccgagcucugucuucugaguacuaacaacagaauugcugccacuaaaaucuaauaaaauuccugcuuucauauacuucuccacugaauaacaauugcaccucauucuucuacaaagcaaaauuaucuucauaaaaguacccagugcggcacauacugcucuuucauaggacccagauucaauaucuagcgcucaagucaagaguuacccauccaucuguaauucaaguuuuagguuaucugaugcuuucuagacucuaaggacaccugcacucaggugcaaaugacaacacagacacacauguacacauaacuuuaaaauaauaauauauuuucccuaaaguaccaguaguacuauauccaguuuaagcuuaucaucuuaauuccagaacauuauauggcaguucuuaguucugcugcuuuuaauuuugaaaaaccuucuguaacuuauucauugagcccaggccaaguaaugcuuaagugccuaauaaacuaaaaauuggauuucuguaaaguugguguucuuuaauaaaagucaaggcaaccauuugaacagggguguccaaccuuuugacgaugcugucuucuacaacagagcuaagguugggaggacuccuuaauggaggagcgcuuuccuguacuugaucccaguaccuaagaaaacaaagcaguaacaaguaaagacaaaaaugacuuaccaaacaaggccugauuuucagaauaggagugguuuucagugacccugucccagucaaguuuugggguccuaaguagcuucuuacccuaaagacucacuagaggggcuggagagaugacucaguccccagcacuccuacugcauguguaacuccauggaguuccagggguuccguccaugugcccuucuggccccaugggugcugcacauguguggugcacagauaacaccugcaggucaaacacauucuuacauaacuuuuucucuauuucuuaaaucuacacuuaguagaauccuaccucacuguuucuagaguucuaaacaugucuuuuuuggcucuuucaaaacucugauuuuuaagaaaaugcaggucaauucugugaaaauauucuccuaaaugagaucauuguuuggcuuucuacacuguuuucaagagauuugugucgcaguggugcuacacugcuucccuuugccauuguguguaaugcuguaauuauaagauacuauuuuagaguuuacuuugauggaaacuuaaacaucaauuuauucuuuguguuacugaaaguguagcuaaaguguauacuguuuuauucuaagcacugauguaguuaauaaaaagauuuugcucuguagaaugaacugaacagaaacauacaccagaaaggccaauuuucuguuagguugcuuuucuguuuuugagaaacugugcuugcuuuuagcuuuaagcuucuaacugugcuaacauuuuaggcugaaaagagcaguggaugagggugcucucaggccuaugugucauaccuauuaauauucuguaugcccagccuacauuuuggucugaacgaaucucugcagaguuacucuuaaguaauggaggauggccuuuagguuuggagucacuuagcguauugaggacuuagugagccuccucuggcuuugcgggugguagaguagcuuugcuagcaguuuucaguagagaaaguguucauuuuuaucaguaacuaucaaaaguucagcacauugagcaggcuguauauuauuagaaaaaccugaugaagccauguuuuuaauacaauuuauaaaugaaguaaauuguuuguuuuucccaaauuuuagagauagugacagacauccuucauugaugcaaugaguaccuuggaagcaagaaucuuagguaaagccagggcagcacacacuaguacuuggggaggcuaaggaaaaaggauugcuaguucaauccuggauuacauagugugauucucuucccccaagagaaaaggaucccagauagucuauuguggcauuuuaaaacauugauuugguagcuaacuguucaacaaaaauuguaaaucacagagucaccccuuccuccccugucagucuauaauaguaauuauuaaggagaaaaucauuguuuauauaucauaaaauuaaaaccauuuuugaaacaucuaauaagcauuuucaggacaaguuuaguacauaauuuucaguauguuuuucucuuaauguugacaaguagaacuuuuuugugcuuguauuagcuuggguuuuuuggccuuuugagauaggaucucacugcauggagcaagauggccuccuucuuggggcuauuuguucacuuuugccucccaguucuaagauugcaggguauaucuccugggugcuaggauuuuuuuuuccuuuuauuuguuuguuuuuauuuuuuuuuuuugagacagggucucauuguauagacuggcuggucuggaacucaaagacucaccugucucugccacccugaguuuaaaggaauguuccaccaugcuuacuuagcucagugcuagaauuuuuagacacgugcuauuauaucagcuuuuuucuacuuuguuauuuaaaagguggaaugguauuauggucuccaugccugcuaagugaacucuguaccaacugagcugcagucccuucagaucuguuuuauguguaugagugucuugccggcauauaugugugugcaccguaggugccuagugucuguagaggucagaagaaagcaucagaucccugggacuggagcuccagauggcugugagccaugauguggguuuugggaacugagccugcagccugugugcuuaccacugagccgucucuccaacccuuaccuucucucagaaggcuguuuguguguacacauacagcaggcuguguggcuugugagguaaaaauguuuacucuuuccaaaaaggguuugccaaccccuggauuaacccauuugguguuuauaugagacagaaugcugcucagccugaaccgucauaugccuguuuuaucugggcaguccuucaggauacuuauuuauaauaccuuaaaaauaucuucugggguuggaagggguucugauacuucgcccauguuuuuuucuuaguaguggugccauugguagcaaguaccauauagauaaugcagaaguuuucuuaaucugcugauguuuuuaaaacucucugauaaaauuuacccuguguccaugcagguggggggaguguuuaggagaugccaucuugcuacauucccuuuccugucaguguuguagggcugagguuagaagagcgaacauugucugagggagagugcuagcuagaguguagaguuagguaauggagcuaaggcuauaucaguauaaaucuguucuauguuauagucuugcuaggaagaacucggaguuauaaucacuuucucgugcucuaaucaugagacaaacaagagcuaagaaaaugcauugguuacccacauguacaguuucccgucaggcauaggagugugcugauuguugacuuucuggaggaucugauacaguuuccauuuuaaaccgcacugcuuauugugugacucugcauagaccgcugagcccucuauaaauaggaaguuacaucuuugaguuuuuauaucaugagcauuuacuucguggugcuagaggucaaacucagguccucacagaugacaggcaagcacucuacuccugagccgcacucaaagcacagugacuuacuuuuaaauccuuaauuaaaaugacauauauagaagaaagguuauaaaggaaguagauccauucuuuauuuagcuuuguugcuuugcuuuauaaucugcuucuaauaacccucucagcuuauuaacagucuuauaaccaggaauguauauucuuuccauaucauuucuucagaguacuguuuucauggauggagauacacacacacacacacacacacacacacacaccaauuugauguaacucauaaaagcuacuguuauuuugaaaauuaguaccucuguauuuauuuguuuuuuuuacaguuauaccauaaaauauauguaauuacaagagagcuuuaaaaaaaagauaucuauauguuuuaacaaauauagcucuuuucuaaaagcaacuaacuuuuaaagucugguuuagauaucuuaaguucuaaggaagucauuauagugcuugugauuguucaccaagagguauaccugcucuaguaaacauagugaagaaaaacauaaagauuuccaucaugcuugaugcaaaagugagaacccagguggaccagguguucagaucagacucaccuaacuauagagagaggcuggaucacuggccgugaucuguucaccuuuuccagauggcuuauucaagccaggaacaggccaacaaagcgcaaaguauuccauuguagaccugggcgacacuccuggcuauguccagagaccugugguuuuuuaaucucuugcuggauuucucugcauuuucuacagaaagauuguaaguaaaauagaugacgacaaggauggguuugucacuguggaugaacucaaaggcuggauuaaguuugcacaaaagcgcuggauucacgaggauguagagcggcaauggaaggggcacgaccucaaugaggauggccucguuuccugggaggaguauaaaaaugccaccuacggcuacguuuuagguaggucccuacuaucugggggaaaaagcuuuguggaccuggcccuugaaacacaacuguuuugucuuguagaaugauuguagauaaaauagacgcggauaaagauggguuugugacggagggggagcugaaauccuggauuaagcacgcccagaagaaauacauuuaugacaauguugaaaaccaguggcaggaguuugauaugaaucaagacggcuuaaucuccugggaugaguacagaaacgugacuuauggcacuuacuuggguaaggggcgagauguuagguuggccgagacuguguggucuugagucaaagaaacaaaugggucagacaggaaagagggggacacugcuggacuucaauaguuugauucugaguugacuccccuuugguucauuguuuuaaaauuuguauauuauauguuuuaaauuuuaauuuugguccucugaagucuugagcacugcaaauauauuugccuuuuuuuucuauaaagauauauauauauauauauauauauauaccuaccuaccucuuuagaguaaguuucauguaaaagacuguauugguccagcagugcagagcaagaggccuugcuuugagguuuuuuaccauggcacuauucaaauuuugggccugaaauucaaaucaaauuagauucuuuuguaacuggugagaauacgaggaaacuacugguaaugaaugaaauaaaacucaaauaagauagguaucaguauauuaugcuuacugacguuuacaagugaaaaucucccauuuguuuucucuggcaccugaguuuuuaugagccugcuuugccaaugcuucaaggcagauguugcuuugauugcuuuguuauugauuugguagccuuuuuguugugggggccacugguuaauaaguuuuucuuuggcuuggaugcuuuucugcuugccugcugcugaacuccagguggcagucuuacugagccaaugagcagggcacuuguauuaaucgagacuccugcguuguaaauaguuucaacuugagacaugaauauauaaaugguaccuuuuuuguacuuuaauucuagaauuaggcaaacuggaauuucaggaaacugacuaacaaggagcguguaaagguccauuucccuaccagauagccagcugucuaugcuaauuacaggaccgaaugcauuucuggugaagagacuuacuucuguauugggccuguucucauuccuaagacuaaaguggcagucucucggggcuugacauuuagccaagaaccaaacauacccacccaauuaagaacauguguauuaagaacccagcacagauggagagcauuccacguuucuugcccucuggcugaaacccaacacccucugagucaaucagaauuaauuauaaauaugaagcaaaggauagacuagacuauccgugaucucaacaaaaugguuugcuaauaaaucuaugcucaggcuuagguacucucuugcuguccagaauucugcuucaacuguguauaauuaugugcauacaaaucuguugagagcuuucuugcaucacagggcugaugauucaauguagugggcauuucuacagccugagacaaagcacaaggcaaagcacuggcugaagaaguaaugucuuuauaaggccucuuucccaggagggcuguggggcuaacaaguuggcuuuagaaaaguguugaggaguuuugugagaauguguuauugauucaaucugaguuuguguauaaaucaucucagcuuuuaaaggcuauucagugguuccacuuuccacaaaaggagcguuuguacuguauguacugucugucuaauaaguaaaauaaaagauaccaagauuggccagaggcuguaagcaaggccagcagggacuguaaaccggugcuugggaaaguagugugccuucccguuucuguucuuuuauaggaguguguugcugucaggcuacuugacucuagucuccauguuuuacugcaaggaaggggacagagggcucuuaaaaaggagguccagucugaaugcauaaguugaguuauaucacauaauuuuacugaaacuguuauuuguuuuaaaacuacaacuuaguauuuaagaaagauguuuuuucuuuccauccuccaucccuaacauguuaugguuuugaguuuacauuaugcagagucccacggccucgugugauuccauacuagugcucuuuacuaaauuuuugacaaucaacaaaagccacuuaguuuucaggauaggacaguuuuuuauuuggguuguuuguuuguuuguuuguuucucuaguaacuuggauguuugcuuguuguagggggaguccauuuuguuuuuuugagacagggucucacuauguaccuuaggugaccuggcacuuacuguguaggccaggcuggccuugaacucacagagaucugccugccuuuaccacuuagccucuggaaugcuagggugaaaggcuugagucacuaugcuguuuguuuguuuguuuguuugaguguguuuaaaauacaaaaagaguggccucuaauaucaaaagucaacaauaugguaucauuguuaaaagaggccagugagcuuuuugauaaguaguaccaugccuuuuuauuuagcguuucaggaacaauaacuucuuaccuuuaauguguauucucuacuucucaaaccaucuucauaccucugagauccuuuauauguuuucauuguacagaaauuaaauuuuagucuccuagauacuucuguggaaaccagcugcugcuuguauaacuuagauuguauaacaguuagauuguucuaugucccacuugguuauauuuugauucuuuuuuuaaaguauguauguauguguguguguuucuguguauggguaugugccagaggaggccagaagaggguguuggauccccuggagcuggaguuacagauaguuaugagcugccauguggguguugggaauugaacccagguccucugggaaaguaacaagugcucuuaaccacugagccauaugucuaguuucauauuuuaguauuuauuuuuuaaugaaaguuugaucaaaguauaauugacaccuagaauguaucuaucauuucccaaaaauuucuugugucuaaacuuucccucugccuuuguuccuaauccaucauugacccguaacucugcaucagucugcaucuuuuacuuguaauuuccaguagauuuuggcgggggugguguuaguuggaccauucaaaauggugauguucuuuuugcuugagucuuaaguguccuuaaaaugaaaugggucaaaagaccuuugguaccuagagucuuaauggaaguuuaacauuugauaaaaauggugauagcugauaguuacugagugccagcuauauauaccagguguugcucgagccuuuaguuuguuugguuucccucccucccucccuccuuccuuccuuccuuccuuccuuccuuccuuccuuccaagacaggguuucucuguguagcccuggcuguccuggaacucacucuguagacuaggcuggccucagacacccgcuugccucugccucccgagagcuggagcuaaaggccugcaccacugcuguugccacuaccaccagcuguuugguuuuuuuuguuguugguuuuuuuuuuuuuuguuuguuuguuuuuuccagacaggguuucucugcauagcccuggcuguccuggaacucacuuuguggaccaggcuggccucgaacucagaaauccaccugccucugccucccgagugcugggauuaaaggcaugcgccaccacgcccagcucagcuguuuguuucuuauuuaaaguuuuuauaaccaucaguaaggcaggugaaaucucauuuuacagaugaggagacugaaauacaguuaaguuucuugcccaagaacuggagaguuggcuaggcaaucaagagcacuuguugcucuggguucaauucccaacaaccacauggugacucacagccaucuguaacuccagauuauaagccuaaggcacuuaaggagcucugguguccuuuucugaccugcaagcaguagccacauacaugaugcaguguuuugcaggcaaaacacucaugcacauaaaguaaucaaagaagaaagaaaugccccuuguccaaggccacacagcuagaggugcuaauucacacucagacaauguaacuuagagucuccacugccucccagauagacacaagacauucaagucuucuacuaaccuuaacaccaguagugcugagaccgcacauucugaguuagguagucaggagccaguucuguguugaguggcagcccuuuaccuucagcuuggaccugauuuggaggugugaucaccaaagcuuuaguucaaaacaaagugucuuucaacugcugcuucugaaaucaaaagccauuucuucaugcuugguuuaacuucaccuggauauucauuguuugauuuaucguuugugagaucugccuguucccuuuacuuuuuuguguuuucgggaaguuuuuuuuaagauuuuuacacaauuuuuguuuucuagaugauccagauccugaugauggauuuaauuauaaacagaugauggucagagaugagcggagguuuaaaauggcagacaaggauggagaccuaauugccacaaaggaagaguucacagcuuuccugcacccugaggaauaugacuacaugaaagacauagucgugcaggugggcgaggcgagggucccggcagcuacggcugcagcccagcuucuccugugcccaugcgcuuacucugcucugugcuugcaccgugccuggcugugcaguggccgcacacugaagcuaaggagcauugcugcuuuucuucaguacccuagguuuaucauaacacugucuaucaaauaauguauuuuuccacuucauugcuaugucaugaaguuaaaaauuagaggaaaucuuauuccaaauauccugugauugguguucagaagccaaguaaugacaugacacuuaggaguucucccagaaggcagaaucaucucccucauuagcaagaguucagcaugacuagggccacagucuuugucauuugguaguguccuccaaaggacucagcuauucuagguagaaguaaaagaaauugcuaguauuuaccuauuuucuaacuaaaaggauauggguuucccucccuccuuuccuucauuucuuccuuccuuugauuuuuguuuuugugugcauuuuuggcugcaguguaggcugguuuaccugcagcuugggaaugaacacugguccucuuugaaccuccugucucugaccuccccaaagugugggauuacagggguuuguugucuugucugauuuuaaccauacacaccauacugucucccgggcaguuccauuaaaaacuagaugucuucuuguucuuuucuacuuaggaaaccauggaggauauagacaagaaugcugauggguucauugaucuagaggaguacauugguaagucuccuguuuccaguguccuuaaauaccgaaaugcuuuggaaguuguaaucaucaauagaaaucguuuaccucauggcucaacucuuuuuuuuuuuuuuuuuuuuuuuuuuaugguuuuuugagacaggguuucucuguguagcccuggcuuuccuggaacucacuuuguagaccaggcuggccucgaacucagaaauccgccugcucugccucucgagugcugggauuaaaggugugugccaucacgucugucuaugggucagcucuuaacagaugguucagacagacugauguggcaaauaguauaacuugagcuggauauuuuagauuaguacaucucaguuuucaccugaggagguccugaguuugauuuccagcacccacacugggugucuguaacugccucuaacucccacuccagagaaucugaugccuucuggccucucuagccgccugcacucauacaugcgcacaccuuaaaaggaugcacagaugcauacauacacacagaguuuuaaauaauuuagaaagaaagucuaucagauagacugaugggaaagccaaaugcguggugaugcauuugucaggaacugcaagaagaggaggaguccaaggccacugaauacaagaaacagaaaggccgagaggauggaaggccacccagcagccugcucacuguguugugcacauuuucugucuaaguccucugagaaguuuccauuuuauuaggguauuuauuuuggccauuuuccguuuuaguugucacuauaagggagcagaugagggcuacaaaugaaacuugagaggagauugaaauguuuuuuuauuuuuugaaauuauaucucuacaauguaucauaaucaugucuacucccugguuacuuguuuguauuauccuuaauuaaaauugcuuuauaauucuuuuguuacaaguggcauucuauuuugaaacagacuuuuuuuucuaauacacaucuuuugguauauugagaacaggggcuagcuacgaauuccuaaccguuugaguuguucuagucugauccuaguuuuaaucccuuaucagcugaguaguuuguggccacugucucccguccugcugguugucucuucccucuauugauugccuccuuuacugagcagaaacuuuguaguuuguaugauuucaacaaacuuaguugccuguguugauaaagugccuccuguuacucuacugaucuuguaguuuaggguuuuauaucugaucuauuuggucuucuauagacggacacccagcuuuuuaaguaccauuugcugaagagguuauccuuucuuucuugaaaaucuuguggcuauggauauauagauuuauucuggauucuugguucuguuguacucuacauuggacaguaacuuuucucaugaacuuucugcuuuuguguuucaaucucugaucaucaucucggguauuaacuauuaagccugaaagagagucuugugcuuacaucuguuaccgucgugaaugcugagcagugucccugcuggagaagcaggguggcgggugagagcugugugaagugauggagccucuucaugacaggcucuuguguucuuaacccaaguugauguuuaccacauugucuacuucuaaguacuuuaucuuuuuauucuuggcuuuggcauuuuguugccaaaaacaaaauuguugccauuugaaacuucuaaagcagagaaauucaggcuugucacaguuacuugccaagcacuggggcccgauaagcagauacagguuuucuuuuucugcauccuccagauucaagggccagagaaauuacauuucgaaccuguaaaacaaccaagaaugugugugguuuucuuuugcaaguuaguaacuauugcaagcuugugcagcagguacugggguuuauagacccauauauucuccccaacagugucuuccagcuugaacacaugcacugguuucugcccuguuagaaaggugaagacacaucuguccagcccccuuuacucccuuucuuauuuggcccagaucuuagucaccuuaccauuuuaucuguaagcauuacauuauguaucuccauaguacguuuauauuucaaaacuuuuugaagauggucugaaccaaaaaauuaauuccuuagucuuaucugguagauugaauacuuuuagaauaagcuaaaaaaaauuuuagaguaagcuaagauauuuuuugauaucuuuccucauauaccuuuaaaauguacuuauaugauauaguuuagcuucuguuuuuguuuuuauucuuugggacauugggacagcacuauuaucccagaccuaaaagaaaucucugcaaauaccaugcacuuacauauuuuaaaguugucuguaaaauauuuaauucgacuucuaaaagacuaauaaagugaggcuggagagaugacucaucgguuaagagcacugacugcucuuccagugguucugaguucaauucccagcaaccacaugguggcucacaaccaucuguagugagaucugaugcccucuucuagggugucugaagacagcuacagcguacucauauauuaaauaaauaaguaaauaaauauuacaaaguggguguggcagccccugcuuguuaucacaacacuuaggcugaggcaggaggauuuugugagguugaaauacaccagcucuuaaaaaguaauucagaaguuuaaacuuggaauggauauuagaugaugcacaggauuggcuuuauaaacugugguaauagcaucaugguuauguaagaaauguccuucauuuguaaagcuauauucaaaaggacauggagauaugugguuagaauuugcccuaaaauaauucauuggggcgagggugucacaugaacauauggcagaaacuggcagcuauugaguugaugauggcuaaguggugggucuguggacuuucuuuccuacuucuguaggaaaguuuucauagugaaaacaaaagugguaaguaggaugcuggucucaaugccugcauacgugagcacucaguaaauguuaauggcuggauuuugaggcggggugccacuauguagcucuggcuaucccgagacucacuauguagaccaggcugcucaacaugccccugccuccugccaucugauuaaaggugugcaucaucacauccggcuguuauuuucgcauucauuaguuguuaaagggaaaauaguacuuugaguuauagaugcaugcauagaggcaaauauguaaaauauauacauauuuuccuucauuaaacuggaaacacauuuauuuauuuuuguugauguguauguguuagguacuggaggucaggcccagggcuuugacucguuagguagggucucugccacucagcucuaguccagcccuaugucauuucuuuguuuuguuuuaaacauuuauuuauuauaugcaaguacacuguagcugucugaagacauaccagaagagggcgucagaucucauuacagaugguuaagagccacuguaguuggugggauuugaacugaggaccuuuagaagggcagucagugcucuuaaccacugagccaucucuccagcccccucuauauauaauuucaaaugccaauauuugguuggcaacacuuaaccauuccuugauugcaguugauuuuuguuuaauuuuguagggauguucauccuguuuaccagucaaaauauagacagaaauaguguugccuugagaaaaugaaaauauaaucuauucucuacuauuuggauuuuauuuauuuuuauuuuucacaaacauauuugugguuuuucuugguuuguuuuaucuuggaagcuuuaauuguucugacauaauuacuugcaaguuuauuguguaucuaaauuaaaauauuguuuuccagaguuaagcuuaguguuuuaaaugucuugacagaucaaauuguucuuaaauuguuaauacagagcugaguggcugaggcaggaggaaugucuccaguuuaaggccuaucuagacuaaaacccugccucaaaaccaauggaagaaaauagcacuuacuguacacaugucaccauaaaaaaaaacaaaaauauaucuguuaauuuuuuccaucuagcuuucuauuuguaaauagcauuguaugucauuacccugaacgaggucucaggguuaaagcugcucucacagaggauccaaaauugguucccagcaccuacuucagauagcucacuacugaacuaccaccgaaacucuagcuccagggcauuagacacuaccuucugaacucuuuaggcgccugcugccccacacaugcaggcacacacacauaauuaaaagaagagaaaccacagaagcccugucuguagaguggagauguguggcagccaugcuuuguucuccuagugucuuuaguucugugccaaaauuuaugauguaauucaucaccaaaauuguguuuaaugaucucauagcuaaaauuuagacuguuuuuguuuuauuuacacacaaaaaauuagaagucucuucacaugugaaaguauuuguuaacaauuuuccugccugucugccuucuaaagaccaacaccacuguuuuuaaucaucucuagagcuucuucuacucuauuagguuucauuacaagugaagaagauggcuauucuaagaagggaaaccggguagaagccacauuguaagccacauuguaagagugcugaaguugagaaucagggaucugauucuuugacgguugucccuucucaguguacucuggguguucuucugcuuguccugacugaaggccacuggcuuagugcacuuagcuagguguugguuaguaagugcaguuuccuugagaauuuagaauucuaccuccuuaaaccagugcuccaauauacuuagucacuuggggugagaugcaaugcaguaagaaaggaacucuuacuugguaccagucaacuuaauuacuuuuuauuuugagacaaguucucauguagcccaagcuagcuuugaaccccugccucagccucucaacgugcugagcuuaacaaaaaugcaccaccaugcucagcuucaccaccagaaauacagagauacaggcucugcuuuccugucacucagucagcagcugggaauacuauuguugaaagaugaacaggaaacacaccuugcuuucuuuuuuuuuuuaauacauuuuuuuuaagauuuauuuauuuauuauauguuuguacacuguagcugucuucagauacuccagaagagggcgucagauuuuuguuacggaugguggugagccaccaugugguugcugggauuugaacucaggaccuuuggaagaguggucagugcucuaaaccgcugagccaucucaccagccccacaccuugcuuucuaaagccucucuggcuugagaaaacuguggcuguuacugggugccaagaaggacuaagccagauugacagaggcagccuuuggaccaaaccugauuccucuguugcgugucucugugcacaggugacauguacagucaugaugggaaugcugaugagccagagugggugaagacagagcgagaacaguucguggaguuucgagauaagaaccgggaugggaagauggacaaggaagagaccaaagacuggauccuccccucagacuaugaccaugcagaggcagaagccaggcaucuggucuaugagucagaccaaaacaaggugaguuguuccaggcccaagcagucuagcggcguccaaagguuuuucuaggggguugccuucaacagauuucaucaaaauauacagaguauuuuuagagucuuaauuacuguaagucugcaaggaccuaaauuuaaugaccagaagucuacggguagcacugucuggucucauuuuggaaaucuuuugcucugugcucguaguguuggagaaaccugaagugcagcagagagcauugauauagaaagucuaacccagaacacaucaccucuaaguguugaauccccagauuuucuuuuuaaaaaauuguuauuuccugcauucuuuaccuacuacaggcucauucuuuuuuguuuuuugguuuugguuuuugguuuuugguuuucgagacaggguuucucuguguagcccuggcuguccuggaacucacuuuguagaccaggcuggccucgaacucagaaauccgccugccucugccuccugagugcugggauuaaaggugugcgccaccaccgcccggcuacaggcucauucuuuagugccaucuuacaacaaauacacacacauguauauaauauuuuagaacaagacagaaugacugacugacugacugacugacugacugagacucucaauauaaagcccuugcuggcuguccugaaacuacaguguaaaccagccuagccuccacucacuugccugugucucuucaaugcugagaugaaaggugugugccaccauucccagcagcaaauagauucuuaaaauuuaagcccuuuucauggggucauaagcuggcuuuucucuggacucuguuaaaauugaaaacugugugaagugcuuagguaaucaaaucuucacuaagcucugucaccuuuccagagagcugcauauugaagaccagaauuuuugcuguuuugaacauucuuuaagcuucaggugcuguuucuuagaaccuuuuuuaaggguggaccaguucugaguucuugcucagcaucacuugagcagccagcugucaggcccugaauuguguggagugagcagucuucuuugaagagucuuggugcugauuaagaugagcgacugagccuucuuuggguguggcucaucuaguuacaguggaggugagauaagguuuggcccuggagaauucacuguuccuguuacaccuugguauuaugcucccugaaguaucagccuaauguuaguggccauuccccacccauaccuagcagcugccccauagcugccuucaaagagagcagaucugcaacucugcccucaaguuguugaguacauuuggccugccauuucacuuuuggcuuuuuuuucuuuucuuuucuuuucuuuucuuuucuuuucuuuucuuuucuuuucuuuucuuuucuuuugagauagaaucucccucuguagcccaagcugguuuugaacaauccuuccuucugucuuuacaaguucaggggucaaauccaggaccucagucuuauaaggcaaacacuuuacacggaaccauauccucagcucacuaaugacuuucuugaugaaguguguguguguguguguguguguguguguguguguauguagaagggauaggggauagcauguuuacacacguagagggaacuaaaaccuuaaguuauuacagucucuacuauuuuauagcagucuuucugaauuuggaauggcaaguauauggccucaauucacuguucacucugguuucaggauggcaagcucaccaaggaggagauugucgacaaguaugauuuauuugugggcagccaggccacagauuucggggaggccuuaguacgacaugaugaguucugagcugcagacagaggaaccuacauuucuucaaaaguaauuuauuuuuacagcucugguuucacauaaaauugcgcuacugagacuguuauuacaaacuuuuuaagacgugaaaaggcauauugagauagugaaaucacccguccccacuccuccucccucugaggggcuggagggaacccgagcuuccgaggaacaacucugauuaguacacuugugucuguagguuuacacuuuguauaauguauaacaugguguguuuauuuuuguauuguucucuaguuggggcuauacuaugaaggaucgagauccuccacccacacuuguaggcagauauuagcauuuacacguccucaauccuuuaccauaguuuuuauaauucucacuuaacuaauuuuuuuaaagccugagaucaauaagaaauguucaggagagaaaaagcaaaaggaaaaccaugugugucaggaucgaugcuuagaggagaaugcuuucucuugccuguugaaaagucucauugcaugaguugcugcucgguugucauaggcccagccacugagccugccauugucugggcaacgauagaguccugugcuguaagacagcuugacacaacucgaugucauucuuuuuccccuuuaggacuagcuguuuucuaauuuugucagacacagcugugcuaggaagaauuagggccagugucuugaaaaaucaaucaaguaguguguaugaugucuucacggggcuauuucuagcucuuuauagagcuguuuccaacuagaaacagcuggaaaacaagaagaacaaaguguaugcagggcaugcaucuuacucuuacuugaaaucacuguaaggccccauccagccccuuucuaagaauuaaccuugguuuuacugcaguuaaaguugauucuuuuccaaucaugacauugaaagugccuuuaacaggaaaaaugaucacugaaugggaauuggacuaagauaaacaauuugggcaccuuccaugaaagcauugaacuuccugauacagugggguuucccccuuuuucucuugagaacaggagcuaaauagcaguauucauuacaagcuugcuugcaguguucuuaccuugugggcugguuccuaaaccucacccugcugauuggaccagggauccucauaccucagaaggcaaaccacucuucucccaggccucugcucaccagggcuugagcuuugccucaaggauagaaggauguacagagggggcucuugguuugaggaccacuugagccguuuucucaucucccuuucucucugacacaaaaaggugggguuguaggaggguuguagaucaucauguugccauccuuauuaaaaauaaucaucaucaucaucuguugccaacuccauucaccuguuuuggucucgaguugaugggccucuuaagaauuauuguaccccaagucuuuaacccucagguuacuaagaugaauacacaucuguauaaucuuuauuacuuccuauaucucugaacaacacauucagguggugcugggugauggccauaucugaaccuagacuucccuuuggucuuccccaauccaguugaggugggcggccuggugugguaaaagcccaguuguggugugacuucaccuuagccauugcaucaagcucuugauagcagauacacucuuacguuucuaaccccagucuaggaguaaugaacaucacugccuuccaggcccucaacuguauuguuaaggagaccagagauaaugaaugccaccaacccuggcuuagaaagggcaggucacacacuguguggcaagagggcauuacagcucauuaggugcacagagccuaaugcuagcgugaaagucacacacuuauccagcaagcugagucugcuaggauggcaucuucuggaccugggugcucagcagcaaaaacugugcucuaaugucuaugagccccucauaguguugggguuuggguguggguuucugguuuaaaucaagucugaggcagugagcaguggucucaugucuauagagugugcccugugaaugcuaagcucucuugaauuugaguauugguucuuuuuuuuauagaguguaaaccaaguuuuauauucuguaaugcaaacagguaccuaucuguuucugaauaaaacuguuuacauucaucaagggcuuaugugucuuuuauucucuuggaaaugugauuauauuccaggucagccaaggcugcauagagagacucugucucaagaaaccaagaagaggcugaagagauggcucagcauuuaagagcacuguuugcucuuccucaggaccuggguucaauuuccagcacccacauagcagcuuacaacugucuguaacuccagugucaggggauccaacacucacauagucacacacacuggcagaacgcugaugcacaugaaauaaaucaguaaaaagaaagaaccaaggaagaaagacauggguuuaggguacuaugauaaaaugucagaaaaggaauuuucccaacuccauuuaccuaucaaugggccucuuuaagaauuacuguauuccagccuuuaacccucagguuacuaagauaaauauacaucucugugaucuuuuaucacuuccauuucucccucacacuuaguccuuugcuauuccugagauuucuggcuccuucucacagcuacggcuuuccuaccuucagugccugauaucaguacccagcacuccuugcguauaacucaacacgcacuucuucguuucgaggggcuccuuuuccaggagcagcagguguaaggaggguauaaaguaagauguuuuuagcacuugggcuugauuuauaaaugccacugaaacaugcaaauucauuuugaggacaucaagagauuaagacacuaacuuuaaucaacgcauagcuuuaaauggauacauuuagccaaaugaaggggagaacaccuagaauaacucugugucagauaaaugaggugaggccauucugauccuggcagccauagcccagacugcagcaacugggagaggccacauaaggaagcucuucgauucacugcaggugcccggugucugcugccuuuucuuggcacugccccaugccaagcuuauucuaauacuggauauaucaucucagauccccagcagggaggagaaaaaaaaaaaaaaagagcaaaaaaggaaguguuacccauacaccagaaacgcagcccuucucucacaguucuccagaggugagagugccacuuagaaacugugacuguuaaaaugguccauguggcccugcuacaggcagagaguaacaggaaaaugaaggugacucaccagagugccaccacuccccaucuuuccccuguuaaugguuaggauucuaguggagauguagauacuuaaauguggcguuguguuugcugcuagcaggccagcugaggggccucagugagggccaacuuugcuagaagagacaguagaaacuucuguuuucugagagcca

SEQ ID NO: 2871 - RNA, 11800 nt, Mus musculus
uugggcgccagcccagacgccggaccuggcacacccuugucuaggccaccuuggcuaaccuacugcaucuccuuccaucuggaaaggcagguccugcccugucucccuuaagggugauggugagguaggugauggagcguauaaaaugcucuacaacagaaacgggugauugugguaaccuaagacgggaggggggugggguuguagggaucgggguggagcuggaggugggagggguuggggaugggcggagaugggcgggguggaggaguaccuaacagaagagaggccuuacugccugcugcgggccgggcaugugcugugugcuuuaccagucucuuaacuuuggcccauguucucugcuguaagacaaggacacucgccugcacuugccaugugcccaccuguuacaagaaugcuuccucuugccuagcuucagccucugcugccaucugcaucugaagucgcuuuaaaugcaggacacacagcuucucggacuuucuagaaaacuggagacaggagucuguccucacacaccuccacaccaaacagccccugcuggggguggggguggggcagggaagcugcuaaguguuaacuccaaaaucaguucuuacugaugacaggagaugggguuugaggccaggcuguggcacagccuuucaauugaggcucgagagaggaggccgaugucagcagggauuauguagcacauuucaggcuccccccucccccggggggacugcauggugagacccuaucucaagaagaggaggagauaguuuguucuagagccaaauaugagagaccacgacccaagaacauagaaucagguugccuuaaauaccauuuuccagagugguggcaguuucaugaagcuuuuauaguuauagaacaagaacguaagcaauccgagucccuuucagaugcacugaugggacuauaagguggauagguuagaacagagugggggacaucucugcugggguuucagcugcuaucugauggcagucuuagucuauggaugguggaagcuaguggucuguuaauacaucucaaguguuucaagugauagucacaaggguacuaggucagacauagaggugggcaaugaauggcuauuaauguggaucaagacagcucaagauaauuagccucagaucugcaacauuccacuauuccauaguuacuaaagucuucaguccaacguccuuccaacuaagcugcuguggcagcuagcacaguuacgaaguucugaccagucagucagucucacagaaccuuuaacauaggcauagcuuguuucugagaacuuccauucacaggacgaugaucuacccacagccuaaggguacaugggggggggggggccugacaggugggaaggauccccaaaaaggugagaucaugguucagaugcgagggcccuguaggagaagcaguggucuuagcccggccuauuucacaccuaacacacauggaacccuugcuugcuuuuggcgggggcuccuaugaguggggagcuccaugggggcaaagaucugucuuaguggucuuugagucuaagcugugccuggccuuuggcaagccagauggugccaguggcucucagcagaucuguaugccuggucugcuuaagcacguggcaggaccaaccuuacuggauucuccaugucacugugccuacaguugccacuuagcagaggucuauggaaggaauaaucgaaagucccaggcacaugcacacacaaaagaaauuccaaguggaaacagauguucagggaaguccugaguagagccccacccugugaagugauaccuuugaagaaugcgaacuggccucacuucugugaguggacuagccagcuuuccuuggcucccagguuguuaaaguuauauuaugaccacucaggaguuucuguaccauacaggcaacucugcucacuagucacaguggggaguggcaggggagaagggcucauuuauucucgaacccgagaggcuucuuccuguagcuauuccagcgcuucaacuggcuuauaaauacaacucuacucaacaugucaucccaugaccucagcgcacauucuugacauuguucuccuuggugggcgagggggucuuugcugaagauguuucagagcugaaacuccacuuaggucacaggcggugcuuuuggguggggcagggcucuggauuuggggcagguuuguucuucucuuguggccuuuauggagcaucauacuguucacugaaugcuggccaucucaucucugcaguuucccaugcuuucaaauccuuccugcacaggaggaagggaaggggagcaggagagagcgcccugguagaggaaguccaccagcaccugccuucgguuuagugccagacuuaaauggcugugcccuggauucaugcuguuagauuccaggcucgucaugguucacauguuucuacaugugaaccaaauuuucuagagaggcuccuggaugugccccuggagcucccucauuuucucccaagcuugaggagggcuuggauguugcgucugcucucgaccagcaagaacgacacgaccaccaguccuucuaacagcaguuuauucagcaaacuucagucuucuucucucuucuuucucuuuaucuauaucucccacuaacaauaauccucucucgaauaauaauccucucucuaacccaggccucucacucuuauauacucucagcccucauccacucacagcaggccacaucaccucaccagguacacagcuucagcuaaucagggcagcaggagcauaucuccaccaaaauggauucgccaguauccugguacaccugcgcagcucucaugauggucguggcuuauauucaggugcaagucauaagacuuagcugcagucccuggcgccuucuugggacugccgccacacccgcuccucacacuuggggacccccccucauauccaguaaagcaugucauaccauccuuuuuccaaucaugugucuggagaaucuuuuuaaaaagauuuauucauuuuucuguuuauuuauuuaaugaauaugaguacacuguagcuguacagaugguugugagccuucaugugguuguugggaauuguauuuaggaccucuguucacucuggucagcccugcuccaaagauuuauuuauuaaguacacuguaguugucuucagacacacccgaccagggugucagaucucauuaugggugguugugagccaccaugugauggcugagauuugaacucaggaccuucagaagagcagucagugcucuuaccugcugagccaucucgccaguccaugucuggagaaucuugugggucaguacucagcagaacugucacaacacaagucaagcucauugucaccuguguaucaaaagcuggcugguaagauggcccagugugugaggcugauggacccagaugguggaaggagagaaccaacucccacaagcuguccucugaccucugcauguguuccagggcauaagcuaauccuaguugucucugaaaggguuaacugaguagguggagccuguauauucuuuuggugauuuuuugaaguuuauaaauacugagcagagaagaaaaaugauuaggacaaggaaaacacauuucaaaccuccagauaccagacuuucccuggaccggaggagcccauggauuucugggauucugccucacccagugcuucugugcugugaguccaucuugggagucagugaaauagugaugacuucuugugucugcuauugaggacauugcuuauugugucccaccaaugucuugccugugaagucccccagagaggcauucuuaucugucaugacccugagaguggguaguuugcauuaucucuugcauagacucucccacucgucacucugaaggaguuccuucuggagugcacgaagcuaacucugugacucugaucaucuuucacuuucagacuuuuagcucggugcugcugcuuuucuucugcgcugcuguucauucacagauuccucugagucuacugucaucuguuugggaguaagagucugugaccccuugaugagaauagaagaaaaaccccuaaaacgguuaaggaaacaucccccugucccaggauguagaacguuuauaauguacagcuaaaucaguuguucacaaauggaggggagggggcucuuuccuuuaugggggagcaguuggccaugaaggucagagaaacugagaaaacucagucugucagggagaauauauuuagaaauaaaaaugcaggcagcaucuuaacagaaaaguagggguucagcaguuuagaguuugcugcucugauaaaggacuggaccauuccuagcacccacaaugggcaacucacugccagcgcuuuguagcugcagcugcaggggacucugacacacucuucuggccucugcuuagacccacauggucaugugcacauuuauacacacauauguacuuacauucuuuuuuuuaaagaaaggaaaagcauucccaagaacgagagugggcuagugaacagaggaagaagucaaagagagugccuccaauuuagggucaugguccuuccuuccucuuuugccccaugccuuauucucagaaccucccaucuguccccuacugcauggcuucaaggucacuggagaggugagccuccgccugguguuggugagaaugugugcuuuggugauacucguuggcuucaaccucacuggguccucugucacaucuuaacugggucuagguuccuuccaauuuggguccauuuuuuuuuuuuuuaucucaagcccucugauauggaaggggacugucugagcagguaucugggcauccgugaggcuaaagagguggcuacuacuuagccuuacaugaggaguaagagagccccaggugucuugaauccaugacagucaggagccacaggaggcagcugaggcuaacuugugcaaugcuuguugaguugacacaugccauguggccuuuggcucuauccucaagcccuguccaggugguuucuggucccucagaugaauuuuauuuuauuuuauuuuauuuuauuuuauuuuauuuauuuuuuuuuaguaaucucuguaccauccuaccuguggguguauauuuguguuggguaauguaugugugugugugugugugagagagagagagagagagagagagagagagagagagagagagagagaguugugugcacaagagagagagagagagaguugugugcacaagagagagagagagagagagggagagagagagagagagagagaguugugugcacaagugucugcagaggccaaaagaggguauugccaucucuccaucucuggcuuaaaacacacacacacacacacacacacacacacacacacacacacacacacacacagagagagagagagagagacagagagacagagagacagagagacagagaggcagagagacagagucaggccuaugagaaccaacucacacagguuugcuuacuggaugggacacacacuuccgcuuuuagacuucucuaagucuaggaaaaggcaaagguggcugaauagauggcccaguggcgggggugggaugcucuacaggcaugaaugaggaccugaauucagagucccagggcccagccuccucucccacaauccccaccuuucagcauguccccucccaccuucacggcuauuccuuuugaguuuucauaacccacuggguucucuuacugcugccugcugggugcagaugaucuuauuggcuugauccugugcagguaaccauggcagcagugagcucauguccaggucauguccggaagaugcauuucacagcacucccccugauccucugacuucuacauucuuucuguucucucuucuguaauggucccugagcuuugccuugacucucucucucucucucugugugugugugugugugugugugugugugugugaaagagagagagacagacagagagacagagaaaaagagacagagagacagagacagagagaggcagagagacagacagacagacagagacagagagaggcagagagacagacagacagagacagagagacagacagagagacagacagagaagcuccauucagagucgaacacuucauaguccccguuaacagcccauuugaccagaugagccucuucaauaaccacuucccauugcagaaggaagucuccugggcuaagguugggagaagcacuaaucuacauguauaaauauaaauauuuaaaaggcaguuugacaacaaguauaauucaguaaaacaauaguaauuuuggcuagagcccaugaccuucaaaaguucugggcuuuuaaaaauauuuacaguaccagguauggaugccccuccuguggaccaggccuaaaacccaagcaggaaguugccccacaaccucuaugcuguuauaguacuagcggacacaucucaccuggcauauggauauuaugcuguuaggguucacgacuggauaaaauugacacuucucugccccccaccccgccauggccuagagggccccugcuggcacuauauaagcuagccuggagaaaaguguucaguaaguuccagccugauuucucuuacaccacaguguucagcaguaaggucuuaccaucuaguuacggugggcaagcaggagcaauggccauagcuuguguuguuucugggaccccugggaccucccugacugguaacuuguauggagauaccucaugcccgguacugggauguucacuuaauaacucacauagucugggagaagcauuguucacugggcaggguacugugucccaacaccuucuaaaaaaaucauauuuuuaacuuucuuuuaaagauuauguguaugagugcuuugcuuguguguguguaugaacacugugugcauguuuggugccuucggaggucagaaaaguaugcuggaucuccuuggaauuagaguuagucaguuggaagccaccauguggauguugggagccaaaccuggguccuauguaagagcagugagugcucauaaucacggagccggcuuucuggcccucauguuuuaauuugcugugauggcuugaaugagaaacggcccccauaggcuucuguauaugaggaguacuugguccaccguugaugacuggggacguaaugggacuuuuaggauguagagcauugcugaagguaguaugucacgagggaccagcuuuaagagcuuguagccuuacccacguccacuccucucugcuuucuauuugaggcugggugugaugaugcugacaagagacuaacucuugguguccuucccuaacagugaacccagacuauucagaagaguuucauucucaucugcucuaauauaaaggaagccuagucuaagaagcagccuaaccuggcuggcugcaggucuaccuacauaagaaggccucccugcagaggccaaacacauaguaguggcucaggcauacccugggaccuaaggcaggaugcaguuguuucugcacugucccgcaguggcuauuuaaaaugcucccaagggggccuccccacucauccucuuccuguuuccccaagcggauucccaggucucuggauagggacacucaggugagcaucuuucacaaagggccaggugagaugcagaggagccugaagccaaaggcagaggugggaaugagguauggcagcaucuccaaagaauauaggucagcauccuccaggccacagaaaccaauacugaccccaaagcacccagccuuguuauccagguuucugaccucaaucucuuauccucugaagaacacaaucaaucagcuuugggcucaugaaagguuuaggugagaacuaagagaucucuaaucugggacuuugucuuugggaggcuuaggauaguucagagucucaacuguaucuuuaaaggagggugcuguagggaagggugauagcagaagaaucgucuauaagagggaccggaggugguagugagggcaucccaagcgggagaugucaggagaggaugacuuuuaccuguuucagaauaucucuucgguggggcccugggaugggccucaguaccaccuugcuccugucugggccuuccgccuccaggcagccuucaugggauuugucuucuuuguggggaccccacucaaugccauagugcugguggccacacugcauuacaaaaaguugcgacagccccucaacuauauucuggucaauguaucccucgggggcuuccucuucugcaucuucucugucuucacagucuucaucgccagcugucacggauacuuccucuuuggucgccauguuugugcucuggaggccuucuugggcucuguagcagguacugaaggcaaccugggcuagagagaggggcccuuaauuauccugagcaguuggaccucuaacaaugggcugugugagcauuaaacuccauuccaacucucuggacuugcucaauuacaccuauauuccacuccaggcucagggagucugucuaccccauucuuuucacauuugcugcaggucuagugacaggauggucauuggcuuuccuggcuuuugaacgcuacguugucaucuguaaacccuucggcagcauccgcuucaacuccaagcaugcacugauggugguccuggcuacuuggauuauugguaucgggguguccaucccacccuuuuuuggcuggagcaggugagaggauagggcagugcucugaugugggacgagagauuggguauaaccuuuuauucuuugaccugaguugguagaguaaggaggaaagggggccgcuggagacaucaaugguuacucugccauuguaacuacuguagugucuucuggcauucuuccaacuggagaagccaauccagaagcuaagcccauucuuccaguucucggaaugaauguuugguccuuuucagguucaucccugagggccugcagugcuccuguggcccagacugguacacugugggcaccaaguaucgaagcgaguacuacaccugguuccucuucaucuucuguuucaucauuccucuuucccucaucugcuucuccuacucccaguugcugaggacucucagagcugugaguggguuuugagaggggcagguaggaguaacucaggaggccccaggagagacaguauauaucuuccucaggauacgucuagaauauccguggucagauaggaguauuggggaagggggagugaaaacgcuguuacaacuuauugguagagcacuuaccuagcaggugugagguacuggguuccaucuucugcacaagagguagugggcgaaggaccagagagaggaggggacaaggaugggaucuuuucuagugucagagcugaggacgcccuucaugaugccucccucaagggaaagccaaacucagccaggagagagagggcuuugacccuugugcucaauuccagguggcagcucagcagcaagagucugcuacgacacaaaaggcugaacgggaggugagucauauggugguggugauggugggauccuucugucucugcuacgugcccuaugcugcccuggccauguacauggucaacaaucggaaccacgggcuggacuuacggcuugucaccauccccgccuucuuuuccaagagcuccugugucuacaaccccaucaucuacugcuucaugaauaagcagguaaagcggucuaucuacauucccacgagguucugguccauuagacccugguucuuccgcuauugaugucuuugugacucagcacccuggccuccacacagggcuuauagaugaggaaagccagaguaguccaagcaggccaggaugcucuugguaggcacaugaacccagaguaugguuccuaaaauacuggaacaaggggaggcuagaccuugagccagaaaaaucaaauugaaagagugggaaaggaugggaaaugcccccaccuacuucauuuagcaauggcagagauggagcaaagggccuuucacaugcucggcaaauauccgcaucacugaguuauauauacaucaucccuacucuuucugucuugguggaaaauaacaucaacaguaacaggugucuagcuuuuuucuuuuuuaaagauagggucugaguaacacuagcuguccuggaacucauauggaaaccaggcuguccuugaacucaagaggugguccugccuccuaucccgagugcuggagucaaaagauguguaccagcacauaaguccagccuucugcaaaccuuuaauccaguccuuuuaaaguuuagccugcaggagcaaggaguuaaagguggaguuuagguagucuucaggguaaggauaauaaacacuucucuuuccaguuccgggcuugcauucuggagauggugugcaggaagcccauggcagacgaaucugacgugucuggcucucagaaaacagaaguuucuacugucucuucuagcaaaguuggcccucacugaggccccucagcuggccugcuagcagcaaacacaacgccacauuuaaguaucuacaucuccacuagaauccuaaccauuaacaggggaaagauggggagugguggcacucuggugagucaccuucauuuuccuguuacucucugccuguagcagggccacauggaccauuuuaacagucacaguuucuaaguggcacucucaccucuggagaacugugagagaagggcugcguuucugguguauggguaacacuuccuuuuuugcucuuuuuuuuuuuuuuucuccucccugcuggggaucugagaugauauauccaguauuagaauaagcuuggcauggggcagugccaagaaaaggcagcagacaccgggcaccugcagugaaucgaagagcuuccuuauguggccucucccaguugcugcagucugggcuauggcugccaggaucagaauggccucaccucauuuaucugacacagaguuauucuagguguucuccccuucauuuggcuaaauguauccauuuaaagcuaugcguugauuaaaguuagugucuuaaucucuugauguccucaaaaugaauuugcauguuucaguggcauuuauaaaucaagcccaagugcuaaaaacaucuuacuuuauacccuccuuacaccugcugcuccuggaaaaggagccccucgaaacgaagaagugcguguugaguuauacgcaaggagugcuggguacugauaucaggcacugaagguaggaaagccguagcugugagaaggagccagaaaucucaggaauagcaaaggacuaagugugagggagaaauggaagugauaaaagaucacagagauguauauuuaucuuaguaaccugaggguuaaaggcuggaauacaguaauucuuaaagaggcccauugauagguaaauggaguugggaaaauuccuuuucugacauuuuaucauaguacccuaaacccaugucuuucuuccuugguucuuucuuuuuacugauuuauuucaugugcaucagcguucugccagugugugugacuaugugaguguuggauccccugacacuggaguuacagacaguuguaagcugcuaugugggugcuggaaauugaacccagguccugaggaagagcaaacagugcucuuaaaugcugagccaucucuucagccucuucuugguuucuugagacagagucucucuaugcagccuuggcugaccuggaauauaaucacauuuccaagagaauaaaagacacauaagcccuug

SEQ ID NO: 2872 - RNA, 28739 nt, Mus musculus
cuaagccuucgcaccagcuauugcuuuauuugguguuuuccacaugugcaaaaguuccccagacagcugggacccacaauguguaaaaaagacccccaaguggggcagagcuguguaaccauaaaaaaaaaaauaguaagagaaaucaguucccugggaggccuggcgagggcagagcacaucacucggggccaguccacacaucacaugcugcuugcucugggucugccgucuuccauugcucuuucuuuuccaagcccuucacucuagggcuguggcuaccagacgggccugacagaguccuuaggcacggcgguuugugagggugacuucucucucacacagauccuccaacucagugcuugcccacuggcaucagccccacuaugacccccaaggcuucccccaaccccuguuuaaccccuuauuucacagucucugcccggagccucaccccagucugcccuugggccacauuugagggacacugaucugagacagauaaaggccccccaccccucaagugacacggggggggggggguuguaccacucacaucacaccuaaggcagguguuuuagugucugauucugugagugugcagagggguguggcacaucuguguggguaugaguuuggcaggaagugggggccuggucuggggggcaauacuucugagauucagggcacauugaccuugaaggggcucccagggacacuuucaucaccccacuugacaaugaggauguagucucccuucuccuugacaguguaggugacguuguagacccgguuucccaugugcuucacauauaccucuucgcagggggucuugggcccaugcacgcccaccaucaucauguuggugccuggagagaggcagagaggagugacucaccaggccacaagcagcccaugucccaucccuggacagcuuccuucccgucccccuccuccccaagacaagccucucggauggaacaugccugcuuugcugcaguccacggugaaugaguucuucugacccacaaaggccugggacagaccagggccccuuguuaccaccuugcuggcauccgaggagaacuuggggauggaacuguaacuggcaccgcggcucgaggaggacuuggucaccgucuccaccagaacuguggauguuucgugaaggcuguggccuccagacaaccggggaccugaagggcagaguaggcagucacgggacuagucaaaaggacucccuacccuuuucuaggacacugacggcucucugagaugggcauuggauagcguugugugcguuaggcuccugccuguccucagcaacagcuuuugaagaauacgaccuguuccacagaggcagcaucugaccagcuccaaucccugcuuaccccugggucacagccacuucugacccugccccucacccuucuaggcuuccucugaggagucaagugaacugaaagggcgaaaguaugacuuuaaacuggaacaaaaugggaauauagcucagugguagagcacuucccuggcaugaaugaggcacuggguucaaaccccagcacugaaaaaaaaaaaaaaggauuuguuuuucuuuuuuugguuuucaagacaggguuucucugcauaguccaggcuguccuggaauucacucuguguagcaggcuguccucagacucacagaucugccugccucugccuccccagugcugagauaaaaggagugcaccuggaaagacuuguauuuuuauuuuauuuuauuuuauuuuauuuuauuuuauuuuuuuaagauuuauuuauuuauuauauguaaguacacuguagcugucuucagacacuccagaagagggagucagaucucguuacggaugguugugagccaccaugugguugcugggauuugaacuccugaccuucggaagagcagucgggugcucuuacccgcugagccaucucaccagcccccuuuauuuuauuuuuauuuggcuuuuugagacaggguuucucuguauagcccuggcuguccuggaacucauuuuguagaccaggcuggccucgaacucagaaauccaccugccucugccucccaagugcugggacuaaaggcgugcaccacuuccgcccggcaagacuuguauuuuuaaagaugcacugcucuacagaauggaaugcugccuagccaugcccaccuccaucauaguaaccguccauaacugaaagcagacuacaaucaaaugugcauagccaccagaaccagccaugcugggcugggcuacgugaaccuucuccagccaggguacucaccugugaccuuugcuuugaagggacugcccacaaugugcugagggccaccauacuugauagcaaugagguaguuaccaggagccaugggaguguaagugacuacauggcccucgggacauucccgacaguccagcugcaccuuggaaggcccaucaauggugacagacaaagccccugagccugcauucuggguguucacaauaaacucugaugauacgccuggaagacagagggagcaagaugaagguaaggaagaaugcagcccagagccgggcucuggauuccuuggggccuuggaucccuugggcagcacuuaaggucaguaccaacaagugccugaccuaccaaggcaugucugaucccccaaaucuaacccugcuccccucaauucagacacucacccguagugccuccuucaagcccaggcccauaagcugacaccaagccuggguccccagccuggcucugcuccccaacacggaucuugaagggacuuccagggaugugggcgccguugaacuugacaucaauugaguggacaccguucucaugggggaugaagcggaugguaugcuuaucugugaagcagaagguuggugagugggccuccaugcuucuucaccccuuugccagagaucccagcccggcaggagauggcaggggcggggccagcucaccacuguccaguucagagacauagcacuccuccacagcuccugaggguguguguacccgggcaucaaucacaccacgugccccauuaagcugcaccgcgaaagaugcuggcugguucacuuuaagcccugucuccugcaaagaccacagagcagacucagagucaugggaagcuggggauggaccaguccucucucagcucagugcuguuuuuacuguacggccagcucagugcucgcaccucuccagccuggucacugccagccagcccagauugcagggaaggacugagaugcaaaggcugaccugccacucugcauccaccuguaggcaccauccuagccaugcuggguaccacagcugaggaagcagaggccagaugcugagucaugcaggccuaguagcagagcuggacagugcugcaggccccuaagagagagcuuggauguggcaggcugaguguagauugccccuagaaggaggugaccaaugggagcacuggagagagcacaagaagggcuuggggguaugcggaugguagccugggcuaaagcggcgaggcucacuguuggccgauaggacugcacugagggucagcugaaagaaugugggguggggcuagagagauggcucagugguuaggagcacugauuguucuuccaaagguccugaguucaauucccagcaaccacaugguggcucacaaccaucuguaaugggaucugaugcccucuucugaaaauagugacagcauguguguguguguauguguguguguguaaacaaaguuaaacaaaacaacaacaaaaaaagaauguguguguguguggggggagggucccguccuuucauaacagcucuuugacagaguuucccauuugcuagcguggccugcugaaagccagcaugguauacauucccauaugguagaaggaaaggagaucuuucuagaugucacaccaggaaaaagaagagcugguugcagugguaggagagguguagcccagucuacaugugcuugcucaggaguccucugcaaacuggccucuguuuauuuuguauuaauuauacgugcuuauucucaugaugugcuuaguuauaaacauucagaggaaaguggaacaaacgcagugacaagacaugccagcucucaggaaggacagggagacagugcuucuaaagagcccaaacaaggcauggagcagacacgcuccuugcaagggcccugacccaugcugcacacagugggagaagagacugcagccagcucguccaccaagcucagucacuggccaugugggccugcccuccuaggcuccugccugucucucgggucccaccccuggcacagaccuggaggcugguaacagugaggcggcgagcgucgucugagagggaggccacgggcaccacgaacgggcugucugggaugugcucaucauugaacuugauggagaccucguagucaccugaggaaggaggcuggucagcacacuuuccaggagaagagcagaaggggcaaacuuuccccagcccagccuuguuccagggcucaguucugagugggugaaggaacuuggggugcaaagggaguagugacugguagggggagucauacagcccauuggucagcaaguagagacccuguccccagcccaagugugaacauuuaccuggcuccuggacaacauaggagacgccacaagaaccaucuuugcgguccucaaaugcaaucucugccuugcugggaccuuccacagcgauggacaaucccccagcaccagcuucucggguccagaugcuaaacucagcuggauggcaauaggguagggguggccacuuaguguuguuaccccucacgucggcugcccuggcucugagcucccccuggcuucagccccuuaccuggcacaccagcuacaccucgcuccagcccugugccuccagcucgcaccuugugggcaccaccuucaccuagcggacccacagugaacugaaaagggcuuccgggcacguguuggccgcgguacuugacagugacuguguggggacccaucuccuggggcacgaaucgcacacuguaugcgcugucuucucccucaacgaucucugcggcuucugucuugccagacggacuugucaccugggcugucauguccugagagcuggccucaccugaaggguuggggugaugucagaccaagaggcuguauccagucuccaugaaccccucccuccucggugaacccccuucucugcucaggccugacuggccaucugggccaagguggucagggaugaggccauuuugacucacagaacagguggccccccagccucccugugaggaccccaguucccaguauucucugcucaccuuccugcugccgggugaugcugccgaaggagcccaggcguucccggccuagaaaaucgccgaaaacagcagggaaagggucuccgccgaccuggguggacuccuccacucggacuucacgcuuggucuccccaccccgagucuugcugaucucuguccgcucugugcggguguacguaugacugcuccgcgugaaggugcgagucaggcgcuccugggcagacaccaucugaaaccaguuuccuacagaaagcccagagggagguggcaggaggugaggagagaggcaggcaggacagaggccucagggcaggcucaaggcuaaaaagggcaucccauggccgacccugcuccgcccuggcucuccucugccuuugcagugccuaccugggaucuugagguugaggucacaggugcuaccaaugguggcaauggagggugccugucugcgccgagugaugcuuuccuucaugcgucccucgccagucaccuucacggugaaggggcuuccuguaagugagaaaggagaagaucauguucacaggucaccugccuggucgccagauuguccccacuggguccccgcccagagccuuaccagguacgugcuugucagcaaacuuaauauugaugauguaggugccggguucagucgggcaguaggugacuuugcagguaccgucuuccauauccucacaguuaauguccaccuugcuagggccuucgaugcucagccccaggccuccauaaccuaagggccagggaauggggacagcugagcuuccucuuagcuauggcauagcugacugacuggggacauucacuuucucccggugggcuccagacugaaucccaacagguccaggaagcccaggggaggaggagguggccagagggaggccacaggcaggaaacagggacaagaaucuggagugcuaacuagaugggggauucugggaugagaaaguaccugcauugcgaguguccacaaugaacucugccacuuggaagguuugucccucggaaaggccuuugccccagacucgaacuuugcuggcauccccgaucuccgaaggccccaccaaaaucuuaaaggggcuguuggugacgugcuugccacucuugcgcacgcucaccacgugcucaccgaccuccuuggggguaaaggagaucccuguggagaggggacaguaagcagaacaauccccccaggccucucccacccagguacccucaggagucccugugcucaccaaugugccuguugggcaggcgcuucagcaggcauggcucuucauugccugaaggagcacggaugcuggcugucagcuggcugaggucacccuccgugaucuucagugacacaucgguggaggugcccacauuaagcugugauguucucauugagucgucaccugggacaggugacaguugggacagaucagacuguuggcuccagacagacucuagcaccccuggucugcacucaccuuaacuacuaacagccucagaaggacccagcaucucuguucaccgagccugucucaguccugggaaugcuaagucucuccuugaaccuuuauguauuuaauccugacucacauagagugacagaacaagacaccagaugcuugcucucucucucucucucucucucucucucucucucuagcucugaucacagugcuaaccugucucuggguuuucucaagguaucaaaaacaguguuaauaacccuaccuuuuaaagaguaacuugaaagcugaaauauuuuucuuucuuucucuucuuucuuuuuuuccuucuuucuuuuucuuuuucuuuuucuuuuucuuuuucuuucuuucuuucuuuuuuuuuuuugguauuuugagacauggucucucuauguaggcuuggcuggccuugagcugacauagaugaucaugucuuuaaagcacaggauggcaggaugcuccuugccugcucuggagaacaacauccucacauuuaucucaagauguucuccuccugccuagcagucucuuguccagacguccugggugaacugacucgagcauggguguggcaggcugcccgugccugaaugucugccucaccugugaucuuggccgugaaggggcucccugggaugugcuugucgucaaagcgcacgaugaugcuguagucuccgggugcugugggcagguaggacacuguacaggugccauccuuguuguccuugcaggugaucuccgccuuggaugggcccuccacagccagugacagccccccugugagcgaaagggggcugaggucagagggucuauccuugugccgccaaccuggcaagccccuucaccucuauuggcagcucuccuuaccuuccccagcauccuuggugacaauugugaagguggcaggcuuguugaccaugccauggcucaggccuggcccguaggcacugacauggcggcuguugauggcauccacauagaacugcagagggcucccuggggagugacagguggaacuggaucagcauagggacaggggcuuccugcacccauguuggcccccagcaucuucaacagccuuggauauugagcccugugucucugccacauggacuuggcucuuagaagcccauuaccaccaggacacacacuuccccaggaccucccauggugccuguacauggcagguucuuacauaaguauuuaaaggaggauggcagaccaacauggggucagcucugcuccucuugcuguggucucacccugcccccgacucaccagggauaugguugccgucguacuugauccccaucuggugcaggcccuucucugucggugcguaucucacugugaugguuccauccuuguugucagugauguuggggcgcgcuguuuuuccagaaggcauccggacuuccccuggaaggcagacacacuuacaugugggacgcugguuucccccaccacacaucccugcuguccuggggccuguucucaagggccucugcuuuccccagaggccagacacugggaagcagccuguucaggaauagaagaaggaaucccggacuaggagacagagggcuugacccugaguuccagcucugcucaacuugugagucucaaccuaauuuguuucuccucucugggccccagggcucauccuuacacuugaucuuagcagaaaggccaagaagcguucucaguucucgagagucucaugcguggggcaccuguuaccugucagcuccccuuucugcacagugaaggggaugaccaaguugaaaggccucagcauggauuccagaggcuccacaggcaccacgggcuccucuguggccugcagcgggugagagaagggagcguugguggaguaggcuggggaguguggccugccucacagagucagagagaacgaagaaagaacaagguuaauagugaaaccggagcggcagaagagacacgucagcugcagaagaaggggcgccauacccagauuugggcucccucugcccauccuaaugccugccuauuccccaagaggcccaaccgugcguggcccaagccugcagaacaacagaaggaggaaugaagaaaguaaggagaaggauggugaggccugucaugggaagcucuaguacccagugcguggggcaggugccaggccgaagaggggcauagggcuggcgcaucugcagcauuuccgcgggcuccuccacgugaggcagcgggucacaggccuggggaguaaggcacagggcacacaauguggggggauccagguccuaggacugacugaaguccuggauggguaucucagguguucuauccuuguccugcagggccaccucuguagaaacaagaucuaggagggacagcggcccaaaggucagagaagaacacagugaacucguccaaagaggguugguaccucucaggucacaggcggagcugcgcugccucccugcacguugggaggcugcagggaucccaagggcucauucuagaguacucuggcuccaggauccauucaucagacauggggacaaguccucugauuccuugagggcagcuccuaggagcucuuaaagcuacuaagaggcauauucugcacaagccccacccugcccuccagccccaccccggcgaugagcuuaccagcacguggaaagggcuguuggggauguguucgcccccaaagcggauggugaugacauauuugcccggcucgggagcuguguaguagaugucgaaggugccaucaugguucucgaccacguccacaucgagcucugccccaucggguguggauacugugcaggucaccuuccccuugccugcugccuuggcguccacugugaucacagucuccucuccgaucuggauucugggacccaggcaggcaccuaccacaugaaaaagccagaucaggggcugcugaggccauggcuagaucucccuuuucccacggcucccacagccuccaaccccuaucaaagaaagaaaaagguuacucacccaguccauggccuccaauggacacuggaaauagacaagaaaguuaggccaugaagguucaagaugagcuaguggcagggacggggagcgggggggaagugggguggaugguugggcugggcagcggggauagauuauuugccagcauagccccaggccugggcugggagacugaaugcacucuaaggaggcuggcugcugagaagggauucaguguuggugcucaccuguaacaaggcacuugcuggcauccccuguaggcagggcauggaugcggaagggcgaguaagggaucucaucgccgccguacuugauggugaugguguaccgaccacucaugucgggcagguaggacacaguauaugugccauccccauugucucggauguuggccuucuuggguuuacccucgggauccuagaggagaagaggaggucagaccugcccauguccacagagcccagcugggcagggggcugagccuagacucaccaggaucugcacgguaagaagccccugcccagcaucacgagcaucaauggugaacuccacgggcaggcuggcagggaugcccgaggcauugaggccagggccacuggcccgcacuuugcuggcaucaugggauggaagcacuuugaucuugaaagggcuugaaaaacagaaggaauggacaguuugucagggaguuguggcuugagaauugugagccuucccacaccugggaagaaggagcgacucugcagggcagcaugaagggguuguuucccaugaccaagcgacaucuugaguuuuggagaacggucacugaaggacccauugaacaugguguuuucuccagaggaagaugcuguuaauuguuuaaagaguccauaugcuuucuauggcucuuuuccuugaugcuuauuuggugccgaagcuacuggagugauauuaccuacaggaaaccuuggaguggggcaggaugggguagucccggaaggagguuuagacaguaaaggggaacucugcccaaguucuggccuugaaggugaggcccuaggagaagcucucacucagcauggcuugcccauggcugguccucaccuucguggcaccuccuggucagcauacuugacagcuacaguauagggaccaucaguggcagguguguaguggacaguguggguaccaucgccauugucacgcaccuccacaggcucagccacaccuggacaaaggcagaggagugucaauagggucuccuggaaccucaccucccuuccaucuuucacuccagacauuccauaccuguggggcccagcacggccaccugcagaggggcccggccagcuugacugcaguccacugugaaggucugagguacucgagcccugacgccggucccuagcccuggcccugagcacuucaccuucccagggucuaccacauccuucacaggaacucggaaugggcuuccugggugggugagaacagaggaggggguuagccucugucgacugccuggcaaagucugucgcccugcugcugagaggcccuuagaggcaaagcaacgugcaaaagcaguuuggaacuuaauuaggaaaacaaaacaaacaaacaaacaaacaaaaacaggacuaagcaaauuugacugcagaaugagacagggcaaaccucaccuucuuagacuccugggaagaaagcccuccuaaaucuuuaaaauguuaacaauggaauauuuuuacaaacagcuuaugucuuuugacauuguaguugaaacgugaagaggagaugcagaauuaaauaagagaaaauggugucuuguuuuaacagaccacucucuacaauaacagaaggcaugacacccucaggcagcuaggcuguaggacagccaaucuagucaguagaucuguaugaccaacguugcaggaguuucucugcccaaucacauuagggcaguggcaggccugugauuggacaggaaaagggaggcggagcuaggaguuugggcgauagggagagauagagagguagcaggagggggaaggagagaagacaacauggaggcagacuaacaggaaggugauccugauccguguggguuuaaacagccacagguagcuaagauuuucacaagguuagaauaauuggguuaaagcuuuugucuuuaucaacugacucugaaauuauuguauuggcaucuuguaaauuauuaucuuauuguuauauaaaucugauuggauaauuaagcuuuaugagucauguuucuacuggguaacuagguguugagauggcugaucauggggugugugggacauugcaugaaagcaagaugaacucgcuaacugggagagaguagcucagaggugagaacucgccgagccggacccugccgagacacaguguuguggcccgccaguacugguacuagagcaggaacacggaccgauggggcaggagagauggcggguugauuuuuuuaauauuucccacaacagaccaaagucuugugcaagggccucugagaaugaacuagaggguuaccacauccgccuccugcccugcuucuugcccucugcaaaucuccacauccacuuucccguugaucugccauccucuucccagagcccucccucuuugcccaccuggaaugggcugucccccaaaggugauguugacaucauagucuccagggguaaaggggauguacuccacggugcagcuuccguccuuguuguccuugcaggacaucuuagcuucugaggggcccucaauggcuaggccaaggccuccugugccagcaccccuguaaaagaacacuccugucagcugcucuagagccagcgaaagggacagaagggauugggggacagggaggagaagagagggcagcugcuagggcccagugcuggaagggauggucugcaaugggcuguuugggaacauggagaggacugauucuuagucaucucugacagaugggaaggacaaacaagcagagaucaagauggacaugaacccgggucaaggcagagagaaggauaccugguuuccacagugaagcgguuggccuuguucaccaagccaccuuccagaccuggcccgaaggcccggacucggguggggucacagcccucagucacacccacucggaaggggcucuugggcacagcuacuucgucauacagcaccucuaccaaaugcacaccuggaagccagucaccgcaucagucaaggagagcagagccccgauccgugcccaccugagcauucugugcgccguucccucucccucaaaucccuuacuuacccucuucauaggcaguguacugcacccgguaggugccauccccguugucugucacauagguaucugucuuagcaccggagggguugaggacacgagcugucacaugguugccgccuguagcuguuagagaucucgcauccacaguaaacucgguggucaccucccgcaggacaccuagauccagagagccacgcucacucagccuucaugcaggccccucuucaucccuugcuccauagcuguuccuucaaguagcgccgagccaccucucugcacccuugcgagucucaggccuccuccucugcccucuccucuauguaaagccauccucagcccccgucagaccucugccaggcugaggacugugucuuaccugccucugcucggcuuaguccuagcugagucuggcucucuugcaaccagcacauuucacguaacuauccccugauucuugacaacccugagacacagcuugcccucugugccccuuguacaucuucagcuuuaucaggucugagaugucuuaaauugaggaguucaaagaucucaccagaaaagugcccaggggcagaugccauuuugucaaaagagcagagauuaaccugcaugcccuuuugaauccccuugguccccuucugguguguugagcccugaaaccuccaucugcccacccccagcucuccucccuccuuccagagcuugcuccccauaacuugacacugcgcugcuccucucuuaccauguggcuccacaccaggcccagagaccuugaugccacugguaucaacugcaggcugcacguggacacggguggggaacuuggguaugggguggccgccauacuugauggugaugguguaggugccggggaaggcagggcuguaggugaugugguaggugccguccgcguuguuuuggaucagcaccuccgcuuugacaccagcguccgacaggaucucgauggucagcucggccucacccgcuucugagcaguccacggugaagguggcugccucuccagccuugccacgcuccaggccuggcccacuggcccucaccuugcuugggucgaacacaggcuggaugguggccuugaagggcgagccagggaugugggcuucagcaaacaggauauugaugguguacucgccuggcuccgugggcagguagcugacugcacaagauccgucaccauugucuuggcacucgaucuuggcuucgcaggggcccucgacagucagccccaggccuccugugccggcccccuuggugucaauggagaauggugccggggugccuacaagcccgcccuugagaccagggccauacgcgcagaccuaggaagaugaacauguuuguuaguccccugaacuugguuucuccuaagcucccagccucgguggcugccaccuagcuacugcagagugguuauagccccaggagaggacgcugagacagaaaugagguaacugagauucaagcucaggucagauuccacggccagcucuaaacaacuaagcugacucuaagacaggcccuacauagaggaugguccugguccuuccuccaggaacaucuguccuucuggccucugacuagaaugcaucuaucuuuucuaucaucccccaacuccuggaucccaccaguccccauauauuuaccuuagaggggucagggggcaggacaccuuccacagcaaaggggcugccaggcacugggugaccaucguaggugauguccaccuuguaaggucccucuucagggggcauguagcggacagccugggcuucugcuccacccccaggcuccagcuugcaggggauaggccgucgggagggugaggucauccgcacaucgaguugucccugaccaccagccccucugguguucaccgagaacgccuguuccugucccacagcuaccucuggacggagggcaagggacaccgugaguggacuccagaggcucacccaacaccccgcaaccccaggguggcucuucucuuacugcuguugaggccuugaacuuugacuuugcugagguccagugggggugccacauucaccacaaagggacuuuuggggacaggguccccaccguaggucacuguuacugccauguugcccuauuggguaaaagagaaagucagaauggggugguuuagauacaauccgguaacaacuccuuggacacugcaguuuauugaccuagaguaagagaggacagggaacaggaaguggccaagggcccagaaugggugagacgaggcugaagaggccauucucaggugccaucagcagcagagggaaaggcgugaggggacgagacauaccugcugcacagcuguguacuugacaguguaugaauagucaugguugucaaugauuucaaagucccgcacagccucgcccuuggcugccccagcaaagugcacguccagcuuagccuugccagcucccuuggucagcacgguaaagugagucggcuuuccgacuuccacaccuggaagcccccccaagagauggcagugagggccuggggaccaacgaaccccaacuccuaccggcuccauccuuguccagacaucuaccugugcggcucagcccaggacccucagccuugaccuugcuagcgucaugggauggguccaccuugauguggaagggacuggcagggaucuccuggauggggaaaaggcuuagucagguuucucaggagacaguauugagcuagaugcuggucaggucauccccccagguacccagggaggguauagcaccaucauguuggcuguggcacacacaagggacucacuccacagccucuguguaguuggcguucugccucagaaacaacucauuucuaacagccuucccagaccuuuaucaugcaagcccauggcuaccaacuguagcugagggcuaccauaccugguuggcaaacaacaccaugaucguguaguggccggccccgggggguguguacuugacugugaagguaucguugucauucuugaugaugucaaagucgaugucagcuuccacaggccccaccacgccuggagcacacuugaugccaauacucacaucaccugaggggaggaagggccugggcuaugcaugaagcucaagagcuucucccauuagaggcuccuggaacugugcccaggcaacugguucuaguggauccaagcccuucccaccuagaacacacccccgagggaguggcucaccuugcccggcuucacugcaguccacugugaaauagguggguucauuggcuuuaaggccugucuucucuacuccagggccauauaccuucacccgcucaggauggcugccuucucccacauucaccugugggcaggguuuuuucgcucagggaguaggcauggcucaaggcucacccuucccagcaacuccccacuccuagccucagcuggaccagucuuagccucuuugugggggccuugaggaagggaaaugugcagagcauccaggacagccaugaaucugcugcauggggcccucauuccuugggacuccugguugugugcaaggggcaacuuugguagacguacccugaaggggcucuuaggcacguugacaccuccccaggagacgaugauagugugcuugauggguuugguaggcacguaggagcagcggaagguaccgucaccguuggggaucaccuugaugucgauggggcagccaucugcauccuguggguaccagccaagcaauguucaugggagcagagaagaccacaggucucucagugcgcccucugcuggaucaagcagacucugcacuucucuaugccccaccaguauuucacccacccaagguccagccagugaugucaggccaugaaucuauggccagucccuaccucgggagccaaaagacuuggcaugaagucauccccguggccugcuuccuagcuuauguuuagcuuauauguuaguagucagggagaggcuaaaucaauguucguaaaauugauuaacaagcuuuuuaaagaacaacugucuccucagagcuucaagaccuuuaggggucaguggacacuaauuuguuaaacugacuugaagccaaugucacauauggugaacucaucuuucaacuucaaauuacugauucaaaaaugauuucugaaaaugcuuuuaagauuaucauccguaagaaaauaugguuuuaauauuacacagaacuaugaccaugagagacuuaauccugucuuucugggauccuacaaccuccauucuggaggccccuaugugggguaauagggcacaguggggacagugguguccuaccugggcauagagcuucaaaucucccuugccagcagcacgggcaucaauggugaacucggcaggccuguccacuaugcagccagugggcuccaggccagguccaaaugcuuucaccuauguuccagacaagagagggggcuggguuggggacaggaggaggaacggagcacccaagcccagucccgauggcgugugggagcuaugacccccaccuugucugggaagcagucugguggggcuggcuggaugugggcgaugaaaggcgagucccggaugucuucaucaucgcagaugacaugcacagcauacuccccaggcuccgugggccaguaccgcacgucacaggagccgucaccuuugucaucacauucaaucuuggcuugugagggccccucgauggagaagccuggagaugaggugggaagggugagagagcauagggcgcagccaggccucucaggcaggucccccauguuuccuucugcucccagcccaguuaccccaaaguccccacucuaggcuuauccugacagccuucugagucucacugccuuccccagcuccuccucggcgucaguccuuugucacaugccucaugccaccuagccgcuuacccagcguucccacuucuguaccgauggcuuccaccacgaagucagccgacuugcccaccuggccagucuccaacccaggaccccaugcccgcacuuucugggcuccggccucugggcucaccugaaccucaaaaggacuaggaguaaaggaaagagcugguaucagugccaggaagugccccugccagaggcggccucuucucuccccucagagcucaggagcaucuuccucuccucacagcaaaugacccagacggggugaggggaugcagauagggaggaggcauugugcuuaccugcggggaauggcauagccaccccaggugauggucaccacauacuucccagguaccacuggguaguacucgcacucgaacaccccaucuccagccucccgaacuuucacuggcuccucugugcccucugaggaaaugaagucaggaaguacaggucaaagucugggagucccagguucuucaucccccucauggaguccuugggaccuaggccuaucugaggaagguguuaccaguggacagaacugaaacuuauggcaggaccacgugucugucaucccugagcacaauagcccaguguagcaaacaagguagagacaacuagcuccaauuuucagacugggaaacugaggcagagaggagaguccaugggucaccgugucucuggaaucucgggauggggcuguguggccuugcugucauugcccucagauugucaaaacuacuguacagucccgcaguccugggccgccgcacucacuuggaccuuugacggugaccuugaguuccccgcugccagcacccuuggugaacaccuugaagucagccaccucuuucacacgcacaccuuugggcugcaggccccgcccagaggcucugcaggcguugggguuacaggcuggggagaggaagagacagacgguuggggugcugaauggcucuggacgaaggccaagcuccugucccuggccaccuuacugugcagguaucuccugagcccucccaggcacuaguggggcauggccucaugcaacccugccccaugcuuucuguguccaucacagaacugggucugcucagagcaaugcugggcguuggacagagaucuggcugcagacccaggucagagccuuuccuuggagccacuugagacaaagacguggcagauucugcaccgugugggcuaagaaacaaggagcgcucucuauccacacugaaggugcuuuccacuauagcccuaggcuuucacagcaccuccauagcugccucacaaacuguggcaugccaccaaccauccagcaccgucauggaauaagaggcguuccauguagcaucaagccuucugccacgcacgggcaaugcauugaaaccagccuggugcgauacagauacauggagcucacagggcaccagagaaacgacagugacauauaacccaggccuagccagcaguggcacagagcucagacacugccacagaauccaggcaguggcuuggcagcagcuggggccaggcacggaacuucaguaggacagacucuaaaguuugugacagagaccacaaggcggacggcgaaacaggaauaaaccugcccaagaacauauacaauggcucggcacuccagccugucacagaaggccacagaaugggagcaauccacaccgugugggcauuccacaagcacguaugaggccagccagcuaaggccaugccuggccccaccucuacuggcgaguacuaacguggcgccacucucuuggccugguggacgauggguacagagggggugggcgucggcaagggcacugaguacagggagagaaccaguugggggguaggaucaccaaccgagggccucgcacacagugagagcaugccaugugagccccaccaggauggcccugugucgccucucccaacccuuccaggggacccauauucuggaagaccccuguguucucugaacucccucuuacccauaccagcccaguugccccugcuugacucaagcccacaguuagcuaccaccccaccccccaccuccagccauguggguuaagugcugcauuucccaucaguccucagaccugacguuugguggcgagcuuucugugucuggcucuggugagguaaagcagccuuaccuucugccacauggacagggaaaggacuccgggugaugggugcaccagcaaaggccacaugcacgguguguggccccuccaucacgggccuguacgugcagcggaacguguugucacccuuguccuccagggccaccucgacuguaucccgacgucccuguggguccacgaucaccacagcaacaucaccagugccagccccugcaaaggacaaggcugucaggagccugcucuggacacacacaucugaucaggcucccucauccuggaaccacccccacccccacccccacccccaccuaggaucuguuucagccccacaccuguacacugucagaggcuaccacucaacccauccugggcuaacucuuaccggcaguauagaugucaaaguagguggguuuguuggccacguuacccacagguuccagaccagggccacgggcugauaccuuguuggcauccccgagagccaugcccacauucaccucaaagggacuacgcucgauguucuggccagcaaagagcacggucaccuggggcgggggcggggugggggcaaagguuagccucuaggggagacuaguucugagggggagaagaggcaaagugagggugccaggcggacaacggcaguggggguggagugggcugagaggggcagcgaucuagggagauaccuuguguaacccagcaaccuugggcacauaggagacggcauaggugcggucuuugucauuguugggaaccacuuuggccuuguggggaaggaagaagauugaagaucacacaauuauaacccugacugaucccauaaccucaggacuccucugucccaacccccuacugcucccuuuaucuccagugccccacuguaccuccuccgugugucccucgggguccucaauguagaccagcaccuccccuacaccagcaucuacugucugcacggugaagugggcaggcugcagcacaguguuccccuggggcucaaugccuguggacagaagcagagcccaggucauucagagguccucucacuccccagacgccucccucgggaaggcucuuaggacuccacgcguaccaggcccauaggcaauggcuuucuuaggauucagcugcuuagagcgaacaggggcaccggguuugagcuuggccuugggaaacugggacagguaggucaugacagaguguucauccacauugggauccacgauuucuucaggagcaaucaccugccguaggaagaaaggaugguugcgcacugcucucccaguucuuaccugcuuccuugccagguaucuguacaguccuuacaucuccaccaccccccaugccccacuaugccaucugccaguguaccuggggcaccccgagccagucaucagcuugcugcauggccucucuggcauucugcacgggcugguuggggucccaggcuucccaaucagggcagagaccuagagagacgguggaagaaugugauaguaaaccauggagcuagcaaagaaucuuuguuuggccaauaauccgagaggccauggcgucacauccuuucuggccagcuuuaggaccuuccucagucagguucccgcuauccccugacauugcacccaaucaccaugccaaggcauagcaguccuugcuagcaucaacaaugaggccuuucucuccccacgaugaugcggccuggcaccagcccuaccagccagcauccugcuuaacccaagaccuagcagggaccccaaguuccaaaccccaacaaaggacccccacauacaugucaugccagcugccuuaggguggacagaaggugagggcccugucucccacaacuccaugaugcuacuccacacuagucuuagggauaacucucucucccuucuuaacugcccauugggggaaacugaggcaucaaauaaagcagcauugaagcagggagauggauuccucuguauggacauugagagccuaaccucccagcagauagaaugcugacagaaucccagaucaccugugaagggcugguuguaggggcagggggagcuugguucaagacugagauaaaggguuugaucacaguggggugaaggggcccgcucacaagcuggaauccaugacuggcuggaacagcugagcucacugcuggcagccacaccagcuuugggcaauggcucagcagcugggaaugcuucccaggcugcgugcccccgccuccccaucccugcuccccugcugaccccagggcgggggaggauucccccaaggggcuaaagcuccucuggccaacugcccccccacuguagaugacaaucaggaaggagcuggaccuuagguggggcucuggccugugcuguucaguccucuaaaggcucugaucuguucaggucuaaccaggcuggcccagaagggcaggccagggccaccugucacuggacaacacaauggcaccauccuggcccucaacccuuucucaaagccauccccagagucgcacaaagagucguuucuguauguaacuaaggauauauaacuaaagauuucuugcuauaaguccaaccuauuucuuuucuuuccauuagaguagaggaaugguguccaggugacaaaauaagccccgggcucuggggucacuucuggaguguguuuccggacaaaucgcugucccucucuggacuucuaggcuugccuauaaaaugacuuguuggaaacccuuuucugcuucuacugaaucuagccuagcaaccaggagcagcucaauccuggcuguaacuucuggaagaggaucaacccucauggcgauccugauucauaaggcccuggggugggugaagcaugagccucacucaguaucuccagauucucucccggucuccuacagggcugauggcucuucaguguguccacuggcccacucaccaggggcacaguugucaaccagggcacccagagccuugccguccugccagucucgguuaaaguuggugaugggcagcuggggcacuuuguucuggauccagccaagcagucgcugcuugggugucuguuugcgggcauccucaucaucuucauccucccacaugggcauggaaauggaguagugaaggaucagcguccagaucaggccuaggaucagcuucagguuuccauccacaauagccuugcugucugcagagagaggggaacaagccggcucagaagggcaccucagggugguacccucucuuacccacguugccccuggggcagcuguuugagccccaggguuggauuccuccucucucugggaccuaucuucucugccuaccaaagccuuucacuuacccccauggccggaugugaggucucaucuucagaaacaggcugcuuuccucuuugguaccccuuccucuacccugagaucauccagcacuggggucuaccuccguccuaagcaagugcccuucugaaacgcaagccucuuagggccagacagugauucuguuuugagucggggucuuauguagccuggacuguggcucugaauuccugacccuccagccucugcuuucagaguccugaucuuauagguauaagcacugcacguguuuauauagcacuggggccaaacucagggccucaugcauaccagguaagugcucuaccaacuaagccgcauccagggcuucuuguuuguuuuguuuuguuuuuagcuguuuuauugacacacaggcugcacauauuagagaagauaaucugauaaguguugauaauagggcacaccuacaaaacuauuggcaugaaauaaaaaauaauaaguauaaccauuacuccucucucuugucugucaugucgccacauucucaggcaacaaaucacaugcucucuagauaguuugcauuuuguuguuuuauauaagaucaauugauaaauuuuucuuuuagcuuucucuacucuugaccuugaauguguguguguauguguguaugugaguauuugugugugugugugauuaugugugugugcccuagaguguaccagaccaaugucaggcaucuuuccuaauuacucuccuccuuuuucuagacagggucucucacagaacuuaccaauuuggccagacuugcuguccaggcaucaccaugcauccucuaucuccaccucccagaacugggacuagggguacgccagcuuuuuacaugggcgccuaggaucugaucucaggcccuccggcuugcauggccacuacuuuaccaacucugccaucuccccuggguuuuaugcuucuacgguggggcucaaacuuuacagugucucaguaaaagugaaugacuauuuugaaagcuuaaguuaaaguaguguaggacuggaucaauacugccuacucucugugcugaaagcgaaaaggccuucugaaacacacggggacugggaggagagaagguggacacaguauuugcucagauaaaacuuggaagucaccuugccuguugcugagggucaaugguaucucccaggagggaggggaaauaccacacauguggacucgauucucagagauacuuuggaccacaacugauauaaacuauagauuuuggaauccagcuuauuuguauaguguaauggaggucugaaaucuaucagcuucccugagcucugccuguaggcuagaaagcgacuggaggcucugucuuguuuacugacguuuccugagaaacagagauggugagauuggaugcacccuauuacgcauuguuuucuguucuccuuuccucagaccagagggccuggggagccucugucauccuccgcuccacccccaccugcccccaggaccgaggaauccgugccuccugggccuccccaccacugauucauccuuccuuccccagcagccccgcagcccgccccuuuccccuggcuccacugcagcacaaugguuuggcagcucucagauuccaugacacaccaccucccggugcucuugcccucucuagcuaacacgggcucacaacacuuucacacagucuggacaccccggggaacccucagccucucucacagcugcccaagcccaagccgggcucacagacuccugaaggcuucuucaaaaacuggagccagaccccugggagggagaccuugaagcugcaguguugggaggggauggaacggggugggggggggugggggggggucauucauaguugcuggagagagagguuucucccuagcaacuggccuugggccaaacagcaaguggucccccgcuuggggacggaaggggguuggguagcaggcccagaacuacacccuggaagcuaugaccuuucucuccuuccacccucucaggaggccaggcgggggagagggugguggagcauagcaucccaucaagagucggcuucuaugcuggccuggggaucacccccaagggguaggaggaaccagacagcuaguuugugacccccacuccuugccuagaauagaggggaggagacagggcuggccaagggaggggcugggacagcugcuguccccuccagccccucccucagcuauuggcucuaagagaaggcauagcaacuggagaacagcugugggccagagcugccucauaggccucuuuguuuggaggggcugagaggguguguguguguguguguguguguguggggugcacccagugcuggggguaagagggguaccgcgcucuuucaacccaagccaggcccauaacucuucuuccggguaaacucagcugucagcaauccuuccaggccccaacuuuccuucuagugagaaguggggagucucugaguaccccaacuucaggugcccaaauguucauucaguccugagacagaaucuagcgggagaccccuucccacuucuagauaggauguggaacuagaguaaguugaauggucccuccuugggacacucccuuucugucgccuagggaccucuggcuggcguuugugccccuucccuccagccucggccccagccccagcucaguuacugaauugcugacagcuuaucucaucagcacagggagaaccacuuggcccaaacccggcacaauuccccuuccucucagcgggaaccuuggagcuucccucccgcccccaaaccagccccggcuucuucccccaucuacucugagccggcccccuugcagcagagccaagggggcuggagccaggcaccaccauggggggaggggagaggugcacaggggaaggaugaggccuggagaggggcccaccgcccccgcagccagcagggaagggaggcugagccacuuccuauaaugucuucacagaggcugcaaacuuucccuuggagaccccaccugggacagucagucccgccuuucagaucccagcgugaagggagggguagguggggagcagccccccccccuccagggcuggcuuaucuucagccccucagcuccacacccacccaacacccuccuaauuucuagcuccaccacuuacaccagggcccccucccccaccccuuguccucaggcuuguccuucuggaaagcucagagacaucugcugugucacggagacagggcuauuuccaggccagagcaggagggugggguguguguguguguguguguguguguguguguguguguguaggggggggggguuaguacugggacuggaagagguaaggcccaggaagaagccugaacagggcaaagggccccggacugaucucagcugcuaauuccggagaccuggagauggccaugagggagacuagggagggggcagauaccuaguuaaauauugaagucucugggggcagcuuguaguggugggcaucaccugguuccauauacaguucccuuccagggucuggggugcauccucccagggggguccuucuaguacaucccagaagggcucuaagaguucacccaagacgcaaacuggaaaccuugguccuagcgggauagggcugugaaaaguaagguaucuucuugccacucaaaacccacccugggcuucuggacucucuagacuccugcgccucccuacccccacucagaacugacacaccuuccaaaucugguuacacucaaugacuuccucucuuccucagccuuccccucccuccagggcagcuugacccuuagcuguagccaaucccaggccaggugguggguuggaacagggcauggacaggcaggagucccccucccagacgaccuaaacgaccagggcaaucagggguuaaagcucccaggacguugcucagugccuuuuuagguuucugaggccggguucuguuugcucuaguccggccagaucccagauggggagcacaugccugccaagcgcaucagcgagcuucaggccacuagucucccuggccucagggcccugagaacccagagacgacuggaaccugucuuaagacugcuuuugcccagcgacgaaggcgaugggaagccauuugcuuucauguggguggcgggauacgcccccaaggaauuagcacugggcaccagcccuguccucgcaagcaugugcaagcaaggguggcccgguggaaggaaaagaggggacuuugggcaggucgguaggaguguguguagggaggcugaagcuaagauguuuggacaacuucggaagggaacuucucaggggugccaccuguccuagagggguaucugggcuccagccuguacuggcgagggagaaaucagaccaggcaagggaaagguuuucuguuccggaucucaguacccgcaccuaugugaccuguuccuacccccgcugugaccguucccugugacccccgcacugaccgauggacacgagcuugauguguucccgcuccaggaacuccagggccacagacacauuuuccagcuucauuuggcggaaguuggggcgcggguggaacuugcgguacaugcgcuucuggcugagcacuucgagcagcgcgaugaggcgcagcccgucgcugaggucucgcugcaggucggucaggcgcuugcccacacacuugagaugcucguugcaccaccgcgugaauguguucugcuggaucuucuuccacggugcguccuccgcuagguccuucuccguggacggcaucucguccgccucgucaaccaggccgaggccggaggcguccgaauaguugcuguuguucaucaugguggcgcggcggggggccgggggaguacggccuggggaucgggcugugggugcugucggggcgggacgcggggacaccgaguucucggagacuucguuagcgcucugggcggcggggcucgcuggccucuugggcugagcugcugggcuguccggcuagggcucucucucucucccggggcggagcggugcucgggaagugcgggccgggccggggcaguggguuuaagaagcccccgggcugccgacccccccgccgcgcccgcagccccaggguccacgucagagcgccggccucccaggaaug

SEQ ID NO: 2873 - RNA, 1976 nt, Mus musculus
ccuucuccgucucugucucugugucuccucugucucugucugugacucugucucucucuuucugucucucauuacuuccggguuuggacaagagcugcuaguuccuaguuccguuggcuuccauuggcucuggcuuuuccuuugcugagugacccuagcuccaagucacaggggaaagguuuagucacagucuccccuccgccugcugcaaacugcuuagccccaagaggggcccucacaucugcgaagagacccugcccucuuuuacucaagccuugacuccagagggagaccuucaguuccugcccugccccagcuggggaagggugacuucacauuccaggucuucaaggccaaggcagggacuucuuuggcuggauuuacagccccacccuccgugucccucugcugugaacauggggccccauccugccuucccagcugcacagagcuguuucccaguccuaggcucuggaccauuuuccuauuuccucacuuugggcuccuccccugaaguaagcccagggcuuccuacuccugcugagcccugaguccagacuuuggaaaaggagcccagccagccagagaagggaggcugggcauuuggccugcaucugguguagauguggucggugggcuccaggagagagauguggaagugaagagugggugcuuuuaaucaacacugacuguuguuuguucugaguucuuaccaucugacaaccccuccccucccaguguguguguguguguguguguguguuuguguuucauuuaagauuucauucacauaucccaggcuggucucaaaccugcucuuguagcuuaugguggccuugaauccucccaucuccuugcuucaacugggaaagcuggcauugcggguguaugccaccacaccaauuuccauagcaggcuucuugcaguucagcucccuggauucuuaauuuaggugacuuugucugcugcucacuguacuguggaugcugguuccacugcuuauaaacgggauaacagaggcccugcgggaaguuagggguuauauauuuaguuuggggggcuuagacgggauuaggguggagcaaagguuggaagggaaacagguauacgagcccaauaaaacagaacaaaagaaagaaggaaagaaagagagaaaggaaggaaggaaggaaggaagcaagcaaggacgagagagaacuauguuaacauacaucacauacgugccuggugcuggggaggucagaggugggcguuggauucccugaaauagaaauuauagaugauggugagcagccacgugggugcuaugaacggaacucaaguccucuacaagagcagcaaaugcucuuaaccacugaaccaucucuccagccccuugcagaggguuuucaguccagcucagccuucuguucccauaagcccaugagguggaaguaaagucacugggacugucacugggacccccuagaggaugagcaaccccaaagggcagggacaugguugcuccuggucgcuuaccccgcacccaacuuccugcagagcuuggaagacugcuaugggucaggauccucaggggaacgggguggggugggguggauuggggugggguggggugagaagcccuaggugcgauaggggagcgggcaccaaggggcggagaaccgcggagcccucccugaacaaagacugggugggcggcggcuugagucuccgcaccccgccucccgcagcgccggcugagcacagaccuaaagcgaggcgggucgagcgagcauggcgggggcucgggcggcguugcuaccacugcuccugcaccucgggagccuggcgcuggccgcgcggggugagucggagcguccugggugugccccaacuuauggcucagcccagcagaccgucggaccgggccagaccacuucuccauccccgccuggguugcgcgucgcuggccggccuuggugcucucucuccguccu

SEQ ID NO: 2874 - RNA, 15247 nt, Mus musculus
cggggcggggcgcugccccgggcgggggcggcgcgaugcggaagugcggggcgggcugggcgacccgcgggcggugcagcucggcgagagcucagcucggccgcagcgccaggccggggcuccaggcuccccgcgggcgcacagcaaacagguaggucccggggcugugggcuguguugggcuccucgccccgagggcggugggaacagccccgggcuucagccaagccacggcuccgacccacggcgaccugcacgccccgggcaccugccaacggggccagcggggucgggaucccgcuccuccgcggugggcgaugaucgaaggcggcgccgggccagcgcgaauggcuccaaggcgcuccgcaccaggccagcucggagugccgggcuccggccgccaacguucgcaugcucggggaaagucccaagggcccaguggacauccccacugcgccucgccagggucaaggaugccaagcgcccugucacagucuggcggggaccagggaggagcgaguuuccgaccccgacccugucggcacacagcucgucucuccuccccggccacaccucacuuuuucgacuaaagagguugaggugucaagcagcgaucccucccaaggaucuuaaagccaaggacaggaaucugugggaauagaguuugaggggagacguugucaaauagaggcucugcuccuugacucguagcucaaaaggggacgacgauuuauucuuagcuguugagaagaaucggggcgggggcugauuaaugcuuggucuaguuucuugacggccugccccuaaacuuaagaaguaacaacuuagaaucugaacgugaagggaaaguguaguugggccgaaacgcaggcggagagaugucccgggccaguauucgcccucggugcagaugucucccagacuccaggugucucucgaaccuccagaggacccagagcggguaccuaguagcagggguggaagugggggcuuucuuggccuccuccuggcauagcaaggcggacacgucccgguccagaggagcggaccaggaacggacacuaagccaguaaccccgcgaugacuccaggggcugacccagguuccuucccacccccaccccccuucccuccgcguuaugccccggguggagucugccgggaugaucaggagggaacgaccuggccugaacuccaaagugaggauaagugaucaggaccagaaaggauguggacggggcugacggaggcuggagaggcuaaaagccucgcaugaggaccugugugauacaguacagcauucgcccucucuacucccuaagcuccuggcuaaagucuaggaaagagauagguaggagaccacuccuauuaacuaaaaguccuucggggguuuucccuugaacucuggccuucccccagccugccccugggaggaagccgggagaggguucuuccugccgcaccugcugccccagaaucucagccugugugcacucugaaggggcagggccccgggugugucgcucaccuggagagggcgggauuuaugcucaugccuacugcagguaaccccuggauguugccuugaacugggugugggguuuagaacgggacaauucgagagacaggagggguucgaagcucugccuuuauuccuuccguuauggcagcuucuccccaccagcuccggaguucucagugaucugacugcccaggcagccucuccugggacuucaugaccuuggggugagcuauggggacucuccaucgcagucgggauucaagggcugcuuccaugccccaucacaugugggauacuuccugaggucugacauggaagauggugggggcucuguucguuucuccuuuuuagggcucauagccagacaucucagucugcguugugugucagcacugcucuuauucaaaaccuccagacccaggagcgggcagucauguuuagacgcugcaauugugaacuggcaggcaggaucugacuuagaucuaagccuuuuuuguugggcaggagggagcuucugugggguagaugcugaacuugguccugcucagggcgaggcuccugugcaucuagcugcagguggugccuucugccccuagaugaacacacccuccucucauggcccuggcuugcuguggggaucauuucucuacgucacuacuccauuagaagggacugccgcuuccuaacacugaggccagagcaacaauuucaaaaccuuucucugauuuaauuuaucaucaucaggcugagacagaaagaaagcugcaguguuccuuggcuccuucuuggucuccgaagcagggcagugagugcucugcucuuccuguucauacuacucuugacaugacucucucucucucucucucucucucucucucuguguguguguguguguguguguguguguguguguguguguguguguacaucacccuccauucuaagaucagagcugcuuaggagcuauaaugggagacagagaggaugauguugaggauggggugggggugggucagccgagugagucagaucucugaguugucccaucgggcuacuuucauuucccuuaggucaggguggaggcuggcgcagaaagaggaacuaagccaccucuucuuaagcuugggggcagggcugggagccuuuccacgcucucuguccaaagcuggcagugcuauuccugggucucuggccgcugagguaugcacugcucugaagugcucugaagucuguagagggucgcuccgcuagccuggauguggcauguaguagccacaacccagaagacacuaggugggggaauugcaggggaaacuggggcuccaugcugcaaaacccaaguaagucugcugaguuuuguuuuguucuuuaacuggcugaaugagagagugucuucccaggagcugcuggcaccgcagccuuccucuucucuguuucugaaccccgccccacccccaccccaaguucaagaguucaagaucaagaauauggucaagggcaggaaagagcuucccaggagggaagaugggugagagggagggagcucuaaguuacagguucugucaggaggagagggagcagguagagggaagagcaccaggguuucauggguccugugcacauaacucuagugagauagagacuguggccugccaaagugcuuaccuccaauggaaagcuguuguggcaauauuuaaucucaaugggggggggguggacuaccuugccuuugaucauucaguucccagauaaaaggcacucagcuuuuauauuuauaacgauccuuuaguguaccagagccgggcacauaucacccuucaugcucuaaugucuucuuccccaucaagaaccccuccauguuccaacuuagcugcucuuaauuccaaucggccagcccucguggccaugcuuucaugaggcguuuucuccucccucuaccuuguugucuccccucagaccaaggaacucugccuaucucucuucugcccagcuucaggcuguuggcaucuuuauuagccagucagggauaaucuggggggcaaggauacauagaaucacuugugucugcaugagacucucuuccucccugggggcaaccaggccagugugaagcauuacaauacauggcaacaggaagcuguuagaccuggucugcacuuccugccaccacguguauggcacuggucuguaaacaggagcaccgaauggaugugaaggcaguagcaggagccagacucaaguccacugauggcuucaggguggcaccaucuaagccagguacccggugucacuggaguggaugagugggauuuuuauaaagaguucaagggggaagaaagcuucauuccugaaagaacugaggagaaaugccagggcuacaggugaucuuaaccaaaaggcccaaaacucagaguccugugaacgaaccugucccuaaccccucucccacggucugcuccugucuaaggccagcuuguguuagaagccugugacagacguuuaguuuagaggauuuguuaggagggacggggaagggcaguuucaggggaaagaaguugaguaagaugcagagagaaaagcugggcaaggcaggacagauacagcaugguggaauagccaacccuagagaaguacccguggauuucgcuggcccaccucuaugcaagggagccagguuugccuugacagagauggguggcuugacauggggaauaagacaccugggacaauucucuagugaagcagcggcuggauacugacugcacucaagaauggguggcccacagcacccacuagcacgggaguuuccuucuccccuaacagaacucacaggcugcgcgagcugugacaggaaggugagggaaagcagccuuggccccagacgccuagaaggacuggggugcucauccgcuugaccuguccaccagggcagggaacaucuugcuaucaguuuguagagcuccucuuugcuuucucccgcagagcccuuugccaugaaccacucagccccagggauucccccaccaccccgccgugugaggcugaagcccugguugguggcccaggugaacagcugccaguacccagggcuucagugggucaacggggaaaagaaacucuucuauauacccuggcgccaugccacgaggcauggucccagccaggauggggacaacaccaucuucaagguaagccuuggauaaggugcugccuucuggggcagccccucccuaggaaagagcccuccggaguagagagaggcagagucacguccugccagcuacagugcucaggggaucccacaccuagacucagggacacaggaccaucuuuucuaaccuguagccuagagcaagguggggauggaaggucucugggaggccagccuguaacuccguguagcacuccaugcucuugauuuauguuacacuggacuacacguuacacauacuauaucacaugcacuaaaugaaguuacuagcucauuuuuuggguuuggucuggguuuugagucagggucucacuuuauaaugcccagcuaaccagacucgcuuggguagucaaggcuggcuugacuugucauccuccugccucagccucccaagugcuaggguuacagacauguaccaccaugucuaacaagcccuaauucuggacaggcccuaccaaaauaguuuuacaacagaauauacaguguauaauauauaauuggaacccagucacguuuaagaauguuuaaauauacuuagauauagggucucccucuauauucuugguuggccugggacucacuauguagauuagaauggccuuaaacuuguggaaguccccccuuccuguccuuccagcguguguugggauugcaagccugugccaccaugccuagcuaacuuuucaaagaugucuuugugcuagggaucaaggcuauccuugcucaugcuaagacacauacagucacuaagggacagccccacccccauacuuuauuuauucauuauuuuauauaucuuaaaacauucucacauaguccaggauggccuuaaacucguuacguagcugccucuggccuugaaccucuguuacucugucuccagcucugaaguacuuggguagauuacagauagucaccaacacacgcaaacccacacauagguuuuaauuuuuccuuauuuuuuuacuuacuuauuuauggggagugugcaggccccagaguaugugcacggaggucagaggucaguuuggaagaguugagucucuccuuccacagugugaaucccaagaaucaaacucaaguugucaggcaggcuggcaagugccuuucuguggagagccauuuugcuggcccacacauacuguaaccugcauuuuuuucacccaauaucaggauuagcuuuccuuuucaagaaacaucugcuucacuuuuugugaccauugaauaacccucugcaaggacccgguauaacucagucacccaucacuucagacuguuuuagauugugcuuccaggcaugaucucuccuaaauucuaccuuuugaucuaauggucagaugaggucuaguguucagaguuuaauaaaauuguuagaccaaagagaugcugauuuuaaaacuuaaaaccuuuggaaucuuauuauuuuagcguuugaacuuaauccuuaccacaauguaugcggauauuucuauauucuauaaaguucuaucaagauuaaguugcuaugggcuggagagauggcucagcaguuaagagcauugacugcucuuccagagguccugaguucaauuucugguaaccacaugguggcucacaaccaccuguaaugagaucugaugcccucuucuggugugcgucugaacacagcuacaguguacucauauaaauaaaaaauaaauaaaucuuuuaaaaaaaaagauuaaguugcuaguuuaaagagaagaaacacuuauaauuuugacaucaccaaauuaccaugcaaaaauaacaagaucaauuaggggugagggucagagguuaggaggcugugcuuagcaagccugaggcucuguuccauccuuaacacaacagcaacaacaacaauaauaacaauaauguugaugauagcuggacuguaggcuugggcccuauaaucccagcacuugggagauggaaacaaguggauugaucaagaguucaaggccauccuugcccauuuagcaaguuugcaaccagccuggguuacauuaggcacugucucaaaagagaaaaggaauaaggagaaguagagagagagggagaggaagagagucagggugggggugggggugaggagaaaaaggaggaggaggagggggaggaagagaaggaggaggagaaaacaacaacaaagcagcaagaauaauacugaucacugaugcauaccugcuuguugguacaguuccaaguaccuuaaagauguugacuccuugagucuucucugguacagucaaggaggauccaaaacagaggcagcuugauuuggucugcuuggccucaaacacagccuggcuccaagucacaagcucuccucucuacguuuuuuuuuuuuuuuccuuguguuccuuugagauuguaccugcuugcccuccuagcagcagugaguagaauucauugaguuugucugaacugugaggguuggacaagaucuggucuuauccaccuaaugagccugucuggcaaggcuuagccugguggccaaaacucuuagcauugacuccuauaggacaagagaguugcuagggccucggugacaguuaagguccccuguaaucugcaguccucuuuuccuuccauaggccugggcuaaagagacagggaaguacacugaagggguggaugaggcugacccagccaaguggaaggccaaccugcgcugugcccuuaacaaaagccgugacuuccagcuguucuaugauggcccucgggacaugccaccucagccguacaagaucuacgaggucugcuccaacggcccugcucccacagguauaauguggcccugugugaccaccugaaagcuaugaacucuggguacaggaaaacccaaagaccuuccagccaagggcuccagggugggcuucaggggcugugcuaggucaugaucgcagggcuccugugaguaucugggaguggggugagggcuccaggugcuucuucauuaccacugcccuugcucugggcucuuggcuucaggggaggccuuugccugcugcuucuuggugccagcucuuugacccacacauaugugggcagcuucaugggugauguggagccccaggaguuuggauaaccucuggcugcccagauggagcuacagccugcccuggcucccauuuuaucacugacuuccugccuugcucucucucccucgacacgcagagagccaacccacugaugauuacguucugggagaagaggaggaggaggaagaggaagagguguguggggaugaggaugaggcuggccucggugggcucugcugcccacccuugcuucaggaucacccacuuccucuguggcccauuguccuccacaucucuucuuugggucauccuuugaugguucugaaaggaacggaguggccaucuugucccuccuagggcuuuauugaugcauagugugucacaugucugccugaccgccaccacaguugggcuugguggguacuacugccugcagaaugcacauuuagaaauggggacauccacagcuuucaugaccuguugaggauggcagaucugggaccagcaguggagguuggccuucacugagcugaggcugagggauugccuuuuguuuguugagcacuguuuccucaggaucagaccaauuuaauaaccuguccucccuucuguccuccuccucugcccguguuuucccuucagcuccagagaaugcuaccaggccugagcaucacagguggggcugggugguggugugguugggggauggggcuuguagcauaagaagugauggguauucuagguacuugagagggcacugagagagaggcugugggaggcaagucugggagucaggccugggagauaguucuuagagguggcuuuagcagcuguauccaccccauucucugcagagccugcgcuaccugggccucccaacgcacccuauuccuuacccaaagaagacaccaaguggccaccugcucuccagccaccuguagggcugggucccccugucccagacccaaaucuccuggccccucccucuggaaauccugcuggcuucaggcagcuucucccugagguccuggagccuggaccucuggcuuccagccagcccccuacagaaccacucuugccugaccugcugaucagcccccacauguugccuuguaaggaccuugacaggccaggcggguugccagggcagagucguggggauggggcaggguugcacgggaggaggauggcgaagaaaauaagccuuuaggccagucuuccugggucaaggcugaacuggggaggcuggggaaguugggccuaccacccggcugcugaguagcugugaggcucacagucagggcaacccgacucucugcuccacagugacggaccuagagaucaaguuccaguaccggggacgcgcaccccggacccucaccaucagcaacccacaaggcugcaggcucuucuacagccagcuagaggcuacccaggagcaaguggaacucuuuggcccugugacccuggagcaagugcgcuucccuagcccagaggacauccccagugacaagcagcguuucuauacgaaccagcugcuagauguccuggaccgugggcucauccugcagcugcagggccaggaccuguacgccauccgucugugccaguguaagguguucuggagugggcccugcgccuuggcccauggcuccugccccaaccccauucagcgggaagucaagacgaagcucuuuagccuagagcaguuucucaauggugaggucuguucugugcuccuccuggcugccccucacucaggauuggguuguaaccucuaacuaaaggccuucaucuugaugcagagcucauccuguuccagaagggccagacuaauaccccaccaccuuuugagaucuucuuuugcuuuggagaagaauggccugaugucaaaccccgagagaagaagcucauuacuguacagguguguuccuagccaccucugauguagcuugaauguuaggaaacauggggcugggcccuugacccaggguagacguggagcccccuggggccaugaggacuugguugcuagggcuggaggagacugucuaccaucugcuucuggcuaucuucaugcccaguuggguugaucagcccugccacaauucuccuuguccugucuccccuuugcuucccaggugguaccuguugcagcccgguugcugcuggagauguucucaggggagcuuucuuggucggcagacagcauccgacugcagaucucaaacccggaucucaaagaccacaugguagagcaguuuaaagagcuucaucaccucuggcagucccagcagcaauugcagcccaugguccaggccccuccuguggcaggccucgaugcaagccaggggcccuggcccaugcacccaguuggcaugcaauaaugaggcuacagauaguggcugccuuggaccuccugggacagccacguagacugauauagcaaugugguggccccagcaggccuggcuggcuacaggguucugagucucuuggaagcagagucgggguaacaagaacauagaagagaggccugagguuucauuuccccuaaacauuuucuauuugagcaccaccuucuggugauuucucuaauaugccuggcugggaagaaaugaagccagcagccccagugggagggagggaacaucacuagccugaggccuuuaguaccacggaguccaauuaccccaggguagccaacuuuuaagguugccccaauucuucuagcaaaaccugccaaggaguguugugggggcuuucugcagagaauaacccugauuuagggguccccuaguuugaaccuuuccccucauccuuaugacaaggauuucuccaggcacccuccuucagagucugagaugcugggacagaaaguagaauuuaauauauuuuuggauuaauaaauguuaaaaaccaggucugcccauuuauugacuguuuccagugccaguggcuucuguuguacugggcuauucaguugccagucgccuggccccagcacaguuuggcaguggugccuggcacaggaguuggggaggcccugccuuccugucagugagucagcugggccuucacacucaccuggcuggcuuugcuuucaaggaggacgcagacugagacaaauguggaauucugaaugugugcugucuaaaaacuguccaaaccuccccagaagagaaugacgaaauaauagaaaaagaagagaaugaagaaauagccacacuucaggccaucaaaaccugggauuuuuaagguuuaauuuuuuuuuuuuuuuagaccagacuggucuuaaacuugcaguauuaaccaaaguugucuuugaacuccugauccucucuucuugccuccgucuccuaagugcugggauaauauauuagccuaaguguaguagagugcuugcuuaacaaugcacaaggccauagguuugauucccuguaacauacauucaaaacaaaaaagguuuagcugggugugguggcucaugucuguaaucucagcacaagggaggcuaaaacaggaagcuuggcaguucaaagccagccuagaauggcagccuacaguaagagcugaacauguuuaaaaaacaagucuugucuucuugaaugugcuacuaauauuaggccauuacaugcaaaucgguggcucaucacuggaaacuggcucaggagcaauauucuaguccaaauaauuguuuuaucuuuuugggguuuuuuuggguggggggggaguauggggaaggagguggugguggcgguggcaaggucugcuaugcagcccuggcuguccugcagcuugcccuguagaccaggcugguuuugaacucaggagauauaucugccacugcuuccugugaugggguuaaagauguguggcaacaugccugggacauuuaucuuuuuaugauggaagacuuuacacauuugugagaaaggaaaaauaaugguaugaaagccucuguccccguuuuaaagaucaucaucugaaugcuaucuuucucauugcagcuccuguccaggcucccaacggugauuauuuugaaguaaauacuagaaauagcauuucauguauauucuccuaaaaccacuccccacuccccugcccugggggaugcucaaagguugugaucuaccacugagcuaaaauccccagcuacuaaagaaaaaaacugucuuaucaaguauccacuuuaugaggcucuuagagaugaauaaugugcuuccaagauccaacuuuggauuccuagcccacguuacaaaaauaaauaaauaaaaugaaaggaaggaaggaaggaaggaaggaaggaaggaaggaagaaggaaggaaaagagagaaaagaaagaaaggucgggcacuaagguauauguugucauuaggaagcagagcaagggaauuccugaaucucacugguccuggcuguauguuaucuugucucagagaauuuaggagacugcccaacacuagccuccacguguguauacacacauucacgugaacacguacccagcagucacacacaaucuagugcucguaaguucaaggcagccagaggacgucuaucuccauuaguggugggacagcgcugcuccugauuacaccuguuguauuuuguaugucuguuguaugggugacauaguuuguaugcugcuggaguccagaccguugauuggauucagguugcgauuuugacuacugauuaaugaguauuugaguuuccaacauucuuaaaauaacacagugagggccagagaaacggcucagccaguaaagacucuugccaucaagccuaaugguucaaucccaggaaccugcauaguagaacugaccugcugugacacacuccccuccucauaucaucauaaauacauguaauaaaauaaugcaaugaaaagcuagugcuuuucuauguuucguagguacugguaaaaaugccagggauacuuagaaaugucuuaccaauagagcauacucucaaaugugacuuuuguuaacccgacagguaaaaaauacuaccucauuccuauucccucucuugagcaaggaugagcagcuuuucgaaugguuacauggucuauguugacuuuaaaaguuaagcggaacuggugggccagcuacauaaggcucgccaugcaagccccacccugaguuugaccucuggaaaccgcagaugcgugugucccccauaucauacacacacaauagcuuaaaaaguaaaaaccaggguuggagauguacgcucagauguaggaugugugcuucugugggaagccuugaguggcagcgccagcugucaacagucaauaaaaacagcagcagauguggggcacacacagaugaacagacucccggcaccuugggaggaugacgaugacaacugggucaaagucauugcuagcuagcgagacugacucaaagcagaagcugucaccuuccaauaaacacuuuaguuuugggaaagcuucuaaaauaagaacauucuugcacacuucacacuauuucuaacuauauaauauuaacuccuugcuuuguuuggauuuuguuuuguuuuucagacagguuuucucuguguagcacuugguguucuagaacucacucuauaaaugacaaggcuggccucccaagaacugggauugaaggugugagccacuaccuccuagcuaggauuuuguuauuuuuuuaacucucucccacucucugggacucgggauuccauccaagauccuauauuugguuacguuuuuaccuccuggucuacguggauuuaauaguaaaggucacagaaaugucccuccuuuggcuuccauugugugcaugucucucccucccaugcaaaugugcacagaacagccacguccucagcuuaugugcacuugcacaugugugugacacacaguucacucccacugagguaggguggaaggugagaugcagcaggaggggcuuccaacaggaugcagaaucagcagcuccuuguaacgcuugcuuucugucugacccaguuccccaccgacacagaggcucacguauuuaugaacuagcgccuaggccaucugcuaggcuuacuccacaauaagcucguaacccuuauuaacccagucacacuauucuaugucugccaugagcuggucacuucucaguuucauaguccaacuuccuccacaucucaguggcuaaucucucaggccugacucuuuccaaguuccuaucucucugcuggguaucccaccuuacuauccugccuugcugugggcugcugagcccuuuauggaucucuuuacacagugagcaagauuacuccuacaagauacgucguuuuaagcucucugcuuagacgccuuuuagguuccaugaaagcugauuucauagguggaucagccaagucauugcugaacagcgaguagugaagggaaauaaaaacacugguaaaauuuuaaaaauugguuuuauuuuuuucuuuuuucugguuuuuuuuuuuuuuuuuuuuuuuggugcuguugauuuauucauaagauggcuacaccacaggacagaacagugcccuugaaggcaauuaauuuucacacuuuuuuuuuuuuuuuagcaaaauacagguagcccuguaaauacauucccuccagacucucacccucuuuuuuaucccuucccaccccauguuuguggaugaauaauucacuaaaagagagagagagcaagguuuaauccauauuuguccucuccacccaccaguuuuggcuuuucuccccaaggcugaugacaaaggcccaugaacuggauuggacuuagcaacucaauaggaucaggguugggcucuacauuaaaagcaacuuugacccuggcuaguccggacuaucaucccuaaccaugauauaagcagaccaggcuccuugucuggacauuucuaaaggugaacaguuggggggggggguguuuccucuauucaccuguguuuaaaggaaggagagcagaggaggugacccuaccucuuuaauuccaacuguaacuauguuaccuacucgcauccccgcgcuucccuaagguaaugugucugucucacugucgugucucagugugugcacugcaugcuggugugugucuaucaugugugugcaucaucugcuaccaggugcauauuucaguucuggugucaucucagcuuuccuuuuuaaaaauuuucuuucuuuuuuuaacuuuucuuaaauuauuuuuccuuuuagaaagaaguucaccaggaaacuaguuccccucccaccacgucggacaggcuccagccauccuuaaaaaccgcgcuguuucucccucacaucccaaacagggacuccuuaggaugccuuggagggugaagucucucccuguguggcgggauggucuggugguagugaaggccccucugccacaacagagguuucugauugugggacacagucuggguuguuuucuuccugucuucuaauaaaaaaagacauuccuga

SEQ ID NO: 2875 - RNA, 1535 nt, Mus musculus
ggaaaggaggggggagggagaguuugcaaucaacaaagcugaaaggaacuggagaucugaagagugcuuugacaucugacaugcagaugaauaauuugaguuugcccagcugcuuuuuggucauguuuuaguccagcaucuccucacagugcuccucuuccucccuucuggaacaguagugcauauccugugccacucaauacuggaaguaugugaucugccuuuucaucuugauuuuaugagggguuacaguuaagagacugccacgagucucagaagaaauucuggacuuguaagcagucuaugaagacuugucaagagauggugaaagacuauggggacuucggaaguugaacugaaugcauuuuuuacacuaugauaugguuauaagccaauggggcccacgugauaaugggccuucugaaacuguaagcaagucccaaauuaaaugcuuuucuuuauaugaguucauugaucagaacagugacuaugacaguaagaguggccugggucucuaauuaccuccaccuuuguccccaauccuaccagugacugaccuauguggcaagaacuccagcuaauuuugaacuuaaauguccuugguggguaagcccacaaaaaagcaucuuaaaaguuaguccguuuucuuaucucuguucucacagcacugcagcauugacuagucucuggucccugauuuuacuauuauuuuucuagguuccauuuucuauauucuagucccauaauucaaauuauucucccaaauaaguuuauggucacucuuccucaagacuuaaucuuuuuauuuggugucuugguagguaaugacaaccugagcgucgagauacuccaucuggucucucguuccaaaaucaacacucuccauguucagcaccaauuuuuuuuuuagcuuucacaugucaugguagacagucacaguaagauggaaaaguuggaaauaauggcaggauuucuucuagucuucauuauucugagcuaguggcagauuacuauguuuuuagacucagcuuucuucaaucugaccaauuuaaaaagcugaggaauuaauuacuaacaccauuugaaaagcaggcugaaacuugcuacaaugaagcugaaccaguucacccucccugcuaagguggcaaacaaaacagcauguugaggcaagaguuagaggaccuuaaaaccaaaagggagacugagucauucacaguucaaggguugcacacacuagagaauuacuaagaggugaguaaucccaaaccucuuuuuagcuccauacugccucuuaauauuuacacuuacacacacacacacacacacacacacacacacacacacacacacacacacacacacacaauuugccacagccugcucuaggaguuacagaacuuguuuggcaaugaaggucaaggcuacuugguucaauccccuucucgcugaucaaggaucaagaauaugguucuucuuaauguugcuuugcugagggccuugcccuugcccuuuucuugaauaaaaauguugcuugu

SEQ ID NO: 2876 - RNA, 27032 nt, Mus musculus
gccagcuagagcaacaaaggagcccgguagucggcagggagagcucagggggcugcggcgcgcucgcgcggagguggcugcugggccgcgggcuggcgugggggcggagccggggacccacucccgcaccccccccccccccccggccggcgccuggccuccaucgaggggcugggagucgguuuuaauggugggagagggaauggggcuggagaucggggccccggaggguucccaggguugaagacagcuucgaucuccaggccagggaguccggggucugugcauccuggcccgggccugcgcugcucaacauggggcccggguuccaaaguuugcaaaguugggagucgaggggcccggacgcgcgcggcgccuggcgaaagcuggccccagacuuucggggcgcaccggucgccuaaguagccuccgcggcccccggggucguguguguggccaggggacuccggggagcuccggggcgccucagcuuuugcugaguuggcuguuuggccauggccgcuggccgccccgugcgugggcccgagcuggcgccccggaggcugcugcaguugcugcugcugguacugcuggggggcccgggccggggggcggccuugagcgggaacgugaccgggccugggccucacagcgccagcgggagcucgaggagggacgugccggugaccagcccuccgccgccgcugcugagccacugcggccgggccgcccacugcgagccuuugcgcuacaacgugugccugggcucggcgcugcccuacggagccaccaccacgcugcuggcuggggacucggacucgcaggaggaagcgcacggcaagcucgugcucugguccgguaagcgcgcgggagucgggauugcgacgcggaggugaugggaccggccacugacggaaagaaaaggcucaggccucaaacuguugggcgggcgcggcuugcacccggaauaguuggagaaacgaguccggaacuuuugggacagguugcgugcgggaaggagacucugcguguuggagaaggggucggggcaagagaccagggaagccagucggucacaaagagcccgaguaaggaugggguuagggggaugcaaggagggagaagagauguauucgugaagcaacaguccauggggauucugggcaguguucagaccuugaggcaaucugaguuguagagaagaaagagaggaugaagguggaagacauuuaaggauuuggagggaaggggcgaggaaaacuuguacauucugagaaggaaaaaaaaaaugccuccuuguaguaacuaaaaagccaaacgaaccaccugguaaucuugauuuagaucagcccagggaaccaaugauuuuugucuuguuuuuacccguuuaaguuuccuuaucugaaaaauggaagcucugauccacucggguuaagaaggagggagacgauuuaaacaguuguuuguggcucuguggaaaugugaagccucacgccaguguaugcuguggaggaacauuaagucugggguguugagagccugugggcaccguccagaguggcagaaaguccuuuccuugggguaggauugugacagagccugaaaacagcagacuacaucaaacaaguccuuccuaggcuauuuaggaugguuuaucucucugccugucacccaguuggacugagagccuguagggugcuggggaggggacaguccuugucauuuucccaucccucuuccccaccccgaacccccacuucggugugauguaaaagcuguccuugauggaaaaagaaaauaaaauugagagcccggagcaaaccagagagccugacagugucccuagcuuuagcucuuccucugagguugugaggcuccgacuaggagguagugugaaccguaggcugacugucuugggcugagguguguugucaacuugacuacuagaguucucaguuguagcugagugcugccugggguccuaagguucuuggcuugaugcagauguuggagcaggaacuuggaggacggcggguaccgagaagauagaacuguauucuauggagauaagguucuaaaguaaccuauagguggagaccucucgagggagucgaaugacgcuuucacagggguugucuaagaccaucagaaaacacagauauuuacauuaugaacuauaacaguagcaaccuuacagucaucaaaauaauuucaugguuuggggagcgggagcgaacuguauuaaagggucgcagcauuaggaagguugagaaccuuagaagcuaaacccagaaucuaaggcagcagcuauauguaaucaacaguagcuuugaaaaaaaaaauccauaaauuacucuaauguaaggucugugugauuucacacaugcacacuuaugauaauauguuugcauaaaugcaguauagaagauauaagaauggacauacagagggaauauaauuguagucuuuaaagcuauauaugugcaaaagacugacagaaugaaaacggaacaugaaagaaagauuacgagcccucggauggcucagguagaggugcuugcuaugcacaccccaugaucugagcagcaugcccagaacccaagagagaagagaccugugugcugacagcuguugucugaugcccgggugugcccuguggcacccauguuccugcucacacacccccgacuacuaaacaacaacauuuuuuuaaaagauucagccagauaugauggcgcacgccuuuaaucucagcacugaggaggcagaggcaggcagaucucugaguucaaggccagccuggucuauagagcggguucuaggacagccagaacuaccuaguggaacccugucucaaaaaaaccaaaccaaaccaauucaaauaaaaacaaacaaacacccuuaaaagaauacaaaaaggaaaguaaucuucaauaagguauggccugaaaugagacuugaauuuaggaggacgccauaugaaaaauccugaccucucagcacaagacaaucaucaaguuuuguguugcugaaaggaugcucucccccacuuccucucucucucucucucucuuugugugugugugugugugagaguugauucacagggccuaugacugaauucucccaagugacaguuacccucugaagcuguuaucagaucaaggaggaagggugcaccuuucccagcccaugcgcccaagaguggcugcugagcugcaggagugucugcaaguuagaaccaugugcuggguguucagguuuuggucgcucuagcugcuuaaucauggcgguacaggggcacaagcucugagcccagagcuucugacucacacugaguucuuuccuguugcugcccauuuacagcuuuccucuucuccguguguggacuagaagcaggugcugacacaggcuggaucaguagauggggaaggugaaagggagccgucagugagaaucacaggcagguaggagccaggagcuaguguuuguccuaucuggaauuauagguccugauuuaguguuauuuauugucucacuuuggcaggugguuuuguggguaauaaagauauucuagcuuauguucauuauaaacuuuguaggguagagauucaaucuuuauguuuuucagagccucucugggcugaguauacagccuaaauccacacauucaauuguacugaguacaucacauccuggggcagggaucgagguauaucaagauggagauuacagaaaugagcucuccgauuucaagaggaggaaggacaauuaaacggguuggcaauaccugugaaaagucuggucacaucguaggugcugaaggcacacgaagagcuuuggggagcaagagaagauacccagagaaacugacaucucaccggugacuugagaaauaaacaggaguguccagggaguugagccagagaacgggaagaggcaaaggcuuuagaggaacagagaaugguacuuagagauacaauguuggcauagaacuggaccaaggcacauuagaagcagaacuguaagacucagggggacuagauugcaagggcucacccuguaguaaguuaagaugcuaccaaucaaaagaugacaaggagccuaugauaagcaaggcuuuugaaacaagguagaaauguaauuguaucugcauuuugaaaagauuucuuugggcuaggugugguuggugauacacgcucacaauuccagcuuuugggaggcugagacaggaggaugauugugagugcuaggucaaccuguguagauagugaguaccagaccaguucaagauuucaacucuaaaaacagggaaggauugaagugauuguucagggguuaagaauacucccugguuuugcagagcaccuggguucgauucccaucaccuacaucugguagcucacugcagccuauagcuccaguuccaggggagccaaugcucucuucuggccuuagugggcaccugcauaugcgguguauguacacacacuugggugcacacauacgcauuugaggggcagggguugcuauauaaaacagccgccagagagaaggaagaaccuggaaccugauuauuuggucaggacauggaugaaauggucuuggggugggggggugauaguggucaggauggggguaacaggcugaaguuugggaagauuauaaugucggaagcagauuugcugauguguugggugccaggcugagcaggaggaagagugagaugcuggggaugguggugcccuuccuuucuacuggugguaguagagguagggugaggauggaaguguggcuuugccuuuggcuuuguguguuagacagucaguggauaucuacauggagcucuguggcagaucugggaagaguuuccauagagaacaggccucuauaggcuuucuuugcccagacuaccaagucugccagugaugaagucucuaacgaggucauucugauuucugcgugugucuagaacucaggucucucccaugguuuucaugucuacagacucgagcuucuuuauucacucagagucucccccauuacagcuggaaaugucuccuaccaugcaugccaagcuagccagacaacaauggccaagcugugcgugggccaccuugggacaaaucugguuuaguaaguggggccagaaagagaggcuugcaucuggugaggggacaggucccugagagucagcacauagacuccuaguccacugcuaugccaugucugcguauacauggauauguggcucuguugccuagccaggguccagccagcaggaaaaagaccggaaaacugggaggaauuucuuacuggucuuucagaccucaaguugggauguuguuggugauggguaauuugcaaggauaguucuggaaaauuuuuuccuucuggcuguuuccaaaacaggccgagggcaauuaaaaauucucucucucauucucugugugugugugugugcguguguguguguguguguguguguguacauugugacacaugucugaguccagcaauugagaggcuaagacagaaguauaguugaaaguuugaugccagcuuuauauauauauauauauauauauauauauauauauauauauauauauauauauguguguguguguguguguguguguguguguauguauguauguguguguguauauauauauauauauauauauauauauauauacucuguuucaaaauaaacacauaaauuuuguguguguguguguguguguaguauacaagcacagaaaauacacaguuuucauuuuugcuucauuuuuuuuuaaagauucauuucauuuauuuauuauauauaaguacacuguagcugucuucagacacuccagaagagggcaucagauuuuguuacagaugguugugagccaccaugugguugcugggauuugaacucgggaccuuuggaagagcagucggugcucauaaccacugagccaucucacgagccccccuuugcuucauuuuuaaaaugguuuuucgagauagggcuucucuguuccuggcuguccuggaacucacucuguacucuguagagcagguuggccucaaacucacuccugucucugccucucaaguaugguuuuaauuuugaguuuucuugccaugcugggauuugaaccuaaaccauuaguccuuauuucuaugauuugcauuuccuugauugcuuguaaggagaaaccucuuugcaguuguguguuaccguuugaauuucucuugugaaguaucugcucagauuacugaucuauuuucuaggagacuaucugucauuucuguuagauugauggggauucuucauauaugcuggagaugaauguuuuguuuauugugaguguuaaaaauauccucauggcuuacuuucacagucucuucuugguguugucuccaguugaacggaguauuugaacuucaauguaguuaucaaacauuuugugauucauucuuuuuuugugugcuuuauuuagaaaaaaaaaauccucuucuccucccaaaucaugaauuuauuacucuuuuaugagaaauguuauagauucccuagucacuuuuaggcacagaauucaccugcaguugauuucuuuaagagcuuucaaaagcauuuguuaaaaucaauuuccgcucucuacuacuguaccauaaaucuaauaugugcguguguuucuggaucuuuguuuuguccauaucacauugucucaguuaccaugccuuuacagcauggucuucaccagcgugacaacugguaaaccugcacccucccucgcaacauaguauucuuaaaucuauagaguaaaauaugugggauuuaaaacaacgugcaggaucauagauccagaauacaguaagaacuucaaaacucauuccauuugauagaagaaccaagccaaaugaaaauaaacaagcuggguugaaaaggaggcuguagaucuaaauagacauccuuaaaagaaaagacagaagacguaugccaaaaagcacuugacaacucgcucacucagaucgcugaucaccaggaaaaugccauucaaagccacagugaaaugucacuccaccccaggaagaauggcuaauguaaaaaaauauaaaauacaacaaagugcuggugagaauucgaaggagaaaaaggaacccuuacaaguuuuguguguguguguguguguguguguguguguguguaaaauuaguuugcccuuuguggaaaccacuauaaaaacuccucuaaaagaaaucccuuuacuagauauguauccagagggagugaagucaggaggcugaggagacagcuucaugcuccugcuuacugcagaauuacucacacagauaaaaacagccaaagcauccaugaauggaaagagaaacaugcccugugugguggcccaugccuugaucccagugcucuggaggcagaggcaggcagaucucugugaguucaaguccagccagagcuacauagaaauacuaucugaaaaaccaaacagagcaugaugcccauucagaaugaaauacucuucaguccuaaggaggaugaaguccugucacgugaacacauggguggagucagagaucacuggcacuaaguaguaaguaaguagccacuauacugucaggugcugaugagcaugaccugugaugugacuccacugagauggagcgacauccuagguaaaccgaaagcuaagagccucuauuuuauaguaucaagaggagcgcuugggcuguucuugaggcuccccccccccccaaaaaaaacccuucugugugugggugugcgagugcuguguucaagacaaggucucauguaacccuggucugccuggaacuuaucaucauguagucuggaauucaccauguuaacccaagcuugcuuugaacucucagcaauccuccugucucaucagccuucuggguucuuuuuuuuuuuuugguuuuucaagacaggguuucucuguauaguccuggcuguccuggaacucacuuuguagaccaggcuggccucgaacucagaaauccgccuaccucugccucccgagugcugggauuaaaggcgugcgccaccacgcccggcgccuucuggguucuugauuacuggugugaaccaucacauuuagcugauacauagacacuggaguguacauacacauauauuucaaaauuaaucuuuuauuguuuuuuaaauauuuauuuauuuauuguggggugugcgcaugugcacacccauaccugaugaccugaguucuguuccuaggucccauggggcuggaaaagacaacugacuuccccaacuuguccucuaaaacauccacaagugcgcugucgaaugcacacaauaaguaauacaaaucugaaucaaguuguagaaauguuauuuuaaaauucuauccauagaauuuuuugcauagaaaguucgcauggcaacaccgccuuuuaauccccgcauuugggaggcagagguagguggaucuucaugagagauccugguguacaaagcaaguuucgggugaaccagggcuacacagugagauacugucucaguaacuaaauaaaaaguaaauaaauguuaaaguuccaugguuauaaaaacacaccuauacuaauauuguuauuaugaugguggcacuguguuccucuuuuucuuuuuguuucauauuuuauuaaacuaaaaaaggaguagguguggugguaaaugcuuguaauuccagcaugaacugggaggauccugaguuuagugccagccugggagacguagcgagacucccaccccuaagucaauaaauaaaugaacuaaauaaauaaauaauaaggcuggugcgauggcccagggggugacggugcugccugccaagccagcugaguuccauucccagaacccacaagcugaaaagagagagccaacuccugcaaguuuuccucugaccacacuugagcucacacacacacacacacacacacacacacacaccccuuaaaaaauuaacaaugaauagauacaacuuuuuucuuucuggauucauuuuauucucuaggaaguuuuccuuguccuaguaauaauacgcauugcauuucuuuauuuuauuuuuaacuuaauugucuaaaacaauaaaggaaaaaaaagcacaaaaaaugaaagccagauguggaggugcacaucuguaaugccaaccuuugggagauggaggcagagggagcaaguguucaaugccauuuugacuaugccagacucugucuuaaaaugcccaaaguaaauaaaacuaaaaaccaaacacaauccacuguauagccuugccugucuggccuggaacuuucuauguagaccaggcuggccuugaacucucaggauugggcugccucugccuaccgagugcuaggauuaaaggugugugccaccacacauugcuuuaggaacaggcaguacaugugacauaaggcugagaagaaacaagauaaaccuuacuuccacuugcuaauacccauugccccucagaggcagccaugaauguuggcuauuuuuguguguguucuuuuaaauauucgugacagauugcugguugucuuucaucuucccccagguuccagucaaucguguucauuuaacaaugcaugucggacccuauuccauuuuaguauacaugguucaguuccgaguuguguucuauuguauauuuaaaauuuuuugugcgguaucgauauguccuugguuacuuuucgauugcugugaagagacaccacgacuggggcaauuuauaaaagaaagcauuugauugggggcuucauuacaguuucaggaggugaggcuaugaucaucguggcagagagcacggcagcaggcagacaggcuggagcaauagcugagaacuuagauguugagacaaccaccauaagggggagagagcgagcgagcgagcgagcaagagagagagagagagagagagagagagugagcgagagaacacuaauugggaaaggaguaggcuuugaaaccucaaaauacccugagugauaaaccauaucuaacaugggcacauccuaacccuccccaaacaguuccaucaaacagggaccaacagggaccacacauuuacauauaugaaucuauuggggcugucaucauucaaaccaccacaggguauuuuaucuguguguauguguauccacugugugcacaccggagaugguugugaucugcuaugugggugcugggacucaaacccuguuaugugcucuuaacggcugagccaucuuucuagcccuuuguguauuagauugguuuuggugugcgugcgcguaugugugcaugugccugugcaugugcgugugcgugugcguguguguguguguguacauacguacaugcacacaugcacuuugugcugggacuggaacccaggacguuguacauaauaggcauuugaucuaccacugagcuacaucccagccucugauguguguguuuuuuggcuaaucuauguaggauauggacucaagcuguuuucccuucuuuugcucuugcagagaguacuaucaagaguaacccuauauaucaucaacuugugaaguaaauuucugauaauguuaaguggccuccccaagauuuagcaauauuuguuaccucugccuguuccccccucucuccacgugcuuggugggucaguauuuuacaaauguuuucaucuuuauuagucuaaaggacaacauguuauaucucacuuauuuugcauuuaucaugcuaagagugcgguugaugauuuacauuauuaaaagccacgcacuccuucucugugugauuucuucugccauugccuguuauuccacaggguugugcauugcuuauugaucuggaagagcuuuaaggagauuagccuuuuuaacauugauauguauuaaaaauguauuuucccaguuugcuaguuuucuuaagccaggacuacacagagaaacccugucucggaaaaaacaaaacaaaacaaaauauuuuuauuuauguaugugugcaucacaugugcaugggagcccucagaggccagaagagggaguuggaucuccaggaacaggagcuacaggugguuguuagucucguggugugggugcugggacauaacuuggguuuuguggaagagcugcaagugaucuuaccugccgagccauugccaagccaugucucuguccccaagguuuuccuuuuuauucuauugaauuuacuagauuuuuucuggaguuuuuuuuuuuuuuuuuuuuuuuuucauuucauagcuuuaacaguuuuguuauuuguuuggggugugugugugugugugugugugugugugguguggugugugugugugugugugugugugugugugugugugguaugugugugugugugugaguguguguguguggugucuguguguguguguguguguguguguggugugaguguguguguguguguguggugugugugugugugugguguguguguguguguguggugugugugugugugugugugugugugugugugugaugcaucaaaaggucauucucaccucaagguuuaaaaaaaaacauuuuccaaagucaggcaugaugauuuuaaaauuccagccuugggaggcucacucacgugaauugucauaagguuugaggccugguugaacuaccuagugaguuguaggccagccaagauuauauaaagaaauccugucuuaaaaauaaacaaccaaauagggcuagugucuuaguuacuguccuguugcugugauaagacaacugaccaaggcaauuuauagaaguaaagaauuuauuuggggcugagagugucagaaaguuagaguccaugaucaucaaggcaaggagccuggcggcaggcagacaggcaugccugaagcgguagccaucuugaucuacaagcaugaggaagaaagagaaaaagcuaaaugggaauaauguaggcuuuugaaaccucgaagccugucccugauccaccaccuccaacaaggccacaccucccaauccuuccaaacaauucuggcaacuagggaacaaguguucaaauauaugagccuauggguggaauucucauucaagccgcugcagcuagagaggcaacucagugggaaacgugcuuucugcacuugcugagauugcugugcugugcugugcugugugugcugugugugcugugcugugcugugugugcugugcugugcugugcugugugugcugugcugugcugucugugcugugugugcugugcugugcugucugugcugucugugugugcugugcugugcugucugugcugugugugcugugugugcuggcugugugugcugugcugugugugcugugugugcugugcugugugugcuggcugugugugcugugcugugcugucugugcuguguugugcugugcugugcugugcugucugugcugugcugugcugucugugcugugcugugcugugcugugcugugcugucugugcugugugugcugugcugugcugugcugugugugcugugcugugugugcugugugugcugugcugugugugcuggcugugugugcugugcugugcugucugugcuguguugugcugugcugugcugugcugucugugcugugcugugcugucugugcugugcugugcugucugugcugugcugugcugugugugcugugcugugcugugcugucugugcugugcugugcugugugugcugugugugcugugugugcugugcugugugugcugugcugugcugugcugucugugcugugcugucugugcugugcugugcugucugugcugggcugugcugugugggcugugcugugcugucugugcugugcugucuguacugugcugugcugucugugcugucugugcugugcugugcugugcugugcugugcugugcugucugugcugugcugucugugcugugcugugcugucuuugcugugcgugcugugcugucugugcugugcugugcugugcugucugugcugugcugucugugcugugcugugcugugcugugugugcugugcugucugugcugugcugugugugcugucugugcugugcugugcugugugugcugugugugcugugcugugugugcugucugugcugugcugugcugucugugugugcugugcugucugugcugugcugugcugugugugcugugcggucugugcugugcugugugugcugugcugugugugcugugccuugcugugcugugcugugcugugcugggcugugcugugcugucugugcugugcugugugugcugugcugucuguuuugugcugucugugugugcugugcugucugugcugucugugcugugcugucugugcugugcuguuugugcugucugugcugugcugugcugucugugcuguacugucugugcugugcugucugugcugucuugcugugcugucugugugugcucucugugcugucugugcugugcugugcuguguguucugugcugugcugugugugcugugcugucugugcugugcugugcuguugugcugugcugugugugcugugcugugugugcugugcugucugugcugugugugcugugcugugcugugcugugcugugcugugcugcgcugggcugggcugggcugggcugggcugugcugggcugggcugggcugugcugugcugugcugugcuugcugugcaggugcagugacaugaguucagauccccaucucuauguaaaaaucuagacaugaguggacucauuacauggcugcuguaaucccagcccugggaaauagagauagcaggaucccauaggcuuaggagucagccagcuuaccaagucagugagcucucgguucagugagagaccccuggaauuuucuuucauguaagauagggauuaaaaacaaucuccccuagauggcuccuuaauuguucguaagauucauuauguuuugcuagacauacuggcgcaaaccuuuaaucccagcacuugggaggcagaggaagguggaucucugugaguuccaggccagccuggucugcuagcgauuuccaggccagcugaaccacauaguaagacucugguccuuaaaaagcaaaagcaaaacaaagcagauuuggguuuuuguuuguuuguuuuugguuuuuguuuuuuugagacuugguuuuucuuguaucccuggauguccuggaacuugcuuuguagaccaggcugggcuggaacucagaucugccugucucugccuccugagugcugggauuaaaggugugcaccaaaacaaaaccuugaguuugucuuuaaacuauaaaauaaaauguuuaaaaguaaagggguggggggacagcgucacaaaaauccagaagaacaguaacugcuuggugcuucuuacaauacuccagguggcuucccccuguguauuuuuuuuuuaagauuuauuuauuuauuuuauguauaugguacacuguagcugaacagaugguugugagccuucaugugguuguugggaauugaauuuuuaggaccucugcucacuccaaucaaucaauuccacuugcuucggcccaaagauuuauuuauuauuauauguaaguacacuguagcugucuucagacacgccagaagagggcgucaaaucucaguacgggugguugugagccaccaugugguugcugggauuugaacucaggaccuucagaagagcagucagugcucuuacccgaugagcuaccucaccagcccaucucccuguguauuuuaaauguauuauguaauaaacauucaauaaguucuaccuuccucacucugaggcaaggucucauauauccaaguguaaccuugaacuuucuauguauuauuguccagaaugagccugaacuucuugucaucagccucccucuuccagacgggcacugcaggccagguucguguggugcugaagaucaaacaggauucaucugagcugggcaagcacugggacacuugagcuaaauccccggcaccaugcucccuuuuuuuguauaguuuugugaauuuggacaaaagcguagaguuguauguuauuaaaaccuuuuuuauaaaaaguauaguacgggguggggggagguauggaauguggaacagucagagggcggagggcugggauggggauaaagacuggacuauaaaaaaaaaaaagauuaaagaauuaaaaaaaaagggaacuagguggccucagcaauggccucuuuagcaauagccaagauuaaggcuugggaccugcucggcaaggaggaacuguugaaacaacuggacgauaugaagguggaauugucccagcuucacuuugccuaagugacagacugugccauguccaaacucuccaagaugcgaguuguaugcaaauccaucacccgaguccucacugucauuaacgaaacucaaagagaaaaccucaggaaauucuacaagggcaagaaauacaagccccuggaccugcgacccaagaagacuagagccauggcugccggcucaccaagcacaaagagaagcugaagaccaagcagcagcagcgaaaggaguggcuguacccacugcgcaaguaugcagucaaggccugagaugacaacgacaauaaauugcaagacugauccccccccccaaaaaaaagaauuuaaaaaaaguaaaaguauaguauuguguaacuaacuagucaccauauucaagacggagacuaguuccaucuucuuuuaaaacaaaauuuuauugcacuuauuuguguguguguguguguguguguguguuugaaugugugcauguguuucaugugccaugguggacauguggcaaucagaugacaacuuaagggaguugguucugcccucucacccagaacugagucucagcuugucaguuggaguggcccagcuccuuuacuacugagccauugcacuggcuccucaucugcacuuaagcagacaccccccaauuuauagugguuugacuuaaacgauuuucuugucuuaacuuaauucuuuuuugcauuagauagaaaucaagccacuacuuuuacauuuggauccucucccagaccagcaauaugaguucuaauuuuuuuuucucuagaugcuggguagcagccaucagccacagcucccacucaguccuuugaucacauggggaaguagccaacauguuccacacagcauacuggguuguuaaaucugacugcuuaguaguucugaacacauuugcuucuuaggcugccuuuacuucaugauguguuaguggggacauguccuccuuacaagucaagacacauuacacagcccucucacaauggccucccacuuaaaccuaccagcucagaauuuccaggacuggguccucccucuaggugauugagguucccaagugauggugacuuggaccagaggagaugcuguuuccugaggacauugcuucauaacuggcagggacucuuggaaccuuggaguauucuuggagcugugaagccuaagacuagucucggacugguaaugagaacagcuagucccucucaaggacauaguaccugauaggugcugugccaaacacauagacuguaccauuucucacucugcgcaggguugcacaagguagaucugucgucuccauuuuacaggcgaggagacugaggcuagagauaauguacuuuguucaagaccacgcugccaggguaugguggaccaggcagacuaaucacaguguccauacuccuuaccccuguacuguauugugaacucuccaccgaaagaguggugaccugccccuagucggaggcacaguuaugcaaaauggcucucacuuccucagaagauucuccuggagugcugguguucccaaaguagaggugauuuuaggggggccaugugggcagaaagcagagcacucugggcuccuggggugagcaagucgagaccuaggcuggguuggggcuuggggagacgacuguguuucugugcugacagcaucuuuccucccucugcacuggacagagccuccucuguuucucuccaucugaccuguuuccuccucuggcucucgaguucccggcuccucugagcaccucuucuuaagcccccaccucuucucucucugccucagcuugguaagagugacaaagggcucuuggggcugggcauggggaaacaucucuugguucuggugaaugggucccacaacccuucuacauuagaagagagaggcccauagaaggguuuagaaaacacccugaagagacaaucccaaccugagagucucagucagaggcagggcauucaaaaguggcagcuguuuuuaagaauguuaacugaacuaguauaggggugcacauuagugaaggaaccacaaguuugacuuguacaaagugaaagcacucauguaaccaaccucugaccaagaacuagacaguguggggcuggagagauggcucagcaguuaagagcacuuacugcugaggacccuguuugaaucccaccacccacauggcagcucacaaccaucuguagcuccauuuccaggggauccaauacccucgcugaccucugaggacagcagacauauacaugguauauaugugcagacaaaacauccucacauaaaauaaaauauagaaauaucacaaaauuauguuugaaagagcuagacuacaaucuccccuuucagcccucuuuuaguugacaucccuggaguugggggugcauauuuuugguugucacaaugacuuugggauucuguugguauuuagagagcagagucuuguggugcuaaguguccuguaaugcauaaggcaacccuuagcacaaaggcuguccuguccagaaaugguaugacaaaggcuuaggggcagggguuacaacuguaucaguggguaagugaggaggggucuuugccacgaugucccauucuaucaccacuucacaggccuccggaaugccccccgcugcugggcagugauccagccccugcugugugcugucuacaugcccaagugugagaaugaccgaguggaguugcccagccguacccucugccaggccacccgaggccccugugccauuguggagcgggagcgaggguggccugacuuucugcguugcacaccggaccacuucccugaaggcugcccaguaagugcccuguggggcaagagagggucgucuagccuuggaaaagagcagcacuguacuggaugcuggggagccagaggugucucuccuaggagacccugcgucugcagacacagggccaacaaagcaugcauccaagcuguaacccacagucugggucucuguggaggcuucucuguugaccugauggagcaugguugucaagcaguuuucaaaugcuugcuuuuaggguugugagugacaggagccugucuugagagauuucugucacauguagagaagucagagcauauacacacgaagcacuagaagcaggaagacagaggggugcaaggcaguguggguuggaagaggacaucuauagggauaacagaaugauagugauacuaauuaucauuuacuacauacaaauaccauuaugagaacuuuaguccuuuuauuaaucgaauccuuacgcccuaugagguaggggcuacucucucagaugagaaaaaugaaauagucaaauaauuuguccaaggauauagagccauugagcagcagugggccuccagucaguguaucugcucuugcccaguuucccagacccccuuaacccugauuuaaucucuccccgugguauuuucuuuuuccuuccccgugucagaacgagguacaaaacaucaaguucaacagcucaggccaaugugaagcacccuuggugcgaacagacaaccccaagagcugguaugaggacguggagggcugugggauucagugucagaacccgcuguucaccgaggccgagcaccaggacaugcacagcuacaucgcagccuucggggcggucacuggucucugcacgcucuucacacuggugagcagugcuuuauggacaaggguauaggauugacagcccaaggagcagggacuugguaggggacccacagaagcuuaugaggggggcuuggguucagaucgaggcaucugcagcagaacagacccucacuucacugcauggccgcuucucccuuuaggccaccuuuguggcugacuggcggaacuccaaucgcuacccugcgguuauucucuucuaugucaaugcguguuucuucgugggcagcauuggcuggcuggcccaguucauggauggugcccgccgagagauuguuugccgagcagauggcaccaugagauuuggggagcccacguaaguaucuuggggacccagaggugagggugggaggagaaagccuguaaugcacauuuuccuuagaaggaaggaguuggacuugaaggcagccauaauggguaggauuuagcauugcccuguuguguucaguguugagacuugugauucuccagagaugauguacccugcagccucuucaaauccgaccugugucccaacuccuggggacccuccucauuuuaguagacuaggaccuggggacaaggugcagugacugguaggaaggauacaaagugacucuccaagugacacccuacaucuucacagcuccagugagacccuguccugugucaucaucuuugucauuguguacuaugccuugauggcuggaguagucugguucgugguccucaccuaugccuggcacaccuccuucaaagcccugggcaccaccuaccagccucucucgggcaagacauccuauuuccaccugcucacguggucacuccccuuuguccucacgguggcaauccuggcuguggcucagguauaguggcugggggcuggggaccugaauggggugagcuugggggaagggucauaccuaacuaucccuuccacaccuuuccgcuacagguagauggagacuccgugaguggcaucuguuuuguaggcuacaagaacuaucgguaccgugcuggcuuuguccuggccccaauuggccuggugcuuauugugggaggcuacuuccucaucagaggugagugacucagccagggccagccagguaacauagugugcugagcaccuacucuguggaagugggaugguagcuuccagcuccacugccuuccucugauaucuaccuaaaccuuggugcaauauagaagaugacccuguaggcugaacagcacuuuuaugaggacagaaaaauguaccucuuccuccaaagccaugaccaagguucuuggcuuuuuuugaggggaacuuggcuagauuccagacccucuuucuucgcccuugucaggauguauuugcauggugaaugcuccgggacaccuagcuggcccacaaggagcaucuuggggccauugcuuaugucuguucacacuaguuuuauagauacugucauauuuuuggagcuugguuuccaagucaugccaaccccuaacauacacaaacaguuuucauaacauauacagauuuacuggucccuaauuuccccgucucaaucugccagcccaugauuugccucgguuucuagcucauuuugcuugguuuucuuugucaguuuugguuuccucccacugaacugucaaccuucuguucagccuucuucccugccuuucuggcagagcaucugagccucugguguauaguuugcaucugcgccucccauacgguaaccaguagccauggauguugaaacuaggccaaacugagaugcuuaaguguaaaaaacacgauguguuugagacuuagcaugaagaagagaaagaaaaauaugaauauaaauuaaucacuaauaguuuguuguaugggaugcagaggugguucuauuugggauauauuugguuuauaaaauaaaauuauauaauuuuuuaauguggcuacuagaaaauuugagauuuuuuuuauaugucacacaauguauuccuauugggcaauacuauuguugauucuguuucaagcuuucaccaucagaauagcuuugaccugguuuccucucucuguccuugacuguugucuaggcucugucccaguuaccgcagcccauagcacauuugcuaauagcuguucucucauucucugguuccccaagcuuuauguaauuagucauaggaauccagcgccauggggccucccuccaugcaccccccaccccagaagagugucuucuguccugcuaaugucucaauucucugucuguuuaggggucaugacucuguucuccaucaagagcaaccacccugggcuucugagugagaaggcagccagcaagaucaacgagaccaugcugcgccuggguaaguggugcccaggggacucuggacaucucaguacugaauccugauggggccuccaggaugcagaaagacaguguggagaguuaaauauucagggacagagccaagguauagugauaguggaggaggcaacucccucugagaaggggaagaacccagguuagugccaggaccgcuaccacaggccccucgcccuuccuguggccucccauaguauaauaaaucaccucuggauuuauuuuggaggaugcaguuucugaccugagccccgauguagccacccuggacucagcugccuucaguauuccauacgcaguugcccuccucccgggugcugcuaccaucucuguucugguaacggaucccgccccugaacuccacaggcauuuuuggcuuccuggccuuuggcuuugugcucaucaccuucagcugccacuucuaugacuucuucaaccaggcugagugggagcguagcuuccgggacuaugugcugugagugaggggccccgggcuuggcugugggcgugguugggacuggagcuccggcuauaaugcagcauugcaucugcuugugaagugcuuguuccaccaucccgccucagcuaugaauagcuucuacauugcuguucaacuccacaugucugucugcgccccugggcaggauguccuguguguuugcaacuguucagaaaccaacccauguugugaucugugugccuucuaccaucgguggcucucccugagucaaugcacaggagcagguccuuggacagcucagcaaccuggucaaguuugccaguucugcuugaguguuucuggaucucaguaaaggugaaccagggcaccuguggcaucuccacugcuaaaaggaugccugcugcuacuggggcucaugguuaaaacuucccuuaaaaggagacucuggcuggagagauggcucuguuuuuaggagugcuuguuacugugccauaggauguaaggucaguucucagcaucuacaccugguagcucccaaaugccuguaucuccagcuccagagaucucucccucuccuggacucugcaagcaccuggacauaaguggcacacacacacacacacacacacacaacacacacacacaacacacacacacaucucugacugcuuuuggcucauucuuaaguuucccccuuucagucuaggaagauguuaccugcggugaugcucgauucuuguccccgaaguuugaugugaggcucagacagcagugauuuauaaaagcucucuagaugauuccaaaguaugucacuggggucuagugguacagcucagugguagaaccuaguauguguggguuucaccuccagcacccgcuccaugagaaucacgcaguggggcucagcucucuccuauauggauucauguugggugccuucuuacuggaucccgauaccuuagcuguugaccguuccucaucauagaugccaagccaacgugaccaucgggcugccuaccaagaagcccauuccugacugugagaucaagaaucggcccagccuccugguggagaagaucaaucuauuugccauguuuggcacuggcauugccaugagcaccugggucuggaccaaggccacccugcucaucuggaggcgcaccuggugcagguggggucagcagcugucugaucuuguccuuccucucuuacccucagccucacgucuucacuugagggcuuugucuuacaugcuuccaaaacagacuggggcaguguuugccaaaagcaagucuggauggcuaauugcuuagcugcucaccacugcccucuaggggacagugagaaccagcgcuuuucaaguaggagccacaggagcccugcauucugggcauguuuuguugcugugaaggccucagcuccucaggacuuaaaccuagaaucccaggucuuucgauagauuuggaaggcagcggcugcucuugcacuugccagccccaccccuucuguucucagguugacugggcacagugaugaugagcccaagagaaucaagaagagcaagaugaucgccaaggccuucucuaagcggcgugagcugcugcagaacccgggccaggagcucuccuucagcaugcacacugucucccaugauggaccuguuggugagccucaguguauuguccugcggagacaccugaccuccacaguaccaggccgguuuccgucuggauacacggacuguuugacaaacuagggaaugaggcacucacucacacucugccuugucgugucucacugccccccccgacccccaccucuccccucuacccccuuuccucccucggccuguucacgguauugcaguucucugaggacuuugcucucucuuccuucuucucugccaucuccagugacuuuucugagccagaguaagucagggugcuggcccuagacuuaugaucucaaguuuuacuuuuugggaaucagaggcugcugcacucggauuuugaaugggcacuggcuccaggguggaaucucucugccagcugcagugggaaggacuggcuaggaaagaugacccauguuacauaaggaggggucauuguucuuucuuuccuuucauccccaaagcggguuuggcuuuugaccucaaugaacccucagcugacgucuccucugccugggcucagcaugucaccaagaugguggcucggagaggagccauauugccccaggauguguccguuaccccuguggcaacuccagguaugagggcucugucuucugcaggaaggagggguggguggacacuuuggaaugaauguaugggguuguagaacuaggggaaggaaggaaaggccccagaggaccugaaggagaugccaaggcuugggaagccuggagggacgggucccagaacccaagaacagggauucugggagggaaggguggaaagaacagaacaaagcccuaagcugugcucuuugucccccugacagugccaccagaagaacaagccaacauguggcugguugaggcagagaucuccccagaguuagagaagcguuugggccggaagaaaaagcggaggaagaggaagaaggaggugugccccuugaggccagccccugagcuucaccacucugccccuguuccugccaccagugcaguuccucggcugccucagcugccucggcagaagugccugguagcugcaaacgccuggggaacaggggaguccugccgacagggagccuggacucuagucuccaaccccuucugcccagagccuaguccccaucaagauccauuucucccuggugccucagccccccgggucugggcucagggccgccuccaggggcugggauccauucauucccgcacuaaccuaauggaggcugagaucuuggaugcagacucggacuucugagccugcagggcagguccuaggaugggaaagacaaauguacaccuuucuauggcucuuccugagagcacaccucugggucucaucugacagagucugugggccaagugucugccuagaagagcuguguaugucuggcuagaagcagccaggccauggaaacaaguugaauacagcgauugguaggccucaugucagaaucaggacccugcacuucaggacccuugcuucugcccaccaaucagagucugacuggcaguguuagucuccgacagagcuuguacuagggcaggaauggcagagacagggaugaugguacccagagugggcugugguggucugugagguaaccaagcccaugucuggcagaugagggcuguuugcccuuuucugugccaaugagugcccuuuucuggcacucucagaccaaaaguguuuauugugucauuuguccuuugucuaggagaggacaggacucucuuuuuccucuuccugguaguuguaaugaccacucccauaagggcuauaacuguucuucacagguggcccugcucaaaauacauccucucuuuucccguucuaucccuacauucacaucucaguuccacuaggccaaccucuuccugguuagcaccuuaaaacugcagugagcacacacagacacacacacacauacacucucacacacacagacaggcaugcacacacacacacacacacacacacacacacacaccccuuacuucugagcucugucuuaagagacuacugguucagcuccaggccucugaaagacauguuauuucuuccucacauccauccaguggggaggacccucugacuuaagggaccaccuugggaagcuucuguagcuucagccaggcaagaaagcuucuuccaacuucuguuucuggugggagcggggggacucccacuuuuuacaaugucuagucauuuucauagugccccacauucaagaaccagacaacaggaugccuuagaagcuggcuggguuuugggucaggggcucaguaugagaagaagaaauaugaacagcaaauaaaacauuuuuguauaagcucaugcguguuucuuuuccccagccccagcucuggcuuauguaccugguccagaacuuccaugaacuccugaggucuuuuucaccaguggaaagcuugcugguguggucaugacugacagauacagggcugauucagcguaauaugcuggcugcucucucuggcuacuuggcaguaaaugaacaaaaggugcuuguuggccaccuuuguauccuuaaguuccaagcauaaagagaaugaaggacagacaugcaggaugcccuuggaguggccaugggaagcgaguguuuuccuggugguauacagacgggcacagcuacugccagucccagguuucaccauugcaggguggcaugcucugccuccuuccagagauguuaggucggguacauucugauccacagcuuccuuucugggcagucaaaggaauucaaacacaaggagagcuuguugguuuugcuucuuuaaaauaccagcagaagauugggaacugaauucaagugacuagauuauguagcaaggucuguggagaaaaggcagugagagccacagaccugaggguacuguggagugcugaucuggcuuaggacgaauagucccuucuucagcugugugugugauggggacaacaggguuuuaaucaagccagauuuuccagaaagaggagaaauggaauucugguuuuaucccaggugacuuguagauaugauauaccacugaaagcuaacacccagggcuggcuuugcggggcacucuucugagcucuccacagaauucagcucaggcaaucucagagcccugccagguucuguucuaccccucaagacacugaggcauagaaggccuaaugggcugcuccaaacuauucagcuacugguaaugcuggcauccaggcauggccuucugguuucauggugacagggaucuaaccauggugcucuuugcauggaaucaaguucagcaaaguaaagcaaagugacuugcacacaaccccauagccagaaagcugcacacacuggccuaguauuucugauugcgaaguccuggcucugcagcuugguggaaauucauucuuagauuucuccauuuuguguuuccucaggcuacccccuccucggcacuugucaguguugguuacuauuuucugaaauuaaaaaaaaaaugcu

SEQ ID NO: 2877 - RNA, 147607 nt, Mus musculus
cagguucuguggcgccucgcgcgugagucagacagggguggggcgaggcucgagaggccgggcuggcggcgagcgagcgggcgggcggaggaagggggugggagcggaggcgauggaggggaggaguggggguaugggggagggaaggggaagggaggcgggaggcggggccgagugggagcuggugcgagagucagagucggcgguugcaguggaggcggugaugucggugcagguugugucagcagcggcagccgccaaggugccugagguggagcugaaggaucugagccccuccgaggcggagccccaguugggacugagcgcggcggccgugggcgccaugguacccccagcggguggcggggacccagaggcuccagcuccggcucccgcggcggagcggcccccggcccccggcccgggcucggggcccaccgcggcucugagcccugcggccgggaaggucccucaagcguccgccaugaagcggagcgacccucaucaccagcaccagcggcaucgcgacggcggcgaggccuuggucagccccgacggcacggucaccgaggcgccgcgcacggucaagaagguacuggggucgggcugccucgcuucucggagaggcggggagggcgggcacgggaguggcggcccuucagggcacggcggcacccgguuccacacccucuagaucguggagccgagagucuucucccacccuugaacccgcucuuagagcggccgccacccggugcuccgcugcgaagcgaagccucuagguaccacgggcguacuuuacuaauaacauggagguagcgcccuucacuacuacuugaacgaggcagggggaggagaagcaccuacuacuacacccggcgccuccagcacacucccgcguguaauuuuccggacuguucgguggcauagaaaaaccuucccuccagcgauaaggauagcaagaucuuuuuccuuggagaacgaggaagcuguaguuagcucucucucaugagagcucgggaaacccucugaguugccuggcuucuguacagaugaugacuuucugccuuucuguggccaacagcucuccacaggguaguacugaucugugcccuuccuuucuagccauugcaauucucuuguacugcgauuguagaccgguaauggaaagaugcuucauucacccugaagagggcuggucucuaggauuaccagauuguaccugaagagaaugcuuauuuuauucauaucuuuaucgugagcagaaaguguuaggaagaaaugcuugcuacuuugaggaaaguaaucguuuggggcugucggcuuccuucauaaauagaaacguguaaugaugguacccccgaauuauuuauauauuggcuauacccuuuacccacuccccucguuuuuucucccauuuauugaugucagcacaagagguaaaagacaagaucuguggaucaucuaaaaaaaaauguggcuuucauuucuugggaacaguaugaacacaaugauuuacguuuuuucccauuauaaugggugcauuuuguuccgucagaacaacaguaaaaaaagauaugaaguguacauuggguuuacuauguagaguuuaggugaaccuuggcuccagcaaaacauuuuguuguaauuaccucaugacuuagggcaguuaacuuuuucauuugguagugcuaaaugaugucagaggcaagacugaaggaauuuaacagugcuuuagggcaugcuguguccuuugcaguuugguguguuguccuccccucuccaugcaauuauaguuaaauggaggaauuacacuuaaaagaugcagccugggcuagugcuggaaguacuuaggucaaaauuaggaaauccaaagccuauuucucacuuguuaagaugguuuguagcuuuggccaaaucuuuuucuugugacuguuuuuuuuuuuucccuaaaguuuguaauuuaguucuuuuaaggguaaaauguuuaacaauuuacuuuuagagugaaguuuauacuuaggugcagaccuaaguuugaacauaguacucccuuccccagauuuaacuuuugaauaagucuauaagguaauuucuccaauaaaauggggguacuaauuaugauuaaagauuaaaaauguuuauggucaucacauagaacuugguaccuacaguaggaucuuaaacaauaacuuauuaaaauuuauuauuucacuucucauugcuuaaguauaugucacugugaccuucucugaaaaaaauacacauauuaguaguaguucaauagauucuguauaaagaauuaaaaaaaaagaaaaaaaaaaaagaaccacaggccaguaccccagagucuguuauugaauucuaaaugugcuucuuggacacuuuccuuguugcugagccaccuucuuccuggcuuuuuaaguaucaaaaucauguuccaugauucuugauuuacucagcagccucaaggcuaugaagacagggcugagcuugccuggcaauuauaaucccaccagaagccuguguuaccugcugcacugucagcagguaaaguccugcagcuguguggcagaaggaagggcacugcugagcucggcuuggcucccucuuuuccucuccccucccuguuucuuacucccucuucccuuccucuugucucauuagggugucaaucuguagcccaggcugccuggagcuauggagcugaggcuggccucuaacaucuuccugcuucagcauucugcuacugagauugcagaugugugccaccacaccuggccugaacuuuuaucugcuuuucuuuuuuaugacaagagcucaggggcuguagauguggcucacuuggucucuacccagcaggcaagaagcccuggguuugguccacaguaacauguaaaccaggcauggaggugcuuaccuguaaccucaguacugagaacguggagacaagagaaccagaaguucaaggucaucuuuggcuacauagugaguuugaggccagccagucaggcuggcuuugaacucaugacccuuuugcuucagcuuccugugugcugggacuugaaguuuguaccacauuuggcuugcccuuuuuaaagagcacaaucuuuaguuuccuuaauagugaagugccuauguuuucuccaugucaaaugucacucgaugcagaaagacugagcuguuuugauuuguuaagccugucuugcuucuuagcuugucuagaugagccauucugcucuugaccgccuucugcuuuauuagaguguguagaaggauuggguauuccaggaacaaaauaguugccuuuagcucuguaaauggugauuguugcuuuuauuuuuuaacuaccagaaaucuuauucauguuauuauauuuccaaugauguuucccuuuuccuguucauguaucaguuaucaauuuguugguucuguuacucuggacagccacacaaaggaaguacguaagagucagacucucacguucaaucguuauaagaaugaacaccauggggugcaggcugcuuggucacauuauacuuuugacccuugccuucauccuguaacuuguacucuauagggcagaucuugucauugugauaucauuaugauauuuguauuuauuagcuuuucuucauaagcauacuuucagugaacgcaguaaguauaucugaaguaguaauuuauaaaaugggaaaacaaguuccaucaugaguggcugugacagcaguuaagagcauuccucucaugugagcuuagaaaugggugcuagcacagcagagaaaagaaggcagaagaggaucccugagaaguugaaacucugacaacagcugcagccuaagaaccucagccagugugagcuuaccuuacuauugguaaugaccauguucaaacagacuccauauuuuucuuggcaaacauaucugcauuauacuuacuuuguugcugucaggagagaaugaguugagccauguucaugcuuucuugcccugaauuguuuaagcccuugauuugguuaauuauagauuacugaaauugaguguuuuggauagagucaugggaaugcgagagcggugugacucccuugccaguuagaaaaguacagccuagcaaaauguucaguaaggcaauuggcaguuggacccuaauaauaguuaccauuaauuggccuuuaggugccaggaacuguuacaggcauuucuguaauccugacaagaacauuaugaaaugcagauggcauuaucucaguuuuacugaugaggaaaugggauucagagagcuuagugccaaccccaagguuuuauauauacgucuaaaaaguggcacagggauuuaaaccuaugucuuuccccagagccugggucuuuaucccagacagaaagcucuuagaucuuggucucuggucuucccccaggaaucuguagguuucugagugaacucuuuaaggugugucugucaggcuaaggcuuaggucauuccaagacuaaagugaagagagugagucaggcuuucagaagaggaugggagaaaacuguacaaaugaaaaccucaaagaauuguaaaguuagaagaugugaagaacauuuauauagggaagaaauuuaagauuagugauacuagccucuuguuuguaauuaauuugugacccaauaaugugccuuccacccccccuuuuuuuuuuuuuuuuuuuuuuagauagagacuuacuguuuauccuagguuggcccguauaguuccauaugcagcccaggauagccucagauuccagcacuauuuccaccuucuaguauuauaagcgugugucacccuaccuggcuuuauccuuauuuuuaaacguaggaaucugguuccuuacuguugcgcuaacaguuuucuucuguucaguaaguccuuccucuaugaaucaggcuuugcuuaaaccuuugagaauuagaaagggaaguaugcuguugguuuuuuuuugaacuuuugauuuuuauguguauaaguguuuugccuacauuuaugucugugcaccacuugugugccuggugcugaaggagaccagaagaggacaguagauugccuggaacuggaguuucaguggucugguuagccacccugugggugcugggaauugaagccagguccucuggaaagcagccagugcucuugaccacugagccaucuguacagcccccuuguuagguguucucacuuuguacugggccuuguacuuucagcuugauauguacuauuuuauuuaauacuucuaagagcucuuaaagauaguguuauccuuguuuuauugaggaaacagauuaagaaauuugucucauaguaacacaguaauguauuagagugaacagauuccuaaucuguuugacuuuggagaccauauuguguagauuuucaauugcagaagguugcucuaggccaaaguuccaguuguauguuccaugccuugaggaagauaccuagaucaaaugcuuccaguuaacaaauuaacaaauacaaaugaucuacuuucucuuaaugagaaagagggaaauaaagauuugcaauuuuuauuuauuuauuuuauuuuauugcuuuuuugagacaggguuucucuguauagcucugccuguccugaaacucacucuguagaccaggcuggccuagaacgcagaaauccgccugccucugccucccgagugcugggaugagauuugcaguuuuuaugcagagucuuuuugaguugaguuucugaguaagacuaaguagaagccugaggccaccuucaugggucaggcucgcucucuccuuguauguggauaacaaauucaggcuacuaggcuuguacaguaaaugccuucaccuuaaaauuuucuaauuaguuacuucaaaaauuaaaaaaaauacugauuauguguguaaaugggugagugcuguauaccuguaugcuuaccaugugcaugcuugguacccacagaagccaggagagggagacagguccuggaacugaaugaguuauaggcuguugugaaucacuaugugggugcugggaccugcaagagcaggaagugcucuuaacuaucgagccaguuccaacccauugggugcccccuaauuauuuuuaauacaaguuccuuuauguagccugcuggcuuuaagccugagaucauccugucuuagccuucacaagugcagggauuauaggcaucaugcaugcuugacuuauaguagcucuuauuaacuacucagagagguauaacugcccaauguucaugugauagacacagauagaggaccuaaaguucauuucacccagugggugguuucagucagccugauaacauuuuauaaaauuuauaggaacuuuuuauagucuuuuuacuuauggcuagaaacuugaugagaccagaacaaaggagaaaguuucuuaauggcaguuuuuaagacuaaacuuucuaucuuuaaauguguauuacauauauauuuuguauguauauucaugugcuuuuguguauaaguggaggucagaggacagcugguuggaauugguucauaauguagguuccugggaucaaacucaggugucaaagguggcaaacaccuuucucauugagccaucuugauggucccacuaagauuagcuuaaguugaauaauagcuuaagacaugcauauuuuuuucucccucuuccacagcuucaucugaacaguuagcuauuuucuucucuuuggagacuuguauuaguagcuggugauuuuuaaauuuuguuuucaaggcucugucaaucaaaacugucaguuuugggcacugaguuuuuagaacuuaugaaaacuagagugcuagaaaacuaguugaguaagacucuccuuaaaaccuuucugaauacugcauaucugagacuaaaacuagcuucucuagucaccucuagugcuccucuguggcccuuuugauuacuuuaaaagaaggaccagcaagauggcucagcagggaaagacuccuguugucaauccugaugaccuaugccuggaacccauguggugaaagagagaaccaaguccccaaagaaguuuuccuuugaccuucaugugaaucaaucucucucucccucucucucuuacacacauacacacacacacacacacacacacacacacacacacacacacacacacacaaaaucaguuaauaaauguaacuuugaaaaauuaaaaagaaaaaucuuaaauauuaggaaaaaggauuuaauaauguucuuggaaacuccuuuauuggccuuugugaugugucuacaauuuccucagugcauacucuuugccagaccucugucuuaucuauuaauccucauaacaacuuuuaucagaugaguagcuuuaucuuuacagaugagaaaauauaggcuuaaagagaguaguuaacaugccugaggcuuugccaaucugugaugccuuugggaucagugagaugaaacauuacccuuagcaacagugggaggcuuugucacauugccagccccuacugcucugaccaaacucccaugugaugucugcuugagcuucugcuaagacugcucuguguagcccuuuggacauuagcaucuguccuguuaguggaggaggcagaaacuaccaugcaucaucacauccuuguuuccuuugguuccugaugucuuauccuuucggcugacuuaguucuucaagccuucuacuuuauuuuucuuaacaucccauugucagcaaauccccauguagcaucagcuuuuagguagcaagaucaagucauggagugagaauggcagugguguaaguguuggcacauggugucuagaacuguaagacaaaaaucaggcugcaggcucucuuguuugucacucucaccuguaauaucuaugacaaaucaauuugauaauuuuggguuuuuuuuuaaagcuguguauccuugaaacaggcuuucauauucuuucuguauauuccuuuucuguuuauuuuaguccaaauugacuuguagugcuugugaaacugaguaauggacugucuauacuaauggacugucuauacuaaccugucuaccuuccaguugccugaacccauggagcugaaaguugcugaagaaaaaucugaaagcuagacagaucagugucacaaugaauuuguaauuagcagccuuguaagacaucagccaugucuagcaguauuaugcaugucucuagcaaguucaccuucccauugcaagggaucugccuuccuuuucgacuugacuauuucaugcuguauuucuccuauuucaugugcucuucuauuuaagccaguuauaagcuuucucuuucacuauaagaacagaagacuccacauagaacuucucuguacauucuaucuacaaacccggggcucaccuuauucuucauguuauuacggaagaggaaguguccucauucugucaaagauaaggcccucacagaagcuuuaaucauguucuuuaaagaagucuuucucugguuaucuccucugucuccaguuucagacuugcuuugccuucuucauuuuggcagcucuguucuucaaccugcugacuucuuuuagucuuucagaauucaucuuuguacaggauuuuucuauguauacauuuuaaaaaaagauuuauuuauuauuauauguaaguacacuguagcugucuuuagacacaccggaggagggcaucagauuucauugugagugguugugagccaccaggugguugcugggauuugaacucaggaccuuuggaagagcagucagugcucuuacccgcugagccaucucuccagccccccuaaguauacauuuuuaaucuuuaugaacuccuuacccauucuuauacucugacagaaagaaagccuauugcuaauguucauuagauuggaaaauguuuuuucuuguuguucagcuccuuaggcuucuaugacacugcucuuuuguucucuggaggcagggucuucuaacaaggcagcacugguuacagagcuaagacugcccuugagcgucugauccuucugucuccugucuccaccuccuaguguugggauuacuggaguguaucaccacacccagcuuuaugacccugcgugguugguugguugguugguugguuuuuacuaguuuccauuuaacuuuuuuggcugaacacuacuucuuuguugacacuuccuucuuggucuuaggaccucuguucgagucacugaguucucucccccaguuauucauauaauuccugugucuauuaguaucaucuacaucccaguaacuuccaaaaguauuccuuuggcuaagacucaucuucugaaugccagucuuagguuuuuacagcugccuacugcaaccagauauaguagcuuuaugucuaacacuagauuacauuuguuuguuuuagauuucuguuauauguaugaaugucuuaugugcccauagaggaauuggaguuaaggauggcucugaguggccauaugggcacuuggauccaggaccuccacaaucuacaugaacuuuuuuuugcuuuuuuuuuauuagauauuuucuuuauauacauuucaaauuucaaaugcuaucccgaaagucccccccccccccacuccccuacccacccacucccaccucuuggcccuggcguuccccuguacugaggcauauaaaguuagcaagaccaaugggccucucuucccgugauggccgacuaggccaucuucugauauauauguagcuagagacacaagcucuggaggguacugauuaguucauauuguuguuccaccuauaggguugcagaccccuuuaucuccuuggguacuuucuuuagcuccuccauugggggcccugugauccauccaauagcugacugugagccucuacuucuguguuugcuaggccucggcauagccucacaagagauaucuauaucaggguccuuucagcaaaaucuugcuaguguaaucaauggugucaguguuuggaggcugauuaugggauggauccccaggaucccgcaauaccuuuccugggcauauauccagauguuccaacugguaagaaggacacaugcuccacuauguucauagcagccuuauuuauacuagccagaagcuggaaagaacccagaugccccucaacagaggaguggauauagaaaaugugguacauuuacacaauggaguacuacucagcuauuaaaaagaaugaauuuaugaaauuccuaggcaaauggauggaccuggagggcaucauccugagugagguaacccaaacacaaaagaacucacaugauauguacucacugauaaguggauauuaacucagaaacuuagaauacccaagauauaagauacaauuugcaaaacacaugaaacucaagaagaacgaagaccaaaagguggacacuuuucaccuucuuagauugggaacaaaacacccauggaaggaguuacagagacaaaguuuggagcugagacgaaaggauggaccaucuagagacugcuuuuugucuuuuuuaagacaggguuucucuauguagcucuggcuguccuagaacuuacucuagaccaggcgggccuugaacucaagagaucugccugccucugccucccaagugcucggauuaaaggcuugugcugcuccugccaccaccacccaucgagcaaagugcuuuucacugaugagccaucucuuuagcuccguaaaacugaauauuguuaauuaccaaaacguuuuguucuuacuuucuucugccagucaacuggcacuuccauuauuuuucuuuuauuuguuuauuuuuuagugcuacaaauugaauccagggccuuguguauacucuaccauugagcuacaccucuguaccucacaaacaaaugcuuuuaauuauccaaaugaagcuugaagauauucuaguaaaauaguuuaguuaaauaaagcagaaguccuugacuggccccagcauucccauuccugucccuagagaggugaccucuguuguuugucuuuuuguuuuuuauuuuuugguuuuucgagacaggguuuuucuguguagcccuggcuguccuggaacucacucuguagaccaggcuggccucgaacucagaaauccgccugccucugccuuccgagugcugggauuacaggcgugcgccaccaugcccggcuguuguuguuugucuuuuuuagacuuucuuaugauuuuccauguauuuguauauaaauuuauagccuuacauuaacuuguacauaaguuaagagcguacuauauguauaauauuucucaggcuccuuuuuuucuaaacuuuaauacaauauuaaaauuuauauguauauguucuuuccauaucaacauacacauacuuaucuuauuuuuauuuauuuuuuaaagacaaaaucuuacuauauagcucagucuacauaaucuuaaacuggugaugauccuucagccacagcuuuuaagucugucuuuccuuuuuuuucuuuuuuuuuuaaauaaagauuuauuuuuauuuugugugcauggguguuuugccucuaugucugaaccgcaugcauauagugccggggaagccagaagcaggugucagauccucugaaccuggaguuguguguggcuaugagcuaccauguggguacugggaacugaaauagggucuucugcuguagcagucaguacuccuaacagcggaaccauuucuccaauucccaccccuucuuuuuaacugcugaguugauguuuauuaaagcauucuucuguuacauaccuuuaacuuuuuuccccuuuaaaauuuauuuuaugugugugaauguuuuacugggauauguuugugugcuacaugcacacauagugcccucagaggccagaugaggacaauggaucucuggaaaucucuggaacuggacuguaguuauagacauaugugaguugccauguagguacugagaauccucuguaggaacaagugcuuuuaucuacugagccaucuuccuaguuccuuuuuuuucuuucuugauaaauagugcuacaguacuuauauguaugcauucucuuuguguuuacauagaaauguuucuuuaggauaguuaucuaaaaggaaauuuuggaagucaaaauaccuuuugguuuaaacauaaucugcuguguagaccaggguggucuugguauguuccuucugucuuacccuguugaguacuaauauauguguacaucaccaugccuagcuaggcagucauauuucaguguaugguaauguauaaagguucaaaauguaaauaccauuguuauauaucugcuagcucuauuuuuaaaaaaaagauuuauuauuacacauauguacacuguaacugaagagggcaucagaucucauuacaggugguuguaagccaccaugugguugcugggaauugaacucagaaccuucggaagagcaguuagugcucuuacccacugagccaucucuccagcccaucuguuaacuccaaugagacagcccuuaccauuugucuugaacuauacuagauuucuuuucuuuuuuuuuuuuuuacaaaauugauagggagaacucuuacuguuuauggguuuacugucuuauaguaaggcugagaguacuuuucaugugcauauugaauugacaguuugaauuccuuuucuuauaacugcuuguuuauaaucauuaauaacguauuuagugagugacugacuacuguaugccagguucugaggaugcagcagugaguacaauagguaaaaaggucuacacuuccaguggauugucauuucauuuuuuuaaauuuuugggacauucauucuuuuuguaaauguugcagauauuuuuuccuauuauuauuuuuugugugguauggagaucagacacguuaggcaagcauucaguaccuaaccucgaucauccuaucuguucuuauggcuugugacuauaauuuuuaacuauaguuuucaugugacuuaaacauuuuauguauugguuggucuuuucuauuccaccuugauaaaaacucuacuuuucaugauuguguuuguuguauuuugcuuucuaguccaucuaaaacuuuuguuuguaauguaggucagugauuauuuguaauacaagauggcauuauugauccccaaauaaaauuuuguauuuaccugcuuucaguugguucugguuguuuauuuuccuuuaauuuaucuaucuuuuuuuguuugcuuguuuguuuuuguuuuucgagacaggguuucucuguguagcccuagcuguccuggaacucacuuugaagaccaggcuggccucgaacucagaaauccgccugccucugccucccaagugcugggauuaaaggcgugcgccaccacgcccaguuuaauuucucuuucuuaacuggauuuuuguuuguuuguuuguuuugaaauaaucuuaaauaaucuaggcgcucucaaauuugcaguccugaucauccugcaucugccucccccgugcuggcacacucagcauucuucccuaacacucagguuugcauauacuagucaugacuaaagagugucuaaacuuauuaauucaagaauggcuguagcaguuaacauccuauuacuacuuacugagggcuuacagugaguuacucacaaaaacacuggauaucuuagcaagucuuucuuaaguacuugguaucauuuucauuucucuuuuaaaagauuuuacuuauuagauuuccucauuuuacuuucugugugaguguuuugccuguauguuuguguguuuacaacaugcauguuugguguucacagaggucagaagagggcaucauuuccccuggaacugaaauuauagaugguuguaaaccaucauuuaggugcugggaauugaauccaggucauauucaagaguaacgagugcucuuaaccucuaagccaucucuccagccccauaguuuuaaguuuugauagaaacuggagccucagugguuuucagauaaagcccugcuaguggucaccucagagagacucaucuguuaauguuccuuuaccaaguuggaagaguguaggccuguguggucuuuuuccaaaacaauauuuaauuuuuuucucuuuaaggcauuaccaagaugaguacaugugauaaaaguguaggacaaauuuuuuuuuaugguaauuguguguuaucugccuuuugaaguugacauuauaugcucuauuuuuuucaugguaauuguguguuaucugucuuuugaaguugacauuauaugcucuaggcuuaaagaggggcuucuuuuccucgagcauaaauagaaauuugucuuuaacaaggcuguauuaguuaaagcuuaauugaguuccagauuacuuuaugccuuggagacaaaaguagaauaguuuuuuuuuuuuuuuaguacauuauuucacauuauuuuuaggaauaaaggacagaauauguuaucucaugucuauaaucucagcacuuaggaggaugaagcaggagaauggcuauaaauucaaggccagccugaguuacagagugagcuugaggccaguuugggauaaagggucuauauaccagaccuuggauaaaggcuuguaccaugccccuguggugugugaccugcagggcuuuguuauaacucuugcuucucuaaugaacugugagcuguuuuauguaaauucauuuauuuauugugugcuaaacaucacuuaguccuaaggugauaguaucaguaaguuaccauucuugcccuagaaaagaguauaggaagugucccagggaaagaaguaaauauaauuucguuugcuaugggcagucaugaaagcagacuuguagcuuggggaggucagccuugacugagguauaucaccccuggaaacuaguugcuuucacaguguagcugaaccuuuauuguauucccuuguuacagcuuuaaaaguccagaaauucauacucauauuugcaagccauuagccuuuuaggacuuguucaugcaagccaaacuuacuuacauaaggcuuauuuaaaacaaacugguagguaacuuguacuuauggcuagauucugaucugaccugaagcaucaguaagucagagaguagucugauuuuuaagguuuggaauucuuaggguggauccuugcugcucagugaaucuugcuacucaaacagcaacucuguuuuguagagggaaugcuugccagaaucccgguuuauuacuuacuguugacuucauauuuuucauuaugaaacuuguagaggggcaaaaaaaucauuuuaagaguuuugaguaaaggugaaaauauagugaaaaaaaaguaauagaacauuuuaaagacacagggacagaaacacacgggcuugggaacacagaaagaugagaucuagagagaaauggauacacagacuaacagaugagcacacaugcauuucccaugugcgcauguauaagaacccucugcuaagucaguucucugacagagaaccccauguaucuccacagaaucuccugugugcacuaaagcacauacccacauacccacacccugauuccuguccuuugacauccaacagguaaugcuuaaaacagauuuuuauggaacuuguuauuauucuccaugguuacuuugagaaggaacaaauauuuucucuaagguacuuuuaacugagccagaagaugaagcaaaaacagaaggguugccuuugggucgguagagccgggaauuugacaacaccaguuuuauuugaauuccugccuguagagcugcuuguuccuggguaucauuuucaguuugaauuacuuaugcuugcuuuuuuucucucacaagcuugcaaccuagguugcugguuaagcagaguuccaagcucagcuucccuuggugcucauuaacauacuuccaugaugcugacugagucuccucaguccaccugggauuggaagcugcacguugcaccuccguggaggaacuugaacuuaguucucuaugaaaguguggaacugaggaacguagacggaaggccaaaaguagaaagaccuguaauuauacaagucuguuaguuaccaugguggguuguucaugguaugcauggugcauacacaguagauuugcaugaaauuuaagaauaacuaagggaagcugguugcguugguucaugcauguaauucuaguacugaaagguagauauaggaggaucaggauaguucauggucauucuacauagugaaccccaggccacccugggcuacaaaaaccucauuuaagacaucaaacagcagaacuaaagggaauuaauaguaacuuuaaaaugucucaacuauucugaugugugugggaguggcacauugugucagauaagcugagccugguggugaagauaaguaaugccagccaucagguaguugagucaggaagaaauucaaggccagccuguccuauagaggauuguauuaauugacagguaacugguaggugcauagcuggcuuuuguugugaguaucucgggcagcagguuaugggauguauuuuauuagugaagaggaagcuugacuuauacagcucuguguguguguuaauccuugagguuuccuaucacaccgaggacguuagaugguagggacaugaacugaauacuuuuacaaauacagcuucugaagccugcuauuuuucuuuugcugcuugauauagguauauuuauuugaccaaaagucuauuuaaauuuuuauauuucagccaggcugggguggugcaugccuuuaauuccaguuacuugggagguagagauaggcgggcggauauugauggguuugaggcuagccuggucuauaacagaaugacagguagggcuacacagaaaaacccugccuugaaaauauauuuaaaauacagaagaguauggagaaaauuguacuuuuauuccuuuuuuuuuccccagacaggaucucuuguaguccagguuggccuugaacuugcuauguagcugaaggugacugaacucauuaucauuuugucuuuuucuucgaagccaccacacaugcuauaaauuuuucuuuauauaaaaaacaaaacaaaaaaaaccccacaacaacaacaaaaacggucaggacagccagagauacacauagagaaacccugucuugaaaaaccaaaaaaaaagaaauuuuucuuugguaguggagauuauaucuagaaccucacacaugcuaagcacauacuuauacacccacaaccuuugcuuagcuuuuuuuucuuuuuuuuuuuuuuugguuuuucgagacaggguuucucuauagcccuggcuguccugaaacucacuuuguagaccaggcuggccucgaacucagaaauccaccugccucugccucccgagugcugggauuaaaggcgugcgccaccacacccggcuuuugguuagcuuuuaaagaagcaaaauauuguaaauaaagucgaagacccuuucuguucacuuaauuagugcuucucacauucucuccacaaacaaagacuacuguuagccagccuuuucuguugguaaauucuugcuguaguuguuuaacaaucgcauuuggauauuguuuauauguuuuauauaauguauuaaagacacucuucuauagccuacuucuuucacucaguuuucuguagucagaucaagauaaccacgaggaaauccaaauuggaaaagaggaagugaaauucuccuuguuugcggaugacgugaucuuacauagaaaagcuuaagaauuccuccagaaaacgguuggaacuugaucagugaguugagugaggcuucagcaugcaaaaccagcauaaaguauucaguagcauuucuguauccacagugagcugucugagaaggcaaccaguuuauaauaggaaaaaaagucuaggaauaaguugaaagaguugaaagaacaauuuccuguuaaacaugaaugaaagaaauggaagaggacacccaaaagaugaaaaagucacauguucauauauugaaagaauaaauauuguuaaaauaucuguuauccaaagguaucugaaaaagugaagcagaaccaaaauggucuauagauuuaugcagucucuaucaaaauaccaaggauaucacagauagagaaaaaaaaaauccuuguaaaaucuauauggaaccaugaaggacgauuuaauagccaaaggacugggcaaaaagaauaaaggucaaacuaucauaucugacccuugaacuuuugauccuccugucuacaucucuggauugcugggauuguacaugugcacccccauaucuguuuuauguggugcuaaagacugaacgcagggcauuuuauaaaaggcaagaaaaguauuucaccagcugagcuguaucccagccuuucuuguauaucacauuguuagguugccucugggucagaaagcacugauaacaaaauguuucaggcuccuuagcuaggcuguagcaacaggaacacuauuacauguguguguuuguguaugugcuguagauacuacuacuuugccuuaaaaauaguaucuuaaaaggaguaguauccuuugcacuacuuuguagauguauucuuuuuuauucauaguuggcccuuaaauaugugauagaucaugguacucuguauccccucuuaagucgcagaauacacaggaaucuguuaacuugaaagagauaguguuuggaauccauggucaggcuuuucaagccucuguccugcugaucccuaguuaccuacauggugacucacagccgucaguaacuccagcuccagaggaucugaugcccuccucuggucucuacaagcacauguacucacauacauaccuaucuacacacaaguacacaugcauacacauagcuaaagguaaaauaaaucuuaaagccuccccccccccaaaaaaaaacaaaccuggaugugguggcgugguugagaucuguaaucuuaacacuuguacaguuggaugggaggcagaaacaggagucucuggaaucuauuuuuuaauuuaauuauuuaguuugugggccagcuagcauggcagaaacaacaagggugauccuaccuuaacaaggagaaaggaaaaaccugacucccuaaagucuucugaccuucacacuugugucacccccuccucacauacaagaauaaguaaaauuucuagaauguuccaucauaugaauuugucauuauuauagaaacaguuugcuauuacugugucauuuugccuuccugaauucuugucaacaguacauaaaaaagcugugugaaaauagugugagaagccgagaacauagcacagugguagacugcuugccuaucacgugcauggcccuagguuugaauuuugacaucagagaaaagaaacuugugggcaucgugauuucuucuguuguucacuggcuccuuuuucuggaguagaaaucugauagcacauuugggagccagacaagcucacagacagaaaacuuaacuauuauuuuuuuauuucucauauuacuuuuuuguucacuguuuaucaaauguuugcauuuucuugccauucuuacuauaaaacuuuuugggaaagcaacugucucucugacuuuauuuauuuugagacaguuuuaacuauguggcccuaacuggucugggauuugcucauagacuaggcuggccuugaacucuuaagauacacuugucucugcuucccugccuagugcuguggugaaaggugugcacugacauccucucuuguccuuuaugaaaagauuuguuuuuauuaaauuauuugugugugugucuguaugcagguaugugugugugagugcaguugcucaaagcagccagacacauuagauccuccagguacagaugggugcgagaugccgagugcgggugcugagaucugaacuccuggacucuggaagagcaguacacucgucccugcugagcugucuuuccagucccuugucccuuuucuauuuggugcucuuuuugggcauugguuuguuauuacuaaugauuagagguugcuuguauagcauguuaucauuuuuagaaaauaauacuggggcuggagagauggcucaguggguaagagcacccgacugcucuuccgaagguccagaguucaaaucccagcaaccacaugguggcucacaaccauccacaacaagauccucuucuggagugucugaagacagcuacaguguacuuacauauauuaauaaauaaaucuuuaaaaaaaaaaagaaaauaauacugacaguuuauguaaggcacuaguuuuuuuguuauuacuguuuuguuuuaauaaaauuauuaaauuaaaauuaauuaaauugaaaaauaaaauuauuauuaaauuauuaaagccuaggauaguaaauucuuagaaucuagcaagcaguuauuccuuugacucauugcccuuaauuacacauauuauuuauccuuuuuuuuucuuuuguacaagaagcuauuuaagacagauaaaaauaccgacucccagaguucccugggguaacaguaaaauauuggauggaauacaggaaacaacagucuguaccuuuaguuaguuuuuguugcuagaacaaaauccuuuuguaggucaugaacuuuugaguaggcugaguuuugaguuagccucaauuaagauuuuugguuuuuaacuuauaccacccaggcuuuagauuagcaaucagagaaaagcgcugugcuggaauuaaaguaaccauggcaacuauuauaauguaaaugccuucuugggaggaaguggagagcgugggcacuuguuaggauauuccuuuuuaacauuuacaacuggaguggacuaguguuuuacuauuuacaaauaaugguguagcugaucuuugaacauuuuucaauacugugcuauccagucuuaaaaguuuuaccaaggugguagcacuguguuuuaauacauguauaaaacuuaagauguaucugugaugugcuuucuuaaaugcacuuugagacuugugcuuccuucacugacagaauccuccccucuuucuggcgcuaauauugugguucucuaucagauuucuaagacauaaaggaaaccauuuagguuuccagagaagcagcuucaugauugaugauagucaacaucugguuuaugauauaacuguuaaucccaaagauuccaggagaaagaccacugacccaaaucaugauggccaaauuaauuaaaccaagcaguuaauuaaagcaagcuuuuuauuuauuuauuuauuuauuuauuuuuauuuguguacacaggcugucuuugaaaguagguuucuagagaucagcgguggacaaguagaagauaagguccuuacaguccaggaguuuuaggggguuucuaaacgagggauuuggcagggaaauagauggguuacagagguaagacuacacaagcauaauaaaaugggucauagugaccggaaacaaagacauggcugcaaggugguuggaacaacaggugucauaguaaccuuuugacacaaaggugugauugcuguuuccuggaauaggcaguacagaaccauuuguaguuagacuuaaucuuugagaaccagagguuuaaucauaaacaggaaugaaucuaguuugucuuuacuauaagauggcuuucaaacuuaagauggagacaggcuaaaaagaugacaaaaaacaaaacaaaacaaaaaacaacaacaacaaaaaagauggagacaggcugguucaucuuggaauuaguagugccaaggcuauuuuuuaagcagcacaagagagagagagcuuuccucuuacaucuuuuguuuuauuuuagccuuugagauuuaagaaaaaaauuguuuucuauuuuuuaauaaagguauucuuucuggaucuagacauuaugugacuugaagagaagaucagagugaaaccagaguaauugcaaacacguugagcugcuaaguacuguacuuauuaguaccuccaagagccuaguggcuuucaaaaaggccuuuuugagcugaagagaugguucagugguuaagagcauugacugcucuuccagagguccugaguucaauucccagcaaccacaugguggcucacaaugcucucuucugguguaucugaagacagcaacaguguacucacauaaaauaaaauaaaauaauuucuuuuuuuaaaaaaaggccuugucagugaacaguuaagguucuuauucaggguuaaugguuaugaugauuauggugcuagauaaaugcaaggcuucccucagcucggcuucuuccucuugauaaggaagaaugaaagugauuuuguugcugggaaacccaagucauucucaucauaagagauacgccaguauuauugagggguuagaacuuagacaauucccugauggguagauggggagaggggccaugaccagguaguaaagauggugaacuucuaagauggcuggcuuccuccuuaauuuccugaccugugacaaagacuucuuggacuuuuuuuccuauaaguaggcccauugcugaauccgucaguguggguuugugcauaugaguucgaguaccucaggaggccaagaagaggguguugggucuguuggagcuggaguuacaggugguugugaacugccuaacauggaugcugggaaccaaacuugaguccucugcuagagcaguaagcacuucuaaccccucagccaucucuccagaucccuggagaucauucuugauucauauucucucucucucucucucucucucucucucuuucucucucucucucuguuguugccauuucaagcuuuuuuguuuguuuguagaacaugauuuuaguauuuucaacuuuuuaauauucaacaaacagaauauuuauuuuaaaauauauuucauuguuauguauccuuuuucauuucuuuuuuuaaaauuaauuauuuauuauauguaaguacacugcagcugucuucagacacaccugaagagggcaucagauuccauuacagaugguugugagccaccaugugguugcugggaauugaacccaugacugccagaagagcagucagugcucuuaacacugagccauuucuccaggccucccuuuucauuucugauuuuauuaauuuggauacugucucugugcccucugguuauucuggcucaggguuuaucuaucuuguugauuuucucaaagaaccaucuccuguuuuuguugauucuuuguauaguucuuuuuguuucuauuugguugauuucagcucugaguuugauuauuuccugcccuuuacuccuuuuggguguguuugcuucuuucuguuguagaguuuucaggugugcugucaagcugcuaguguaagcugucuccaguuucuguuuggaggcauuucauucuugauucucuuagugguucuucauaugguuuuacuuaucagauccauuaaacuauccugaugauccucuucugacccuauuuauuaucuauagguaauaucucccaaauaagaggucauauuccaagauacugcuuaaccaauaacaauuuucuuucuuguucauaucacuguacuauuaucaguugauuauauuaacuuguaacuuuuuaaacuuuauuaugaguauacguguuugccuauauauacagccauauauaaccugcaugccuggugccuaguggagcuccaaagagggcauuggauacucuagaagcagaguuacaaaugguugugagccaucauguggaugcuaggacuuugaacuuagguguccuggaacagcaaccaguucuuuuaggcacugagguauuucucuagcccagcuuuuuaaguugaucucucgugcugaaguugauauugagcucuucauuuucagccuauuucuacuugugcauaugugauuuuuuuuuuuuuuuuuuacuguuccaugcuaucacuuaaccuuuauugauagccuuauaaucauuagcaaaauucuucaagguugugguaaacaucuaaagugaguucaaauucuauagcaacauuagauacuccuauccaaauugagauuaaaucguugauuauuaaucugagaaugauauuuuaauuuuaauuaguagugaacuuaagaacugacuagcauaacaaucguuauuuagauuugauauuucuguuaaacucucuuaauccauguuaaagaccauagucuucuuuuuccuuuggaauuagaaauuuaaguugaaugcucuuauuuucaguucuguuacuacuuuucuuugaaguucucauugcuugaggguguaauugucuggauucagagaccugcacuuacuauaagcuauucccugcuccuccugcucuuucauugaccacccccgcccccauucauggucuacuuugcucuuagccauguauauucuauuuuauucuagaguuuaaaguuuguuuguuuguuuguuuguuuguuuaaaugcucuccucuucuucauacagaaucucauuauguugcccaagcugaggauccuucugugucacccuucccagugcucucauuauagagaugugccauaauuauucucagaaaauaaagauagaagcaaaucaagaguuacuuaaauagguuaaauuuucuauaauuuuuuuuaacaugauagagucauaucuuauauuuuuguauauacccuugcuggaaaaaauacaauuaguguuuuuauaagugguauaauuuucuuuuaucuuuuuucuuucuuuucucauucuuucuuuugggggggugaggugggggauaaggucucuauccugacuggcuuugaucucacagagaucuguuugucccugccucuccagggcuaagauuaaaggcauguaccaccaugccuagcucaauaagugguauaauuuucauauuaauuuauuuauugcauugguagauauuuggacaucagagaugagcaagguauauucuguucucaaggaggucagauuuauaguuggagagauaauauuaaguauucacuagagcaagauagggccuaguagaggaucucaggccuucuguggugagguugagggaagaauagguaggcaguuaggagucauuguguaggcuuacauaauccucuucagaagaauucuguucaaaguuucuugggcuggucauggacacaccugcagugccagcacuugaaaggcagaggcaggugaauacaguuaagucuuaggguggauuggaaaggcaggaauaacaguuguaggaaaucugauuaaaaccaaaugagcuugucaucuuaugauguaccauauaaauaauuuuugucuuuguuauguuguggucacaagcagcucccagaugucaguaguuauuaaacaugguuuguuuuuugcauaugcugaugucuuuaguguaguuuuguuccaggauucaggcuggagauaagucuaugauuugaggcuuucuuauugugccagaaggaaaugaggcaugguagaaucuacacaguguuucucugaaagcuguucagaagugagcuaugcauuuccuccccucuuuccuuucuucuuccucucccucucuucuuucacuuuccuuuaucugauuauuuuuugagacgggggccuuguuacaaagguuuggcuccuuauauaacccaggaugggcuugaacuuuuuuuguuuuuuuuuuuuguuuuuguuuuuuugagacaggguuucucuguguagcccugacuguccuggaacucacacuguagaccaggcuggccucgaacucagcaaucugccugucucugccucccaagugcugggauuaaaggugugcgccaccacgccuggcucuuuuuuuuuuuuuuuaaagauuuauuuuauuuuacuuguacacaauagcugucuucagacacaccagucuuuguucauugugaauaggaauaagaaagggaaaacagaaagaaauacucagaaaucuacaguugucuaccauuugaguggguggugaguugaucaauacaggagguaucaauaauagaagauagcuuaauuuaauuauguugaacuugagguguuugugggacaucuaaauagaggggacuaguaaggaaacuggauaagcuggcauaaaguucacaggauauagaaaguauuaauaaaaugcucgaguaguaggacugggaauuacagccccaaacagagguaccuuugcuucuugagugcugggauuaaaggcauggaccacugugucuggcuguguauucuauauuuuuaaaguuuaugguguuuauaccuaucuuaccugauaauuuuauuugguucuuaauuuauauuuaugucuuuuuuucauuuaauacacacauauagcacauaucaacaaaauacaguauuuaguuuuugaaaugaacauuaaaagguauuuuuguuuauauuuguuguucauuguuguaugacauggcuuguguguaccgcuuccugccuguggaggucaggggacaacuuuuugagaguuacuuccuuuccauuguagauucuggaaauugaacuuuagucacuggguuugugucaagccuuuuucacugcugagccaucuugcugucucccccgaguuaauuucacuucccauuuucccucuuuguuucugcagggaacccacggucuaggcgagcccuggaccacgagcuccuccuuuuuucuuuucugaguaauauucagugcugaugggaaguccugaguuaaaggguuuuauaauuauccagucagacuuauauuuuacauuacuugguagaaggucaaacguuuacugaaaaauaaguuaagggacauaagagacuauuagguguauuuuaauacuuugguuugcaguuccuucaacccuccucauuguaaaaccugaucugccuaagcgauucugccuucuuaucuaugaguuguuagaacuacuuuugccuguccaccccuuccauuuaguuacuagggaacaaagcuguuauggcaggauggucaagcacuaucuauuccuucaguuagaaucggaguaaaagaaacccuuagaucucugggcccucuaucccaucuuagauaaaaggcagagaaaaauuguuuauagucaaguuuccuuuuuuuugugccccuccuuauuaaauacuuaucauuugauaaaagggugaauaguuaagauuuuuaggcagaugccagauaaauauaauaaacauuauuuuaaaucucauaaaugaacuuagaaaaagguaaagaaaaaaaucuuagagaaaaauggacgcgagugagcuggggauggauguaacucaguggaguaacacuugucuacaguauacaaaggcuuagguccaugaaugcccaacacuggaggagaaaagggacugaaagcuacucaugguuguccucccaagaggcccaacaagcagcugacugagacagauguacauacuuauacccaaccaauggacagaaguuggggaccccugugguugaauuagggaaaggcuggaagaagcugaugaggaggaugacccuauaggaagaccagcagucucuacuaauccagaccccagagaucucucagacacugagccaccaaccagguagcacacauaccagcuggucugaggcccccuacauaucuacagcagaggacugcugggugcaagaugugcuaacccuugacagacauagggccccagggaguggggaggcccggcggaagggguaggguuggggagacauccccuuagagacgagggagggggcaugggaugagaaacuggaagggcagacugggagggagguaacgacuggacuguaaaaaaaaaaaaguaauaaaacgaacaaacaaaaaacccuaaaguuuugggcuaucaugggacuucaauuuuaacagcuucagagacuuucuacauucuuacuuaaagcuuuguuccuuaaaagucacugugucauuaaaaacauggucuggacaggugugaugguacccagcuuuaaucucagccaguggaucucugaguucagggcaagccugguguacguagggaguuacggacagccaaaaccacacagugaaacccugucuaaaaaggaaaaagauggcuuauggaaaauaucugcccagaggcagagauaucauggaaguuugugcacuucaggaccuugguuuguccuuguguguuaagugugguguaauguccuuuuuuuccucucuguguccaagaaacccaaugcucugaaaugaccacacaaucuugaaaugugacacuccaauggcuuuaggcugaaguaaaugcugaacuuuucuauagagauggaauagccuucaucuuggucacagagaugcuccaccuuguucuuuuuuguuuguuuguuuuguuuuguuuuguuuuuugagacaggguuucucuguguagcccuggcuguccuggaacucacucuguagaccaagcuggccucgaacucagaauccuccugccucugccucccaagugcugggauuaaaggugugcgccaccacugccuggccauauucuuuuguucuuaauggaccuuuaaaauucaguagacaauagaauagaucagcuauaauacaucucuguaaugaaauacuguuaauccauagaaaugaauaaauugcugcuuugaagcacaagaucauaguugaguaaagaaaacaugggagaaaagaaaccagacaccaugauguuauuuauaugacgauaaaaacauuaacaggaugagaagucacaaguaaucuuugaggaagaggaaaaggguuaaugguuaggagggcuguaaagaugguuucuaaggugcugcuuuuugguucuuuuuuuaaccuuuguuuauuauuaucauuaucauuuugguauggguguuuuguucacauguguauaucuguaucacaguaggcuuucaguacagaggcuggaagaggacauuggauucccugggucuagaguuauagacaucuguauuaguaaugauaugaauguaaauuaauuauagucagcaguuaaaauacagauugugguaguauguuuccgggaaggcuggcauaaguuccuuuguucuguguguauaccaucccccaucuagaaguagaggucauuguucaguuccuuuugaaucugaguuggcuuuugucacuugaucaauaaaacgugggagaaaugauacuuggggcuuuggagauuaaaucaugaaaaaacuugcagcuuccuccaucuagaccacauuaaacauuuuugaaauguucuauggagcacauccugggaacuagauuaacaugcuaugagaaacccaagccagagggagaaggucagccuugugagugaaggaaacauuuuggacaguuggacauccaguuguuguagacaucauauguaaaaaaacuaggguccaggcauauagccccagucuagacaucuucaacuuuggcacuacuucaccuggccucagaggucacaaaguagacaucaagugucuuuguuauaucuucuccaaauauggaaccuuagcugugugaacauaguaaaaugauuguaguuuuaugccaccaagcuuuguggcagauuguuuauaauagauaaaugaaacagacgugugcuaucacagucuauaaucugcugacuggggguuaguguuaaguugaaagugaagucacuuucaagaagacugagcaaagguuugaaacacagugaggaagguguugcugaaggcuaagaaaaaaggaaccuuuaucauaucaguggcagauaguuuauuugguuguccacacuaucaucuguaguaaauaacaugaaagauaaaaaguauaacaaaaguggaggccagugagguggcugagaggagaaaagagcuuacccuauaagaugaugaacuaaaacucaggagaaagcugagugcacccguccagcucucccugggcugaggugagagccaagacaggagagucaccuggaagacucugggucagcugcucuacaguauacaucauggcaggaacaagagaagugcugcccaacaaugguggaaggagagaauugacucccaaaauugcuuccugccaauccccaucucucucuccccccucuccccuccccccuucuuucccuauuccucucuuucucugccucucuuccuuucucuuccuccccucucucucauaauaaguaaaaaauuaaauaaaauuaauaaauuuguaggcaggauguuuaaaagugcuauuuagcuccugcuaguugcuuauaagguauaaaaaauuagagaugaggcaaaaaaaauaagcuauugaagggaaauauuuuuuguuugcuuauuuguuuugagacaggguuuuauggaguccauguuugccuugaacucuugcuccuccugccuuugccuuccagugcugggauugcugguauaugccaccacacccaacuauuuauuguuucuugagagaaucucuguagaccagccuuaccuuaaacuuguggcaguccuccugccucagcuucucuaaugcuaggaauacagacaugggccaacauuucauacaagaggaaauccuucucuaauucaggguugaguaugcuggaaaaucaaaccuccucaucccuguuaguuucagaugaccaaugacuuaaaaccauggcuucagagcaaagauaaaauucaaggcuuugugagcaaaaugugaccucaaguaaauccacuuguuaaacuucuaaagacguaaggcgacaucacacaaaaccuuuccguuacaugagagcaagccugaaggucuuacaagggacaguuguagaucuggagguuauguuuuuaacauuaacuucacaaagaacuugaauugagggaauauauauguguguguguguguguguguauauacauauacacacacacacacauauacacacacauacacacauacauacauacauacauacauacauacauacauacauaucugucuaauguaagauuucuuggaaaauauacaaggcuuuuaggaaauuguacacuaaccaaggguuagagccaggaaguguagagaauaguuacagggugugggacuuuguugucauuuaggagcuggugacuugugucugaguuuuagaauugauggccuccucguuccugcucuucucacauugccucaccuucugaaugagaauguuuauuguggugaccugagucagucucaguguccuguguuguguguugagugugugggagcagauaauuugucucuuuaauucagaugaagaggaauaagacuccaguagcuguacccgaggaacugcaucugaggagcuccacccaagcuggaccugacuuagauauccagauacugaacaucaagcugaugccauaaugagaugagaauuuugaaggucuuaggagagggugaguguaauuugcaugucggagggaguuguugggcccagaggguggucugugguaguuguuugacuccaaaguggcuaguagcaguuucuuccuuucuugccauucagagauagccuguuucucuauuuguguugaaugugggcuggcuuuagugagucacuuagcaaacaggcuguuauuuguugggacugcuaagacuauaucauaagaagcuucacaacuucuguguaugguaccuggaauucgcugucuuucuuucuauugaaugugcauuggugguuugccuaaauaugugucugugugagggugucaggucucccagaauuggaguuauaggcaguugugagcugccauggguucugggaauugaacucagaaccucuguaagaacugccagugcucuuaacucuuaaccacugagcaaucuuuccagcccuguuuuauuuuauuuuuuuaauuuuuuuuuuuuuuugaggcagggucuuacuaucuagcucugguuguccuggaacucacuauguagaccagaauggccuuaaacucacagaaaaaugccucccccugccuccugagugcuggaauuaaaggcauguaccucauaccuagcucaguguuuuguuuuuguuuuuguuuuuuuuuuuugguuuuuuggauaccaguaaauaacuggaauauuguuggaccaaauagaaaauaaucuagcucuguauaguuugugagagucauaucuauguauaagggagacauaaggaaucagauuggaaguaaagguguggaaaaaccuauucuaaaagaaguuagugaagcauauuagugguacagaaaauucauuugaaggcaaagucauuauuagaguuaaaaauugggcuggagagauggaucagcguuuaagagcauugacugcucuuccaaagguccugaguucaaaucucagcgaccacaugguggcucacaaccauccguagugagaucugaugcccucuucuggugugucagaacacagcuacaguguacugcagauacaguguauucagauuuauaauaaauaaaucuuuaaaaaaaagaauuauaauaaauaaaucuuuaaaaaaaaaagaaaagaaaaagaaaccuugccuagaguuaaaaauaauuaggagaaauuuaauaauuaggaguaauuaagguggcacaugacuaauuucagcugcucaggagacugagacaggaagauagcuugagccuagccuaggccacccuuggcaacaaagcaagacucuauuuauuuauuuauuuauuuauuuacggucuuuuuggauauaacauaguucuggcugacauggccauauuccugcuucugucuuuuaagugccaccgugucugacuaagaugccagucaagagugaauucaggggaggagaugagagagaaucuguaucuccauauggauaaacaaauauauaaugcaggaagaaaucugugaguauaauuguaggaguaguuugguaguuccacacagugagaauucugacuguuuugaguaaccuaaagucauaugggcaaacauuuuuugagaaaauauacuaaaaauuugaauaaccaucaagcuccauuugauaggcaugcacagagucuuaauagaugaggacauacuuuaaaaaaaaaacuaaaaauauugaauacaugcuaaauucacauuaagucuaagcaauaccacugaguagauggauguuaagcagacugccaauuauauuuuguuaacgcaauauagauuaaaauugagcaaaauaauaacccaaagaauacuauuuggaacuuuuaaagaaacugguaggucaaaaaggaaaaaauaaucaaaauuggaaguaaaguugaaugaugauauaguuauauggauuauaaauaaagcaguauccagagggaaauuuacagccuuuccuacuuuuuuuuucuaucccuacauguucgauuugagccuuuaaaaaugucuucugucucuugguuuucgaguaagacauguuuuaaugcucuuauuugguaauuccaacauuuaugccaguugcauauuagcuuucaacuguucuguuuucuugucuuuaugaggcauuaucuucuuacuucugauaaacuuguauagauuccaaacaggaauuguacuuuccuggauacugggacuuuaccuugauucauaucacaacugagucugaucuuuuccuuaaguucacuucccuguagccagaguagcucuccaucuagagcuggucccaaauccaacgggguugcuccacccaguaccacaugguuuaggcuuucauuucugauuagugggaagaggcuuggcccuguccugaagggcacuucacauugccucuguuucaguacuccaccgaguauuuacagguucuuugcaaaauccuagaugcuacugugugcugaccaucuugccuugaucuccucagacagacucucagcucaaucuccucagcuaagauaggccuuggggcuccccggucaaggcgacagcagacagcggguucacugggucaguucacauuguuuccugucucuuagggcucacugucuuuuauugcuuggugcacuuuguuucuguaaguuuguuucaggcagguauguccuggaacucucuuuguagcccaagauagccuugaacuugggacagugccucugccucauucagccaauuuuagagguucaagccacugcgucugauugguuuguuucuaaauguccuuaaaauguuucaugauaaacacaucugucaaaugugcauguuugucaaaagaaagacauggauuuacuuuuucuacacuuaaauuucuucaaucauuuugggagauuguucuagauuucaggcauuuuuaagucuggcaugguggcauacaccuuuaaucccagcacucaggagguagaaguagguaccuggucuguagcaaguuccuggccaucuaaggcuagauaguaagaucugccuuaaaaaaauaauaaaaaauauuuucaguuaauuccuuguuuugauuuuuauuugcgaucuguucuaugguuauauaaguagaaaaauacuuggcagcacaggcccugggguuugagcuaaacauugcaacuuuguuucucauauuagcuuccaaggagcgucagguggucauuuuguuuuucacuuuaaaaguaguccaucugucucauuugacuugaucuugugaccucagggaagaaaccuccuaggaauagaauaaagaaacguuuuauaucccgaggcuuuuauaaacaaaaugaagauacaaauauuguuuuaaauuuaauauuuuaaguacuuccacaaugcagucaguuuuccuuaaaaaaugaagcacuauucuuuggccuagugaauguuucuuuauaaauaauugauuucuaagauuuccuauuuuaagaagacuguguucuaguugaauaauuuaagggaaagugaugaggcuaugaauucuuuuaguagaauaauaagagaaagcaagaucugggguugaugugagaagaguagcugugugguuucagauggaguuuguuagucuucucaguugggucaucucaccacaguugaggaagugaucugauggaaagagucuagaauaauuggagccaucaugagcuaauguuaucguugggaagaugaaacaucacauugaaggauuccaucuugugacuuucaugcuuguuuccuuugccucucuguauguucaguguauggcuguugauaauugaaagggagagugaggacuggagagaguggcucaaugaaaacugcuguucuuuuagaagaccuuaaaugucuguaauuccagagccagaggaugcagcauccuccuuuggucaacaaggcaccugcacacauguaguaccugcacauaaacuuacuugagagagaggggggggggaacuacccucuaaaauagaaaaauccaaacuauuaguuucuaaagcuguauuuuuuuucaaacugaaagacggucuaacuuuuauagugccauuuauagaauuauguaccaggaaggucugaauuuuuaaaauuuuuaccaguauaaggaagacauauccaguuaaaauguccugcaauauaaacauuagaagaugucacacagagggguacagugcccccccaggcccugaugaggcugaggcugugguuguauauguauguguaugccugacaugggcuccuuauggcucuacucuccuccuuuuucauggugguaucccucuuaucguuaugcuucacaguuuccugauguugcacucauguguucacagcaccagcugugcugaggacuauguuauuuucuugcccuccuauuugagacuucccugagucauucuuacaggagcucacccaaguucguugaacucaacuauaaacuacagguuucuguuagacgaacggggcagaagucagagcacagagacuccuacuagagaaucugagaggcaaggaaacuaacauaucucuguguccugaaaugaccagggucuccugcccagauuaggaaggaaggagcacuugccacagucuuccuguagugucaggguauggggcuuugggacuuugaagauccaguuugggcacauuuuaacgaaaaggagaaaagaucaucagagaaagaacuuuaguccuuggacuuagugccagccucccuccugagggagaugcucuuccggacccacacagagagcaagucagauacacugucaagagugacagcagggcacauaaaggaagacacuugagagucccagcuggucgccugaagcuuucaaacaauggagucuaaaggagggagaaacugagacuaagggcauacuuugggugguucucuauuuugauugacagguuuauauaaaaauguaucuguuguacaucuucuuucccauaaugcauguccaauuaugcauaggcaugcaaugguaaauccagagcuuaucacuaaaacuuucagaauccaguuuuugguuuuguuuuguuuuagguuuguuuuuguuuuuuuuuuuucaagacaagguuucucugugugcuccuggcuauucuggaacuuucucuguagaccagacuggccuugagcucacagagaccugccugccaagugguggggcuaaaggugugucccuccacuuuuaauccaccgggaauccaguuuuacuuuaccgugcaugcaccccaaaggagccuaggcuggaccagucuuucuccuuuuguacuggucuuuugaagaguaugauuggguagaaucugucuguuugauaguuguuaaggggaggaggaacuuacucuguuguuuggagugggguguauauacauaguacaugaagguaagggucucagccuaccaagugcauuauuauuagaagaguggugugcauguagcccaaucaagguagucccaggucacuaaacuauuccuaugcuugccugccuccaaauaggaauaaaaaggcacauuauuacauauuuuuuuacaaaucuguuuaauaccucacuuccuaagaaacagcugaaguuagauccccgguugaagguaacuuuauacaguauuuuaaaagugagugugugugugugugucggucagaggacaucuuugugaaguugcuucuaaacuccucccuuaauauggguucuggggaucaaacucagauugccaggcuuguguggcaaaugucacccacugagccaucucacuagcccuuuaacacaguuauuuuaaauaauccuguaugugaaauaaaaguuccauggcauagaauuuuccacuugugcuauuauguccaggccuuuucagauuaggaauacuaaacuaaaaaaaugggucaugggucacacuuugaaacaacuauugccuauuuuuauaugggaaagagaaacacaggaguuaucaccauuaaguacaccagauuucugcauguguuuaaucaauacaggcuguugagccuaauuaagcagugcagcauccagacuccagacuugaguggguggggagccgaucccuccaagcuccgaggugggaguuaguccugguucaugugcucuuuaaaagcaguugcuguucacuguuaaaagugguguuuuguuuuuuuuuuuuaaaacauuuauuuguuuucugggugugugggugcaugugugacacagcucauguguggaagucaaagacaaguugcaagaguguauucucuuuauccccuuaugugggucccagggguagguccugaugggacucaggcugugaguaagcaucaggccggccaguaagcauccuuacccauggagccaucucaacaccccacauuuagcaguuuuuguaggcugugugccugugggugugcguggcucauguguggaggucagaggacaacuuucaggacuagguucucuuuuucucucaugugggucccagggauagaacucaauuagucaucucuccaacccuugacuuaucuaccccagguauaauccuaguauaauuaacaucgauaaaaaauaguuugacauaauauauaguaccaucaacacucacagugugggagcugaagaaaugacuguucuugcagaggaccaaguucaguucugagcgccuacaguagacaguugccaacucccuguaacacuagcuccagggcauccaaauucuggacucccaagagcaccugcaucauaucugcacauacuuacacacacacacacacacacacacacacacaaaaugaaacacacaauagaggccagauaucagaggcauaggggcaaacaaugaccacaagacaucuuuuugcaguucccaaauagguuuauaucuuagguaugaagucaguuacagucccauuuuuuuucuucuuaaggcuaaaagaauuugauagauaucguuuucaaaaauaaguuguuaaaauuguauuauaacagagcgguuagaaauuugaauggcgaauaaaguaaaaauaacugcgauaagguuuuuuuucuuccauaaaauuucucucccuuuuaaaauauaaugugcauuggugacuuuccuacuuguguguccgugugagggugucagaacuccuggaacuggaguuacagaugugagcugccaugugguuggugggauugaacaugguucaauccccuggaggaacagccagugcuuuuaacugcugagccaucucuccuaaaaaaacauuuuaaucuuccuucccucuauccccccucuuagcuacccucccucaagccccucccaugucccccacucucaaauugauagccccguuuguuugauuauuguuacauacauacauacauacaagagcaccugcaucauaucugcacauacuuacacacacacacacacacacacacacacacacacacacacacauauauauaugcauagauauauacaaauacaaccugcuuaguuagucuuaguuguuuguugcauauaguuucagggcugaccacugugcacuagacagucaguaaaugggcucaucccugggaaaggcuaauucuuuuuuguuuuuuguuuuuuguuuuucgagacaggguuucucuguguagcccuggcucuccuggaacucacuuuguagaccaggcuggccucgaacucagaaaucugccugucucugccucccaagugcuagaauuaaaggcgugccaccacgcccgguuggaaaggcuaauucuaucaacagucauuaguugucuguaguucuuugucuuaagaguagaaccccauaaaacuugcccccucugcauuaacauguucguugauauugccauuguuccagucuugcuuaugcagcuauuucuaggagaggcuguuuaacagccaacuuccugguauucuggcuuuuacgaucuuucugcccccucuucagagauguucccugagccacagaugaaggaguugugauguugauauuuguugggguugggcuccaugaucuguugaauaagaaggagugaugagggacaaacaauaccaagguuguuugauaaagcuuuaaggaaucauauuauuuuguauuuacuaaacuuauacauauaugcaaaaauaaauauguauuuuauauacuuaaacacacacacuaaaggaaauuaagccacuugggcuaauagugcucuccacaaaaaccacaaacuaaccaaaaccccuguuacuaagcaugagaaccuuccuucugaaugacugaccaggguaguccacaugcuugccaaaacaauauaggcuauugauguagccuuugguugccucucagugguugagggugggcucuuauugcugaagacacuguaugcauagaacacaggauuuuuuuuuuaagaaauucguuuuagcuuuuaugugcuuuuauguguuuugccugcuuucaugucugcauaucaugugugugcagugccuguggaggccagaagaggucauuuggauucucugagauuagaguuguauauagcugugagccaccauguguacgcuaggaaucaaccccgguucucugagaguaaccaguacuuuugaauguaagauaucucuucagcucugcagcuuguucuuuuaaaaagaucuauuuuuauuuuauguuuauagauauuuuaccugcauauaugucuuuguacuacaugugugcuuggugucuguggaggccagaagaggguguuggauccucuggaacugguauuaaggaugggugugagccacaguaggugcugggaauugaaccugggucccuggguccccugcuugaguaagcagcacuuuuaacugcugagacaucuccauacacucccauaaccaaccuuguuucuaacaauucaaaguuuaguguacauuugauuagucuuugggccaauaauuugaagauaggagaaauuauugccagguuuuucauaucaugcauuugcauuugacuucuaaccuucguaugcuaugcagguucuuuaagauaaauggagggucucacaguguggccauguagaugaagauguuuguaugggacaaaugacauccucucacaucuucucuuucgucuucuccacauccagcuucagcaugagacccuaagccucgaguucaccagcuugcagucuauaccccgguccccaccacaauuccuuggauuauugauagaaagucaagaucuuauaauuucaucuguaaacauaccacuuuaucucuaacagcaauucuauuauuauacuaaaaguuuauauuucuuuaauaauauugaaacaauguauauaauuuuucuagcgucauucauaaaaguuuauuuuuugguguauuuuaaucagaaugcaaaugaauuucaguuguuuuauuuguugugagccaccaugugguugcugggaauugaacucaagacgucaggacaucuggaagaacagccaauacucuuaaccacugacccaucucucuagcccugauuuauuucuuuauacauuuuauuucuuauaaacugcaucauuuggcuuguaauuuuccuaagucugaauuauacugacuauaucucuagugguuuuuauuuguuuguuuuguuuuaaacaaaaaaacaguacuuauauuuagaaguuugcuuggauuuccugagugcuuucuuucauuagaaagcacauaaugucugccugucuccugugaugucagcagcuauugaucuuugcagcuauccauuaaaucauucaggcuauaaaaugcucuccauuuauguccuucuuucuguaaugagcaugccaggugagugcuuccuucuuucuccuuuucaacaguuuucaaaaugcuucaccagcuucuccaguggugaccaguuagccuuguuuuauuuauugggguuggguaucauugugaauuuccaauuuaaacacuuuugaguguguuucaguccagugcuguuauuauuacacuuuauuucauuucuuauauuuuuauguauggucuuguaguagaguagguugaaaaugaggacaugucucacucccuuuguguccccagagcuuagucuuuaguguuuaucaaaugagugaauugauguucucuguagcauuucaaaaugugauuucauuuugaggacauuacaaacaaugucaaggauaagucuuccugauugaucuagaaaaggggauucuaagugaagaaauacugcacaaaaauaaagaaaauuauuuuuuuuuaaagugacuacuagguaggugugugguggcaccuauaaacucaacugcuuaggagccugagcugggaggaucacugguguccauucagucugaaacuccaaccuuggagaguguggaagugguauuuaauugcuaguacugagcagacauagaguguucuauuguugccaauggaucuuucauuguaauuccccccuccucccaaaaucagucuguuuuuacuucucuugcuauagcauaaguaacauuuaaagcuaccuuuucacucccguugucuuuuugcucccuuaauauagaaaggcuuguguguugcagcacugacuggggaagccucgcacgggcuggggaagugcugugccacugagcuguauucccagcuuauuguagaagguuaaaaacaaaacuaacuuauccacuuacucugcauuucccagacaauauuuuuuuuucuuuuuuugagacaggauuucucuaauuagcccugccugcccuggaacucacuauauguuuuuaaauuuuguuuguuuguuuauuuauuugacacaggguuuccuuguguagcuuuggcuauccuggaacucacuguguacacuaggcugaccuggaacucacagagauccaccuaccucugccuuccaaguucuagccauguccgcccagcugcaaagauucuuuuagguacaugcuaggcaccauucuaaacccuuuuacauggauuuauaugugucauuuauucuuauuguaacccugcaaaagagaguagguagcaauuuuaacaucuccaugauacagaugaaaucacugaagcacagacauuaaggaauuuuugcuccaaguagguguuuuguuuguuugauuguuuguuuuuacaaaauuuguaguuuuauaaggaaaagcaaauauagcuagacaagguauuuuuccauagcaccgggaaucgaauccaggccucauauuaugcucugagcuagugcucuaccacuaaugaucuccggccugagaacuacuaccucccucccuuuuucugcaacaucaagaacaaaccuagaaccugcugugcacuaggcaaguucugggccacugggucuugucccucaguucuccuaggugcuuuauagguaguugucaggcaagcaagugugcaaucuucguuuucuuuuugcagugcuuguugaaucauggccuugugcaugcuagugcucugaaccauuuacuuauaucccuagcccaagauagcccuuuuuguuguuuuauuuugagacagggucucaucuagcuaggccagguucaaauuagaaauauuccugaugcuuucuuucaccuaccaagugcuuaggacagcagguguuuacugccauacaucacagagcaguacucuuaggaacuuacugcugaaccucauuucuuauauuguuuccaucugcuggcauuccuuuucuuuguggguucccagcuuucagcaguaggaacguuuggaggguuuuguuuuuaggcagggucucaccaugcagcccuggcuggucugggacuugcuguguagaccaggcugccauagaacuuacagagaucugccugagucugccuuccacauagugagguuaaaacuauauacgauuaugcuuggcaggaagcuaaguuuucauuuuaauuuuaaugcauguguaugaauguuuugccugcguguauaucuaugcacugcuuccaucccuggugugucggaagccagcagagugcauuguuuccccuggaacuggaguuagagaugauuaugagcuccauguggguucugggggucaaacccagauccucggaaagagcagcgguguuacuaacugcugagcuaugcaguuaucucuccagucccuagaaaacuaaguuguagugguugaagaaaauuaauuaaaaaauaagaaaaauacaauuacauuuauuauaauaaauaauauuuguugauuucuccagauugagaaauugaaaauacuauuaaagcaaauauaaauugcuuggaaauauauguaugagccuucaccugcucuuggagucuggcauugagaugaucugggagaagaguguuuaugagcacauaaaacuuuucaaaacagaaaaaccaagcagcagcuacacauuauuuuuguuuuugaaacagauuauuuuuauuuguuuguuugcuugcuuguuuguuugucucuuuuuaacaggguuucucuauguagcccuggcuguccuggaacuugcucuguagaccagucuggccucgaacucagaaaucugccuacgccucuaccucccuagugcugggauuaaaggcaugugccauaaucaccuggcuugacucagauuauugugagauagcccauccgagcuguguaguccacacugggcuccagcucaugguucucuaagccccccgaauucugaaauaauagacaugugccacacucauagcacaaguauaaaggcauggugguacaugucuuaguuccagcaugugagaggcagagggaggaggguggaguucaguaccaaccugauuucaugaguuacaggccaaaaucugaaaacugaguggagucaaugaccagaaggcuuugagguuucaggucuuauuuguaguaggauugcucagccuggcuauucuaauuccagaaaagaaaugguuucaugugaauuuuuauaugguauugagauauaacuccaaugugauuucuucacaauuaacuuaauaauauuaauucacuuuuaggaacuaagccauugucagaaugauuccucauuugcuguuuaugaaaagucuugacuguauuguguugugugguaguaauggagaaggaucauuucaguuaacaugauucuacaguguaugcaucuacccagucauuuuguaagaaaggaaugguuauuucacuuauucuuuuuuuuuuuuuuuuuuuuuggaaacugaauaguuuguucuagcugaauucaaauagauguucaguugguagaacaauuacuuugugugcacaugguaaauguuauuuacuuggacacauuugccuuuuucuauuuuauacuuaauugguuugacugcaucucuaaaagcugcucuuuagacuggcagccaacaaaccccacaugucugagagagaugccaggaaaguguuugugcuccaauuucccuaauccuuaauuuuuagaggucacugaaaucacgauucuuuagagggugguaguguguuuuggaccauggcaugggaaaaaauuaacacuuuagugacuuaugcauuacacuuuuaacauguguuaacuuauuuaauuauuagaauucuaugagguagauggccuaucagguuuauacauaaaaauuugggguuaauuagccuguuucaaaucuuuguuuuuuaaugcaaauacuuugcacauccuuuucuuuuucuuuuuuuucuuagauauuuucuucauuuacauuugaaaugcuaucccaaaagucccuccccccacccccccuuuuuuaauuagauauuuucuuuguuuacauuucaaauguuauccccuuuccugguuuucucuuugaaaacccccuaucccuuucccccucccccugcucaccaacccaccuacuccugcuucccuguccuggcauuccucuacacuggggcaucgauccuucacaaaaccaagggccucucuucccauugauguccaacaaggccauccucugcuacauaugcagcuggagccaugugucccuccauguguacucuuugguuggugguuuagucccugggagcucuggggguacugguugguucauaugguuguuccuccucuggggcugcaagcuccuucagcuccuucaguccuuucucuagcucuuccauugggaacuuugugcucagucuagugguuagcugagagcauccgccucuguauuugucaggcacuggcagagccucucaagagacagcuguaucaggcuccugucagcaagcacuuguuggcauccaacuuguuggguuuggugacuguauuuggggugaauccccaagugggacagucuccggauggccuuuucuucagucucugcgccauacuuugucucuguaucuccucccauggguauuuuguucccccuucuaagaaaggcuugaaguauccauacuuuggucuuccuucuucuugagcuucauuuggucuaugaguuguaucuuggguauucugagcuucugggcuaauauccacuuaucagugaguguauaccauguguguucuuuugugauuggguuaccucacacaggaugauauauucuaguuucauccauuugccuaagaaugugaugaauucauuguuuuuaauuuggcaguuccucagaaaauuggacauaguauuaccugaggacccagcuguaccauuccugggcauauacccagaagaugcuucaacauguaauaagaacacauaccugucucaaaucuuaagugacaggacuaugauuugaagacaucucugucuccaagucucguucuuucuauuauaccgcaugugucucugucuguuauauugcuguagcuguuaaacggaacaggguaacuuucuguuaguguuucaguacgacaaggcaguuaaugggauaaguaggcauacuaagaagauugcacuucauaggacuuaggucagcuaaguuagaguguaaaccugucaacuugcgugugauaagucauauguuguaguuuccaagacuauaaaugaagaucacauauguucagguuucuaaugguacaugugugugugagcuuugaaacuuagaaaauucacuaauguaaaaaaauaugacugacacaucauguggcuuggugaaugauauuguucuuauaaccaagaaacacuuaguugaucuuggcaguaugccauugaaacucaaagaaauagcaucugucaaucacagucauuucuuggaaggaagcauugaaaaacggcacagcaguuauucuccuugaccucuuucccugaaagggaauuggauuaggcaagcugguuucauaauagaguagagcuucucucuugucccuggggaauuuaagccgagcagccagacuugcugugugaagccaguacaaucugguuuucaaggauuuaacuaaauucacugugauuaagguuuuaugagggaugcacauugcaaagcagcagcuuuaaaaaugcugcaucugagucaguccaugucuuuagauuggagaacagaacagaacagaacaacuaaguaaauucagggaaugcuccucaccaguucuguaguaucuuaaagagaagccuagauuucgaagcugaaaaguaggcagaaggggacauuauauagauuauauaaugagucuuuguguaggcagugcuugauauuucuucagguuuuaguuuauaagcugacucaaggauuuuauuucaccguacagaaagagaaaaccauguugagcauagugguauagccuguauucccaguagugagcaggcaagaagugugagcauucuugcagguuguaggucagccucaucugcaugguagcuccaggcaagucaccacuacauaacaugacccugucacgaacacauaaagcuaaccgaaagguaaacaaacacacaguacacagugggaauauaguuaguauauaaauauuaauagaaaucagucacagaccagauauaauggcaccuaccuauaaucucagcucuggggaaacagaggcaauuggaucucuguuuguucaaagccagccugauauauguagaaaaauuccagcccagcaaaugguuuauagugagacccugcuuuaaaaaaaauuacaguauuucaauuauuaccuuaaaaaugaaggcaugcuggagaggcccccuauacccugguaaaacucaacauugucuuugauuaggcugaucuugcuucauuccuuucacaaacaguggcuggcuuugcuaggaguuucaugcaaugcaaaucccuugugauucuuuuuaaaugguuauugauuagccuggcaucauggcgcagaucuuaacucuuagcuugcaggaggcugaggaagggugauuacaguggauuugaggccugcauggcucacacagugugacccugucucaagaagaaaaaacaaaauaggccuggggacauggcuuaguaagagugcuugcucuguaagcaagaggaccaugaguuuucacauagaaagcuggggcaugacuucauaugccgauaacccuuccuggcauuguggggcagaaacaggcagaacauuagagccaaccaguuagcauaaucuaaaacagugagcauccaguucauugagagacccugugucaaggcaguagggucuaggaugauggggaaaacauuugacauccugcucauguugggguaggugcccccucacacuuaaggaaccauacaaacacacgcacacacacacacaaacauacauaaacaauagcaacgggcuggugagauggcucaguggguaagagcacccgacugcucuuccagacugcucuucugaagguccggaguucaaaucccagcaaccacaugguggcucacaaccauccauaacgagaacugacucccucuucuggagugucugaagacagcuacaguguacuugcauacaaauaaauaaaucuuuaaaaaaaaaaccaauagcaacaacaacaaaacaccagaagcaccaaggaaaaaggucugauuauccuaaaauaguuacuuaagacccuuuuuagugguuugcauuguaugcagccacagaaagccaaggcaauagaaucucaaggucaaggccauguuaggcaaugggccuucugucgcacccgcucucgaccagcaagaacgacgcgacaccaguccuucuaacagcaguuuauucaguccugauucuucuuguuuauaucucccccgaacccugggccucucacuccuuuuauacucucucucauccacgcaccgcaggccacgcacccucgccagucacgaggcuucagcuaaucagggcagcaggggcaaaucuccaccaaauuggauucaccuguauccugguacaccugcgcagcacucaagauguuugugucuuauaugaggaagucaggugcaagucauauaacuuagcugcagucccuggcuccuuugggacugccgccacacccgcuccccacagccuucuuuccaaaaaggguaaauaaaacaaaaauaaauaaauaaauaaauaaauaaauaaauaaauaaauaaauagaauuuuaucacuauacuuagaaaaaugaaggcuauaaugaguggagaagagaggcugugucagggaagcaaugagaaaucaccguauuccuuagcaccauuuuuaaaauucacuuuacaucucaaucagcucacguccucuccuuccacccucacauacuccuuccucauuacuuccuucuccuccgagaaggggaagccccccauggguaccaacucacccuggcacaucaaguugcaacaggacuaggugcauucucucccauugaggccagacaagguaucucagcuaggggaaggggauccaaaggcaagcaacagagucagacagccuucccuccaccccccccaacccccacccuucuccaguuguuaggggacccacaugaagaccaaggugcacaacugcuauaaauguauagggccuaggccuagccccugcaugcucuuuaguuggagguuuaaucuuugugagcaaccauggccuuagcaccauuguuauaccaccagucacagacuuucccccucagauuauuucucacaaagucagaacauggaaagacagauaaaauuacucuugaguguauguuggcuuucacuggauuuaaauauuuuggcucucuagaauagcuugcucaauugagcaaaaaaaaaaaaaaaaaaaaaaaaaaucugagacuuauuaccauggaaaggaaacagucuuacaccucaauuucgcugaaaaaguucaaggcauuguauuacuaagugguuuaaaggaauguucagagcugggcgugguggcgcacgccuuuaaucccagcacuucugaggcagaggcaggaggauuucugaguucgaggccagccuggucuacaaagugaguuccaggacagccagggcuauacagagaaacccugucuugaaaaaccaaccccccccccccaaaaaaaaggaauguucagguagguuuugaaaauaaacucaggaaagagaugaguauguauuucuuaguuuauugcaucugugcaguuugagcucguccccuugcuuggugagguaagaguuggacacauuaguuuaugcucuccuccccaaguucaguuauauuucagucugacugaaguaggugauuaaugugucaaagcucuguguguguguuucccaucuuucucaccuguagugccuggugcaucccccccacaaagccugacugcaggugaggugguuggggauguaaaggcaagggccagcgugugaagcuaggaugucagcagcugcuaggagaggggcugccggagugcaguugguuguuuucuaguuauaauuuguauguguauguguacccuuggucaugauggugucgggagcugccugugaauccuucccacuuacuaugcuugaucuuaaaacccaccugaguugugugugcuacuaaaauuagagggacagaaaaaaguuggaguagguaagcucucaaaacagaaggcccaguguggugcuuuggaagcuagugcacugcucuggaccaugaggugcuggugugacagcaguggggggagggggggggggaggaaggagguugagagugcucuugccuaggcuuauggcuaugcuagaaacugcuguggagcucucgggcggcugagugggcucagaaguuaaguuggaagugguguugcaugccuguaaucucaacacuugggagguagagacaggccaaucucugggaguucaaggccagccuagucuauggagagaguuccaggacagccagauuggcauagugaaacccuguccuccccuccuccccucccaaaaaagaaacaggcaagcaaacaaaacccuaaaaacaaugacaacaccaagaaccucagaaaggaccccguuucuaucauuuacagcgaacuaaaccuccacccuuccucuuuucugucuucccuuucuccuuccuuuucuuucucccucccaucccccccuccuuuuaauguauuuaguuuauuuuugggaugcaaucuuccuguguucucuaggcuggccucuaauucugggcuugugcuacagguguggcaugccuuuacauuuuuuaaaagaugagaaaaauauuuaaggaagauguuuaguauuuggucauuuccaauacauaauuaaauauuagagauaaguaagaagacagccuuuaguuuugauuugauaggaaagauguuaaucucauugaaagaauaugguuagaauccauuccuaauggcaagagaaaaaaaaaaaccuuuucucacucuuuuucuaaagggaauggagaguucaccaaugggacaccuuuauugucucuuggugaguucugauuuaggaaaucuaagguauuuucuuuuuaauguuuuagugaaaaauagaaggaagaaacuauuuuguucuauuauuuaacuaaauauuucaagaaaaggaucauaaguacagguuaaauuucuacuaaucuaucugauuucaccacucugguuugguuaggagcugucuccaucuacuggucacagacgaccugcuguuuuauucggguacaugcuuuccccacuuucucccuucagugcuugacaguugugcagccaggcucucugugauuaaguaucauaccuuuaugucgcuuuuccuagaaguuguagaccaauaauugcagagagagcagugcaaagggcuugaagaaauaaaccaaaaagcugaacucuguuaagugccucguuuguguuuaguauuugccaaguaagucuaauuuauauauuaaaugacuuaaagguuaucacuucuauuugaccaagggcaucauuucccaaagugcuguuggucuaauuucuuaugcuuucuuagaaaagauugccauuauuaucauuaccaaauaacacaguuugaagagcgagggacuagccaggcaugauggcaugaaccuguaauucuagcacuccagagguagaggcaggaaauagaagcuugcauuuagcuacacagugaguuuaaagauagccagagucauauaagaucuucucaaaauuaaacggaccaaacugacuuuggucacggguuagcaaacuuauuuuagguuuuagacuaugugguuuucaucguagcuguuucaacuagugucauacaaauguagccauagguauaauacacaaauucuaaguguaacucuauuuuaaaaauaccuuuauuuauggaaucugauauuuggguuugccauaacugccuugugccagauacaguauucuuuuguauuuuucagcuauuaaaaaaaaagaagaaagaagaucaaaccuauacauuaccuuuccucucuuguccuuuuccccuuccuccacagauacauacacagaaacuuacuuuucaaguuauaaaaaaaauaaauauuauaagaaaaaaauccagagucugaagagauggcucagaaguuaagagcacuggcuguucuuugagaugacccaguuugauucccagcacccacguggcaguuugaagcauuucauaacuccauuuccaaggaaauucagaguccucuucugacugagggcaccaggcauacacggugcacagacaaacaugcagccaauacccauccauaaaaacuaaugaagcgguaaagagucacuggggucaggaagauggcuuugugaguauacgaguguuugucuugaaugugacccucagaacccacaguggaaagaaaacuggugcauggaaguugucuuuugccuuucacacacugaaagaaagaucaguugucaucagaguuaaagcaacauaauucauuuuaaggaauauuuguguuuuuccaauuuuaauaucucugaaauugggaugucaguuuaauuggcaacacucuuccugaccaugucuguggcuuaccuggccagcaucuucgccuuuguuccucucagaucuuucucuauguuuaauuuacaucucuuccuuuaauccuguccuuugacauacccucauuauuuacacguuaccuugggauucaagacauuuuugaaucuuucccaaucuccagcauuaagauccugccaugucuccuggccuugcccuugugcuucgaugacauuaugucacauguucccaaguguacuggucaacauucuuugccuuugcucuggaaucucucccugacuugaaauguccucuggagauuuauugcaacauucuuccucuucugaucccaccaguuucuauccauugugagagucacuaccauucccuacugugguauauuuucuauucauuauuacaccauguuguaaauacauauuuaugucucuggccaguaagaugguuccgugcauaaagguacauugccaccaacaccagugagccgaguucuaucccugggauucacaagcugcaaggagagaacugaguccugcaaguuguuuuguaaucuccacaugccccucccauaaacaugcacacucuaaauaaaauguaauaaaucaaaaaagucuuucagauaaaauugugagucaccugaggguauuuaauaaguuuauuaaacuaaaggaacugugaagguuaauauugucuauugugguauaguuauggaagaaggagauaaguuugaaggaaguuuuaguaaggaaauagguaacagucuaauagaggggggaaacaccugucaccaaugaacgguaucagcaagcuauuuaaguucuugcagccugagacaugcagaauauuaaucugucuggaaaauuagcauuggaacauaauucuaucuuuguuucagaguuugaagaggagauacaagagaucugacaggagaaaaauaaauagauaagugaaaccccagagggugaggcaguaaugguagguaaacuugguuugagcuugaaaugugaucuggcaguccaagaaaagcuaguacuauucugagcagcuaacaaagaagaauugugucacagguuagggagccagcaggagcccacugggaauauuacauuuagcacugugucagcaugauagaggcagaaggugacggcucuaagagcagcugcagugcagaaggaaggggagguuagaaauugaagcacauaguguugacugaacuccugcuguucuuaagaugcaggagaggacacucccaaauaucuugaauguuaacaucagugcaggagaaacaguauuuagccaagacuuuguuguuguuguugauacagggucucacuaugcagauguggcuggccuagaacucacuaagguagaucauuguguucuugaacuuguagagaugccccugccucagccucccaagugaugggguuaaaggugugcaccaccguaccuggcuuauagaacuuuacaagaagaugaaacucagggcagguaaaugaaucuuucuccaaaagaaguacuccaugucauuguuguugauaauccugcugccuugccucuuuggacacuuuacagugugaacgcuguaaggcuuccuguuagaugaacuccuuucuccgcagaaaugguugagaaauauuuuggucucaugaacagaguuuuacuagaaaguaagcuauaacuguucaguuuaauauuuauaaauauuauauugagcaucauauacaacaaagcacaugguucuugagggucugaaauaaaaccacugguaagguaggucauuacaggcucuaugccuccccucgagauggaucucaaguuggguccgucauuggaccuccuuucccucagucucuucuccauuuuugucccugcaguucuuuaagacagcaacaauucugggucagaguuuuugacugugggauggcaaccccaucccuccacucggggcccuguuuuucuacuggagguggauucuacaaguaaggcccuuccuuuugaguccugagagucucucaccucccaggucucuacagauuacaacccccuguaacucuaauuccagggggaucugacaccuucuucuggccuccaaggguacugcaugcauaugguauacuuacaugcaggcaaaauauccauacacauaaaauaauaauaaauaaauaagauacagcaaugaaaaaugugauuauuaauucaaagauaaguucaggcaaauauccuuguauuuaaaaccaaagaaacccacaauauacuuuuuuuuuuuagauuuuauuuauuuauuaaauguaaguacacuguagcugucuucaaacacaccagaagagggcaucagaucuuguuacagauggcugugagccaccauguggaugcugggauuugaacucaggaccuuugaaagagcagucggugcucuuaaccacugagccaucucuccagccccuacacaauauacuuuuacaaagcaaaacaaaacaaaacaaaaugacaaaaacaacuccugcuuuuuuuuuuuucauuucuagacaccaugauuucuaaguaccuuguuuauaaggagcuauguugcagcucuaaagacagugucaggcauuaagaacauggugccugguuccauuugaacaggcaucugagucuuuucucauuguacuaaauuauauacccccaucaguguggauccuccaagugucaagugucaagacagacuguguugcaagaugaauugguuuagcaucuaagaacaauaagggucagccgggcgugguggcgcacgccuuuaaucccagcagucgggaggcagaggcaggcagauuucugaguucgaggucagccuggucuacagagugaguuccaggacagccagggcuacacagagaaacccugucucgaaaaccaaaccaaaccaaaacaaaacaaaacaaaacaaaacaaaacaaaacagaacaaaaaagaacaauaagggugaaagaagccagaaguagcagugugaguuuucagaaugugauguaaaccacuugccugugagauucuuaucucuuagagaggugagaguggauuggagauguucccacgagguucaguugagaaaaauuccagauaggcucacacagucgccaagcagagcuugccuguucuuuggaauccuguagagcagugguucucaauguuccuagugcugugacccacuuucucacuuaguggugauucuccaaccauaaaauuguuuuaauugcuacuucauaaaagugugauuuugcuauuguuauaaaucauaauguaaaugucuguguuuucugauggucuuagaauagcccugugaaaguguuguggguaaggaauacuaccccugccaaggcaugauuuauacagucuuaggugguuucuagaucagugguucucaaccuggggauugcagucuccucaggggccaaacaacccuuucacagggucaccuaagaguauugggaaacacggauauuuacauuaugauuuauaacagcagaauuauaguugugaaguagcagugaaaauaauguuaugguugagggucaccaccacaggaggaacuguaguaaagagucgcggcguuaggaagguuaagaaccaauguucuaguguacuuuuacagcagaguagaggagaaucucuuugcucaggacauuucaagacccuaaguuaauaaucaaucucucucucucucucucucucucucucucucucucccuguguguguguguguguguauggguguguguguguguguuugauagcuuuuccacauuaaguaaauguguaucacucauuggccauaacuacuguaguuugagaaaugacaggaaaauuaucauguguuucuuuuuucuucauauugaauaacguauuuuaaaaguaagaucaugaaaacguugaaaggagucaucaguaaugguauaaaauccagacuucauaacugaaucauaaaaguuaaccuccacauaggagaugagcaagagcggggaaaccccuucuugcacuuguuagaauccuauauuuaaaguuuuuaaaauuuuguuuuauggguaugaauguuuugccugcucucucauauauacauacacacacacacacauacacacacacacacacacugugugcauacccagugccuauggagguucccuugaguccggagccagcgugggaucugggaauugaacccaaguccucuggaagagcagccagugcucuuagccacggagccaucucuccagccucucaagacaugaauauuuuuaaaaucuauaacauccuacguagacaaaggaauauagagaugagcaguuuuuauucaugaugaugagaauauaaguugguacuuuucugguaugcacauuggcaauagagaauauuauuucuuuucucuuagaauucuacuucuuggaauuuaaagaaauaagccaaguacggugguacacacuugucuugccaauucauuuuguuuuguuuuauuuuacuuccucuugcauagcugugaccacaauacaaaagaggacaauuuaacgugaagaauuaauuauuuuggcucccugucugagauuucagcccauuggcucuguuucuggaucaguggcaaagccguucacugagaaugaggaacaggaagcagaaaagcuuaggaccacaagugagacacagcucaagaggccacccucccacugaccacuccuucaacuaaaucucccccauuuuaccauuucucaacaaugccaugauauucugaguuuaaugaagaguaauugaccaggucacuuuuuauggcuuagaaggcugugcuaacuugaaagccugaguuugaccucuggauuucagaggaagaagaaaaccaaaucuuaaaaguuguacucugaucuacacacacaaagcgacuacuauuaauaauaauuaaaguaaacaaaugauuggcccacagucaacuaaaaaaggaggaggaagagaagaucaggccccuuucuaaaaguucaucagcugacauccauaccugcaauaaaugagccggcuggggccauuucauacgcaagcuguaacauggaagcaagagacucacuagucgagucugggcuacacaagcugcuuuucucacacaaagauaaaaaggugcuaaggcuacagcuuaguugguagaauguguuguucaaaccccugcaccacguaagaccuggugugauugugcacuucuauaacauagcacuugggagaugggcuuaggaggaucagaaauuauaggucagccaucguuggcuacacagcaaguuugaagccagccugucucaagaaaugcuugccuuguauacagaaagcccuggguucuaucccuggcaccauauaagacaaucccagcacuggggagguggaggcaggagggucagaaguucaaggucaucccuggcuacaguaaauuagaagcuggcuugggcuacauaagaacuggucacaucaagaagaauagcaauaaaaauauuuagauuuaugacuguguauggugguauucaucuguaaucagaacuucugaggcuaagguaaaaggaucuugauuuugagaccagcuugugccguauagcaaguccaguccagccuuugagcuguguaguuagauucaaucaaaaucaagacuagaggcugaggaaauagcucacuuguuauuagcacgccuaaaguccugaguugauccugaauagguaaaagaaaggcuuaguguguucaauuacuauuuauaauauaaacuuagaaucagguuaauauaugacaguugagauuuuuuuagauaauagggcucuuuuauuuuaauuucuuauuuuuauguguaugaguauuuuuccuacacaugugccugugcauuuaggagacagaagcaggcagauuucugggaguucaaggaugcccugguuuacauuauaauuuugaggccagcuagaauuacaaagugagacccugucuccaaaaaacaaaagaaaaggaagagcuagcacucaaggcuuuguuuuuguuuuuacuguuaaguuaaucugugucucuuuucuucuuauacccucucugcaugugucauguuugugugcguguaugugugugugugugugucuguguguguauauguaugucuaugucuauuucaggagggcuauguguaugccuguguaucucucugugugucucuguguguauguguuucuguguaugggugucugugcuuguguguaucuguguauauaucuauguaucuauaugaguaugucuguguguuuaugugugugugccuauguauguguguguguaugugcuuaaagcuuuuuuuaaggauauucauuuuauaacaggaugguggugggcuuaaaauagccccccacauauuauguuucuaguuauguucuaaagacauacuucuuagcuuggguguauucacucuugaucccugaaacuuccucuuggcacuaguuuauaaaagccagaauguugaaauagcccuguuaguuugagaucugaaggugugaacucuuucagaaacauaauugaaaccauuacucaguucuguaauuugggaucacucagcaacaagcuacggaagugagaggugcaacagcacacagcagugccugguuccucucuuagcuuuguacuagaaaagucuucucuaucuagucuuuaucaaagucuugugugcuuauuuaaagucuuuucuccugaaugggaagaguuugaaccaauuauaagcaaauaacccuuuuugugccuuccuuuauguguauuucuguugccaugucaacaaaauauagcuaacauugaguaaaccagugggugcuuguaugcuaccucccuaggggaagguaaguguggagaaguagaaggggccaaauugagaacaaagaaugcuucuccccuuggcucuccauuagcuggcuguuucaguccucacacacacacacacacacacacacacacacacacacaaaacccguuucagcuguucagagauacagcuaauaugucuuauucuuuugcauguuagaaccuugucacuauuugggguaaaauaacuguuauaagcuaucuuucagaaccaggaaacccaaaaauaaauggugauacuuacgaaauuuauauuuugggggcucaaaggcuuacauugugcauauugguguugaaaguacuuccugagugacaaguaacugcuuagucaguaauuuacagucacaaccaacaaacaaugguggcagagaccuaaaacacauggcaugcuuuuagaacauauauuugguauaucaguggggugaauccuaaaggugaaaucauuaggucaaaaacuaccuaacguuuuaagauugcgagagugauacccaaacagcucuucacagugacugcaugugcaccaggaaugucagaaaaagaucuuucucuauacauaggaaggguccuuuaaaacagaauagauauuugaacaucuagcagccacuugagaaguagcggcaggaggaugcuugauccuucuuguaagcacaaaaaugaaaccccuaaacuuugcaucagguuugugguagaaagaacuggcaacaacccuugccuguuucuuuuaguggccucagguccugucugcacuucuucugugcagcuauucgaauccacaccaucagguaacugauuucacaauuuugucuuuuuagucucuuauuuucucacccccucuucuuuuuuuguuauuuuucuccuuaaaauugcuaaagcuuauccucccacacuucaaucauaauuuuuuguggaggguaaaagagagcugaguuuugaguucuuccauguuugaaaauacccauguucuuuucuuacacacuucuugcuauucggccuauguuaggaauuugcuaauugacuucuccaguguugcuuguuaagcuuggcuccuccaguuucuguugagcuccucugccaaccccuagugaacccuuaacauaacccaauuaacccuuggucauuggguuaauuuuuaauaaaauuuaaguguggcuugguaagaacuuucuuagauguuagcaggaaauuggaugaaaauuuccccucccauuucugagauauaguacaaacuagaugauuuuuuuucucaguugcuucaucacuuguaucuacuuucacuuccuuuguguggcgguucacaacauuuagccaagaaaaugauccagcaggugcuagcucacauagucaguuguuccagugggaagacaguucugcacacuuaauacuuuauacuguuacacuuccagauaguguagggaaggaaaccuucucugcccaucucagguucacucgcuuggccuguaacuuacagcaauagaagauauuaaugaaagagaagcaaacaaaagauuauuaacaagcagugggucuuuaauacgcacaugcuaugugcauuaagaggugacuaacugaacaggguaguuagaauucagacuuacagcacaguuuaacaccaaccaguauauuuguagccaagugacaagguaaaagaaaagccuuagagcuacaaggcuaaguggguacugugagaagacagauguggaaaccgcugguagaugagggcuagauagugugguuugcuuguguacccucuuuuguuagguccucgugucuacauugagauuguucucuccucauccuggcaagagaccgggauggggggcacuuuuuaaaagggacuuuauauuuuguucucagguaguggggaggaacauagaaaacucacccuauccugcuuuguucaguugcuuucagcuuaaaauaaggcuuugccagagauaaaauauaccaagaagguacauauucuuuuagcauagaauuugcuaaaagcagagccagguuugguggcucacgucuguauucccagcacuuaagaggcugugauaguuaaucaacuugauaggaucagcuagaacagugguuugcaaccuuccuuaugcuucaauccuuuaauauauccucaucuuguagugacccccaaccauaaaauuacuguuguuguuaacuucauaacuguaauucugcuauuguugugaauuggaauguaaauaucugauaugcaagacaucugauauguaacuccuauaaagggucauucaacucccaaagaggucacaacucacagguugaaaaucauugaccuagaagguaugucuguggugguucaucuaaauuaucuaagccccuggguaugcguguaagggauuacuuagguuagguuaacuaagaugggaagauuuaccuuaacucugaguagguggcacauaggcugugaaaugcacaauaguuucugcugcucucugcuuccugaaagagugugaccagcugccucaaguuccugcuacccugacuuuccuauaccauaaagccuauaccucuggacuuuccuauaccauaaagccuauaccccuggacuuuccuauaccauaaagacuauaccccugaacuuuccuauaccauaaagacuauacccugaacuuuccuauaccauaaagccuauacccugaacuuuccuauaccauaaagccuauaccccuggacuuuccuauaccauaaagccuauaccccuggacuuuccuauaccauaaagccuauaccccugaacuuuccuauaccauaaagacuauaccccuggacuuuccuauaccauaaagccuauaccccugaacuuuccuauaccauaaagccuauaccccugaacuuuccuauaccauaaagacuauacccugaacuuuccuauaccauaaagacuauacccugaacuuuccuauaccauaaagccuauaccccugaacuuuccuauaccauaaagacuauaccccugaacuuuccuauaccauaaagacuauaccccuggacuuuccuauaccauaaagacuauacccugaacuuuccuauaccauaaagacuauacccugaacuuuccuauacaauaaagaguauacccugaacuuuccuauaccauaaagacuauaccccuggacuuuccuauaccauaaagacuauaccccugaacugugaacgcaaguaaauccacccuuccuuaaguugcuuuuguugaguauuuuauuucagcaauaagagaaauaacugcuaaaaaggugaaggcgggaagauugcuguaaguuugaagcaugcuugggacaccuagugaaccccaggcuagcuugggcuagaguguggauacucuguagguuggagcaguaguuuuguuguaggagugagauagaaaugaagacuugaguauauucaagucauggauagccaugaaaauggcuguuuguccucaaagcuuucuuacaggauccuuacggauuucuagggugaaagcagcacacaguuauccugugaaauuuauuuuggguaagguaguguaaauaaaaagaaauauaaaaucucuuaugauuuuggaagucucccaauagauucuucaaguaacagauacuagcauaaaggagcauggccuguaagucacaaggcaguaauuccagcugucagagcuucauguaagagcaccaugcucuuaggcagcacaagagaaagaagguggaaaguaaguaggacacagaaaggcauuuuuauuucccacugaggaaauugugugcaaaagucuggagacaagagaaacugagcagugucugcaguccuagcuaguaccauuacuacccaccagcuggaugcagacugccagagauuaaaguugucuuagauuccugugcucuguucaauuuacucaaagguaaugucaaaagaaauggagcauguagggcuagagauguagcacaguaguagagcacuugccuauuacacgcagagcuccaggcugagccccagcacugcucccugcuccccucaaaaaagcagaacacguuuuugcagcuguacuuuuuuuuuuuuugguuuuuugagacaggguuuuucuguagcccuggauguccuagaacucacucuguagaccaggcuggccucgaacucagaaauccaccugccucugccucccaagugcugggauuaaaggcgugcgccaacuucccggcuuuuuuuuuuuuuuuuuaaugaaaauaaauacacuuuuaggagaagaaagugcagcacugacuccugucugaaacccaagugacuggaauaauagauuuaaaaacgagaaaccaaagaugaggcaguuugaagauuagugaggagacagauugguuccuucagaauaggaaugagcacaagggugcgagccuauaaucucagcauggggaaacucagggcaggacugucagaguuugaguguggcuucgguuaccaagugagagccugccucuaaaauaaauaaacauguuauagagacgggaaggguuggugagaauaccaacaugaaaacaaacuuaaugacuuaagaauaaggcuccugagaggagagagaugauaugauccacuggacguuuaugauauaccauaggaaugaugauacuaaaggggcuagagccugccugagcccauugugcagaaagcagacauuuggagcauccuccuucgcagggagaccuuaggguauaauucagaggauuaaaauguagagaaacauugauaauuaaauuuauuguauccuucuuucuguggguuugagaguguuacagugugucugugugccccgagggaccuaacaaagguuaguuaauuauaaucaacuguuagaacacacugcucugugcaaaggacuauucacgugauaccuauguuuguuguucauguggaagcauacacuuacuauuugacuucuuaagaaugaccuucaauuuuaaaggcuauuuauuauauauauuuaaaauauauagcucuauaaauugucucuuucccuacucacccucgcuccaacaguaaucuuuguugaucucuguauauauauuauacauuguauauuacauuguauacauguauauuauuaguuauauuuucacaauuuauagagacuacauauuuuaaaaccacuucauuuacaauuuuucuuaauugucuaaaaucuuguuacuguuccuuugaacucuggcuucauuucuuuuguauaggaauguauccaaauguuuugucuuuauaacugguuuucuguuuugcucuauuuacauuggauuaaaacacaacaauuccccccccccccuuuuuuuuuuccugagauaggguuuagcagugaguccuagcuugccuauaacucaccguguagccuggcugucccuaacuugggcucuugcuccuguaguaucucagccaaggacugggagagucaucacagccagcagccccggccagccucaccucuucucuguucucugcccuucuacucagauuccuccuucuguccuacuccccucccucccuuccuccuuuguugcaaguagucuaaacuagacuugaauuugcuaaguagcaaggaugaccuugaccuucugaucuuccugccuucccauccugaguagauuccacucucacagcgcuacaggucaucaagcccagagcacugugcgcaguaggcaagcacucuaucaauugagcucauuuagcccugcuucauuuauuaccaucaucaucaucaucguuguugucuuuauuguguuuguguucagugugcauguagagauaggacaacaacaugugugaagucuguucucuccuuguauuuuaaguauuuucuaggaauugaaugaagguugucacacuugaccaucucugucugcguggcuuuuaaugaaaaguuuuuguauuagaagaguugaaaaaaaugacaagagagccagagacgggaucaggauuucauggaaauaucagucauauuauugauguauuaaguguuuguuuucuuucuuaauuggcagguuccuacuauuuccugccaccagagggcacaaagguauugauugaguuuagugcucuguucauagugaauuccgacugacuuucauauuguuuucuuuuuuggccuguaucauauaauaaaaucuucauucagggauaacuuuguauuugagcauauauaucauuaagaaauuuugacauugaaggcuguacuguaccaaauuauaaagaagaaaaggaaggugaugacuuggagaaaugucagaggagugugcaguuucuaagcucauucucaugccauacuuggcacuaagccuaggggaacaggcugggcagguaugucagugucccaaaaagagagugcaggaguagacccacugcuguacaaugaauuguguuucacaaaggagucagaguuauucgaugggaaaaugauauuauucucagcaaaacaauuagauauauccacuuuggaggaaaggugaucuuugacugcuuugacuguuaucucauuucauaggaauuagccaaaaaaauagauuauagauuacaugggaaaagcaaagaaaaaaaaucuugauaaccuugguguagaugagaauuucuuagugcauauagaaacaaacaaacaaacaaaaaacugcgaaagugucuggggcaauggcucaguagguaaagugguuggaggaguuuggauuccuagaacccacaagguggggaggugggggagaguucucugaagcucauaguacagccaccugaaguacacaguggaaaacaacagaccuccacauguguggcaugcaccugcacuuagacacacacacacauguuuuugcaaugucgucucagcaguauagcccaagcuagucaagaacuccugaucuuucuuccuuaggcucccaagugccgcaauuagacacuuuggaaauucuauauacuaauccauuuugacuaccacagcucuuuucccuguggauuucaaacagguucugagaugguagagaaaucuuagacuguaaccaugcguguguaaaacugggaugaacaaguugguuauucuguggcugaugaaucccuucauuucuaauugcaugcagauuuuuuaaagauuaaaaaaaaacaaaauuucuggaaaugugugcuacaaaugcuugucacacaugauccaguggauaaaaggaccaccaagccugaauaucugagaucaaccccuggaauccacauggggaaaggagagaacugcugcaaguugucucugcccuccguccacgcccuggcaagcauguccuuccacagauacauauacacacaucauggcaggaguaugccucuucuuccauagacacacaaacaaggcaagacuggcuggauauauauaguacauaguacaaacaaaauagugugugucucauuauguagccauggcuguccuggagcucacuaugguagaccaagcuggccuugaacucacagugaccuacaugccccugccaucuaagugcuaagauuaaaggugugugccaccacaccugaucaaaaauucucuuaaaaaagaauguuauagcauuauaucauaguaacagauuguaaaagaugugaacaacugaagugucuauugcuuggugacugguuaaguaaauauuggcuauuucuauaaaauggagaaacaugcagauguuaaagacagagacucucuauagcuacugagaguagagcuauaugguaagacauugccauuuuguaggaaaagaaacaccagaccuguccacacaaaaaucucuuaugcaaagaagucucuaaaaaggcauacacaaacaggacuucccuccagagagaagagucagaugcagaaggaaaggguuagacacagguugacuauugcugucaucagauuucuaaggcagaucccuugacuccuacacagggaugacuagguagcucagugcuuaagaacacugcugcucuucuggagggcccagccccaugucaggcagaucaccgucuaauuccagcucugugaucuacugccucuugccuucucagacaucuguacucacaugcacauaucaugugcacacacacaccuacacauaguuaaagguaauccgucuucaaagguuacaacagauuaacuuaagcugcuaugcuguuuucuuccacugagaguguucugccauagguuguugguugcuuuucccuauaggcaggaaaagacugugauuccauugugcuccauguaccuuuuaucuugagguuccagguauuuucugauuaucucguguucaugacagguaacauaaucuaugggccucaguuucuuaucuguaaaaugaagugaaaaggaugaacuuugggcuuuuuccauuucuacaauuagagcugugguuauaaaccaagaaaaaccuuuaugcuuagaauaaccauuaggcaaagaccuaagucugaaccaaggaaugaaauugcagauuuuguguguagauaugugagagcacuugccaaccagccaacucugugcugaauagacaugaguucuuuuuaugcugggaaagaagucagguuacugaugacagggcuguacaagaugcuccagguggcucuuccgaggcagagguaacgugccaucaaacaaacaaacaaagccuuuugcucugcucuguuuugugaaaggaggaaauuagaucuaacccugugagugauauucuacacaacucagacuugcuuuaguaccuuuuuguuuaucuuaaguuugaauuaugaccuacuuuacuuuccucaacccaguuucucagaaucuaaucucuagcauuuuuaccuauuuuuaucuauugcuucaaaaugcaguagaggaugggauucuuggcagcagggaguucaggguuuaaaaggaguccacauguucagccaacaucugaggcuaggccaugucagauaacgaguacaaaggugccugaauuugggucucaaauuagcugugaucuugaguuaaucacuugacaugccuacuuguuuccuauacuggcuaguuuugugugucaacuugacacagcuggaguuaucacagaaaaagaagcuucaguuggggaaaugccuccacgagauccagcugcaaggcauuuucucaauuagugaucaaggggggaggucuccuuguggguggugccaucucugggcugguagucuugguucuauaagagagcaggcugagcaagccaggggaagcaagccaguaaagaacauuccuccauggauucugcaucagcuucuguuuuugaccugcuuguuccaguccugacuuccuuugguguggaaguguaagccgaaugaauaaacccuuuccucccuaacuugcuucuuggucaugauguuugugcaggaauagaaacccugacuaagacaaauugguaccaggagugggguauuccugugacaacuugaccauguuuuggggaggacugugaaaggacuuuggaacuuugggccagaagauccagucuguguuaagagcucugucggauguuguguaggagcuuggaagauaauguugagaacacugcagaagauggaagccuggcuugugaaauuucaagagggaagauuaaagacucuuuucagggccauugcuaauuugauugugaagauucugugguucugguuagcuggggcuaaagaguagcugugauuaacaagauaccagaacuacuaaagcaaaaacuuugcauuacugggacuauugaugcugguuagcuggagcuaagaaauuagugagcuuccaguucagugacccugucucaggucagucauguggagugcuauagaggaagguggucugccuccugcuguggccuuuacagucacaaguucagugagagacaccaucucaagggaaugagguggaaagcaauagaguagauguccuaauuucuacuuugucuucugcauuuccaugcauggaugcaagcaccugcauauaccaaguggggagggauaccacaugggggugggggggcaggggauggaggaagggaaccgagaaaggacagaaagaacagaacuaggaauggaagcaugucugcacuuagaaagcucaggcugcggacuccaggccaacuuggaacugcauagucauagagaaacuguagguuucauuguuauugucauuaugaaauuuguuucuuuggaguagauuuuucuaucagucagaaaauucacuguauguguuagucuacuuuuuuuuuuuuuuaagaauacuaguuuuguuuuguuuuuguuuuuguuuuuugagacaggaucucuguagcccugacugucuuggaacucacucuguaguccaggcuagccucaaacucagagauccacuugugucugccuccuaagugcuagaauuaaagucgugugcaaccacagcccagcaaaacaaaaaacaaaaaacaaaaaccuaaauaauaacuguaucuuuaaaaaugccaaaaauaauauacucuucuuauuuucggauauuauuaaguucuaaagcaguaacaauuuugaggaaaauauuacauuuauaaaaguuacaaacauuuaagucaacauauguacuaauuuuuuguguguccacuuagguugagaaaccauuggguugaaaagcaaguuacuaaguacagcuacagggauuguaguggguguggcugaagaugguaggagugcugcagaagugaugagagcauuuauacauuauaguaaugacauuaucaaauauuuuacagcuucuagaaagccccaucuguauuagugagagaaugaaaagggaaaaaaagacaaaugacauucuaguacuuugugaaaauguuuuggcuuugaaaagccccagaaauaaaggggaagguggaauggaaauccccuugcagugguagauuaugaguagguaggccauguacuuuacgaaugagcugacuuuucuggcauuucuguuugcagguggcagucaugcccacuuccuccaaagagcuuuuuguguuuuaguuaacaggccucacagugagucucuccuaguguggucuugugauuuccugguguguguguguguauauguaugugugugucugagggggaaucccaauaccuuucacaggguccacaacaucaguaauguggcuccuuuuccaucacauuggcauucgcagaagugucacaugagcaauggcagaucaaacuuuuagugcguuaguguaaaggcaaggcaauuuacaauugagaauuuguuuguuuguuuguuuuggugcuggagcgauggcucauccguuaagagcacauacugcucucucagaggacccuuucaguuccaugaugucucuggccuugaaggcacuuggauucacauuaacauaucacacacauaguacacaugcacaauuaaaaguaauaaagaugguaggagcacuguagacaugaugagaugaaaauauuuaaaaucuaagaaaauugaagacaauguuaccuaauuucuuuuagacugucucugaugaauuaaaaguauuaagcuuauuaaauaucaacucuggcucaaaggucuuuguuuuuuguuuuuguuuguuguuuuuuuaaauaggcucccacuguguagcccagguugguguuuugaacuggugauccuccugccucagcaucccaaguuaggugagguggaauuacaaagugaacuagauucucuuuuucuucuuucucccuucccccuuuaucucuuggaaauagaauaucaguuuuacuggaggaaguugagaagacagauccuggacaguugagcauugguggacauuuucuagagaaugaacaaaguaagccuguuaccucagugaugcugacugcaaguggucggggcagagggcaaaaaggaauccugaaagaaccugauuugcacaauaaaaguugaagcuuucaggugagaacuagaacauaaggacuuaaucugucagggccauccaucgucagguguuuccaguguagccucuucugagcucagagcucuugucccugccuauaaucugugucuguguaaaugcuucacagguacgggugugguggcgcaggccuguaauuccagcacuuaggaguguugccacuguucugaggggccagccuagucuccagggggcuguccagacuguccuacgcuauagagugagaccuugucucagaacucuagaaacuuuuaaaagcaaauguuguagagauauucuagaccuuacauguccacaguggaacuuuugauuucucuuaugaaauuuucuuuaccuaccaaaguuuuagucaguaaaucauccucggccuaauuguucaguguaaaaucaagucauucuuucauuucucaccucuuaugucuguaugcaagacugaugaguucuguccucugcaucacugcacaugugucugcuucccuccaucuucacugcugucagccugcuccagaugucaugucuuucacuugauguguugugucagcuucugucugagcuucccuacuugccugucucuaauccacauagcaggagauguuagguauaaauuguuccaugucacucccuugcuuaaaauucuauacuagcaccuguuaaauuuaguauuaaaccaaguuccuguaguccaggcuggcauggaauuaccuguguaccugagauuaccuugaacuucugacccuccuccugacccuccucuugaccucccuccuccuccuccuccuccuccuuccucccaagcgcuuggauuauagggccgagccccacaccacugugccuccuuuauguggugcugugacuccaacccagagccuccugcacuccagagaagcacucuaccaaccgaguuacagucaaaggugaaaauccacguucuuuaaaagaaaagauuuguuuuguguguuguaugugccuauaugugcacaugcauacauacuaaugcccucguuuggaggcuauaaacagaugucugucaccuggugcuggaguuacaagcaggugugagcugccuggugcaaggaaccucauucucccacugagucacuaaauccagccacccguccauaaacauguucuuucucacuucaggucuuugcaguuaguauugccuucguuucauagaauaaguggucucugguucuucugacgcugcugccuuuaaaaugcccucugggggcuggugagauggcucaguggguaagagcacccgacugcucuuccgaagguccaaaguucaaaucccagcaaccacaugguggcucacaaccacccguaaugagaucugaugcccucuucuggagugucuacuggaguacacuggacagcuacaguguacuuacauauaauaaauaaauaaaucuuuaaaaugcccucugugaugauucuugcuaaagugacuuuuagcauguuuguaauuuccuucauaguagccaccaugacuuuaauuuccaucuauuuuuauuacauuuauuauguauuuuugugggugccagguguguauguggguacccauacugugguagcaccaugugaugauuagaaaacaacgugaaagaauuaguuucuucucugccaucccucuacuggguauggaacacagguuggcaguaagcacucugagucacugagccauuuucccagccuuguuuaccuuuuuuaaacaaacaaacaaacaaacaaaaaaccuuugcuagaaaaaguaggcaauuagccauguuagaaugagaauaccuaccagggccgucacacacuaaagccauuuaguaggccaucagcugagacuaaagcacauagguuuuagauacaggguuuuggaaauuacuugcauaucacaaauaaaugaaaggcuggccauagugccacaugccuuuaacuccagcacucagaaggcaggagggucaguugaacaccauucuuggcaauauagcaaguuugacaucagucugaacuacagggcacgcugcccaaacaaacaagcaagcaagcaaaaagagaauaaagaaaaugaugaauuuggcaagaaaauguuuacuaugaagaagaaacagacuacaauagaaucuucaagagugaacuacaagaaaaaagccgcaaaggaaacuaacaagaaagggaucuuggagauaagaggaaagacacauacagaggcugaggaaaggauacugucagugcaaaauccaaacgugaacuaagcugagaaauacccuuagguuuaacaaggacuucgugaccacagcacaaacaguugcaguugauuggcagucaacugaagaccacuaggaaaggacauuguagaaagucaaaauguuggccaugaagcuagaugcagagagcagcagcugaaguggcugauagugaacuuauggugaggacaggagaccugaacauacucucugcuaaugagcagaagccacuagaaacugaaguuagauaaacaggacaggaguuuguugacaacagagaauagucuccaaaaagaugagagaaacuuugauccaagcauccuuacucuuucauugaaacagaagggaaaacuggaggugguaauauauaccugcaugggaggugguaauauauaccugaaugggagguggaagcagaggggucaaaacuuccaaaucaaucuuggccacaucgagaguucaagacuuguccaagauccauaauaaaugagauccuuuugccaaaggaagauaagaaaggaacaaaggagaggaagaauggguaugugugagccugugguuuuggguguaaagaaguugaaagaccaucuucuauguaacaguaugaaugagagacagaaaagucacaguaaggaaauacugauuaacuagguuauauugaucuaucugugugcuuggcuuauuuucaacaacugaauaccucaagcaaggguaguccuggggguuugaauguggauuuucauaagccuucacuguggguaacauuaagacuugcucuugcagcuagguauagaaauguuaacauugcuuuaagauuagaagauuucuuuuguuuugucaugcugggaagaaaacccagaugccucaugcaaacucuauuauuaagccacauccauaacucagggcagaugaguuuggcuagaacaucuuuauuguagaaaaauguucuuagaaacaaaauuuaaaugauuuauggaccucacgagagauacauguagccguuucaggcaagaaucagcuuauaaccuguaagucaguaaguuugucauugaaaucaucuaguguguggaaaguagcgucagccagugccucuguuuucaauccuacuucagcuucugucuuagugacuuuucggcugcugugaagaagcaucauggccaagguaacuuauagcagaaaggguuuacuguggcccacaguucagaaggauuagacuccaugaccauaaugacagggagaacagcagcaggcagguguagugcuggagcaucaacugagagcuuacaucugguccacaaacaugagucacacagagagagcuaacugggaauaaagagagcauuugaaaccuuggagugacacaucucuuucaagaagaucauauguccuaaucauugccaaacaguuccacugacugagaaccaaguauucaaauauaugagccugugaagaccauuuucauucagaccaacaugguuucuguuggugugauaaaacauacuaaaaccagcauggggaggguuuauuugguuuacagguugaucaucacugaggaaagccaaggcuacaaacucaaggcaggaaccuagagaagaacugaagcagagauguggaaguauaucuuguucucuuuacucauucaacuacuuuuuauagcucaaguccaucugccgaaagauggcacuggaggcauguccauaggccaagcuaauggauacaguuccucaauagaguugccauucucucaggauucuagauuguuucaaguugacagaaacuaagcagcacaauugaccucuuuuuagcuuaauacacaaacauaguacuauuuaaucauaaccuuuuuuuuuugucuccaagagcucauguuaauauaauauaaaacacagucuagcugguucagugguggcgcacgccuuuaaucccagaacuugggaggcagaggcaacuggguuccugaguugaggccagccuggucuacagagugaguuccaggacagccaggacugcacagagaaacccugucuuggaaaaaaaaaaacaaaaacaaaaacacagucuaauuugaaaaguccaacagucuuuaacauuuucaacaacuccaggaucuauuuaaaauccaacaucucagcuauaaaaucuaaaauaaguuacauacuuuugauuccaaagagaauagcagaaccagggcacacuuagaauaaaaaucaaagcaaaaccaacauccaagaguguaaacaaaauccucuaguucaccauuuggaacucacucacugucuucuggacuccagagagcuuaggcagcucugccauaugccauacacacuaguuuaucuguagacucaggcugguccugcugcaacuguccuugguaguuuccgguaugcuggggucuccacggcaacuaagauugcaccuuuaccaguggccuccuggccucucuucagggacuucaacuuggccacauaguuccaggccucaguuuccauccauaaccccucaauucugaggucuccgcugccauugggacugucucauguuccuuaacacaaaaaggccuauacuguguguuacccagaaaacauauugggccugggcaaaugucacaguggugaagaacacuugcuaaggacucggaugcagucucuaacacccauguggugguugacaaccaucuguaacuccaggggacucagugcuucuaaccuccacaggcaccaggcaugcacaguguguguguguguguguguguguguguguguguguguguguguguguguauugcaggcaaaaccacauauacauaaaauuaaaaaaucuaaagaccauuuucaaaagaaaacaugcuaguuauguauauagugcuauugagaauagguuugaacuuauaaugaauuuaauauauguuaaauaagaugccuuuaaacacuuuucagagcugugaauguguuaugugacaauccauaguuuagcauguccagugaccuugguucaaucucuaguacagaaacaaaggaaaguccccaguaaccagaagaacuccuaaaacaagguuaucuauuaguugaucacaugcaucuaucccuguauuucucguagaagcaguuuuucauuauugggaaguucuguguucaugcuagguuuuuuaaaaaguuuguuuuguuugggggggggguguuguuuguuuuucaagacaagaguuucucuguguagcucuagcuguccuggaacucuguaggccaggcugaccucgaaaucaaagauccaucugucuuccucucgagugcuggaaauaaaguuguguaccaccacugcacaugccagcuucauggaauguaacugccucaaacaacaagagucagugugcuuugcaauuuugucugcauggauuuuaaagcccccaacgcacauuauagcuuacuugaguacaaguuucagaaguuugcuucuagacaauaagugauuuuauuuaugaaaaaaauucccucaguuguuuuucugcagugcggggauuguaccuagggccuuacaugugccaggcaagaguucucuaccaucaagcugcaucccucaacccuuuagaucuucucuaagagucagcaauuuacuagccauaccaggugccacaugccuuuaauuccagcagaaacaggaggauuucugagaguuggaggccaaucuggucuacauagugaguuccaggacagccagagcuacauaauagagaaacccuaucucaaacaaaaaagggagucaacaauuuuuacuucuucuauuuuuguuucuuaaacagguaauugcuuauguuaggaugcagacauagccacuuucuaacgauggcuaugcuugguugacuugcuguggaacucuauggacuguguauauuugguuaugaagagagcugaaaaacuaaagaaguuuugcaaaguaauuggauucauuuuuugacaugagaguggcagguagagggaugacaguagugcuugucacagacaucaggacuguugauagagugugugggaacugaguaguacauuggaaguggccgucaugcucagucuuucuucccaugauuucucaugucugucguuucguuuucuuccggauaaucuggagaaccagacuggcugcuuuaagauugaccuuaaauuguucucauuucuggcugcugcacucucccuugaaaguaucacagcgccaucuucccugagaguguuuuuaucacaccauucugcagagauugcugcccuacuuagaaacuggcuuggcugcuccuuaccuaccuccaauuacuaucugccacuucucuuucauuaaaccagugucuuuaccuaccagcuuaguucucuuacaguccccucccuucacguugauguauugucucaugguucauaguguagaaggggagaccuauuuuagauguaauucuuucauccccuuaccaccacaaaguucucuauguuuacuccuguucuccuccuguuauaaauaaauauauugcaugcuaauauauaauuauaucuaauaauguaaauauauuauuggcauuauuuugucuacuacacauuuauuuuucucuuaauagaugagcaauguuguauauccuuaauguagaaaauuagaaaaugugccagcaauuuuggaaccauuaagucuuguuagucucauaaugcaaauagugguucucagcagcaccacuguacuccccaaggauacauuuguggauucaccgucugcagaccgaagauaguaaaauaaaaguugugucugaauaauuugacuuuaucucuuaucauuauuccucaaacaauacaguauaacugcuacauggcuuuuacuuuuuauuaauuauuaugaacuaccuagagauggauuauaagaagauguguguucuauauaaauacaagaccauuuacuuaucagauuuugaugggggaagggcauccuggagccagucuccacccccuacuguugagggaaaaacgcuacuuaauauauguugauuacaagggauuuccaaacacuuaagguuccccaaaguauuauuaaaaggcaaagacaaaacuggcuguaauguuauaugccuuuauccuagaaaucaggaggcugaauugccauacagccaguaccaggccauccaagacuauguaguuagaccugaucuaaauggaaaaaaaaaaaaaaaaagaaaaaaaaucacagacagguguuucaucucuaccuuaaaucagucagugcuguggggucuaaaggaaguuaguuguucauuucucagauacugacuucugggcuuacacaugugcauugucagcgagcagucuacuacaaagcuacacugcuacccuaaccuagauaacucugguauugaaaauguucuuaucuaugagugagauguagguguagugacuucuaaaauuuuaucaagcuacaaccuuuugauuuguuuuuuguuuuguuuuguuuuguuuugguauuugucacauaugguuucucuguguagcccuggcugucuuggacucaguuuguagaccaggcugaccuugaacuugugagaucugccugccucugccuccugagagcugagauuaaacgugugugccaguguacuuuuuauguagauaaauuauguuucuagaaaguuuauuuaaaaggaaagacuauaguaaaaacuaugcauuugacauuuaauaaccacacacuucaguauuuuuaccugccacuuucagugcccaaucccauaagaaugcugaauguaaauucuuucucauucuguuuuuuuuaggguuucagaaguuuuaagauaaaccuugacuuuucuuggaggcagguuugaggcggacugaacccugaccuaaguaugucugaauuugcuaugucaggagaauuguggguuuaaguccacacuccacucccagguuaaaagacguaacaggaagggaauacaguagcugggugcucaaguguacugcagucucuaacggcuuaauugcuuaucugagagaccugguuggauuaguaaguggcaggaggguacacagcugccucccuggucacagcuugguuaugccuguuucuguuugccuugucacuucuuccucacaccugucuccuuuccuucuccuucccucugaggucccuguccuagaaucaucuucucucagcagcuugcauucacuguuugucuuguaagcguuaaccaccugaaauacaggaauaagacgcuaaucucagggagagcuuaaacucuaguguggaaauaagcaaauaugaccaacugccauauccauauuaauguggacuaugacagggguuauuuaguaauuuguggacuugagucuauguuuaaccuuuuuauuuguguauguguaugguaugugagugcacacauauauaugcuugccauagcauguguggggaggucaaagaacaacuuuccaaacucaguucuugccuucuauguuuguuuugagacaagaauccucuugugucuugcugcuguacugcugcgaccaggcgagugagcuucgggcaugcuccuuuauaaugcuccuugggacuucguuuugaguaaaguaaggcaguuuuggagcauuauaaagaagaaagugauuugaugagauuuaaaauaaagaagguacugacagucguguauauguaagugaauucagcaucucugugggccuccacagguggaauaauagcaauaauaguaaaguucauaccgcccuaggagcauccagcuguccuugcucuuuugaguacuuuuuaccauuuuuauuuguuuuaauacaagguuucauauagccuagccauauucuccagcccugccuccugacugugggauuacugaugugggucacuacgucugguucugcuuuuuuguuuuguuuucauuuaucauuuuguuuguuuguuuggggugugugaguguguguguguguguuuguguguguguguaaaauaugugcagugguacuuguauggaggucagaggacagcuucccgggguggguccucuccuugcaccguuuggauauuuggauuacagacauugagcugagguugugaggcuuggcaggaagcucacuacccagugagucaucgccccugugcccuacucugcuguuuacuuauuaacuuacuugauccucucaaaacuucccuuuaacagaggaguaaauaggcacaaggagacuagguaauuguucaaguuacacagugaguggagaggcuuggccaggcagucuaaugcuacucugcuauaccugguuaaggccaguguagcuuccugguacuggguuuauguaaacaugcauauuaaucuuuauuuuaaaaauauaaggccuagaacaauggcucaacaguuaagagcacuuacuccuuuaaguacccagguuugguucccacuaccaagauggcagcuuacgccaucuauaauucuaguucuaggggaucugcugcccucccuggcuuccccgggcacuggacacauacagugcauguacauauauacaagcaaauacucacacacauaaaaccuuuuuaaaaaccaacguuauaagaauaguauuguuaucauguuuuaacagaugagguaacaaaggcuuuaaaaaguauuugguuugccugaugauagcccagaaaguguuggagcuaaccuaaagccuguuaaaucuucaccaguuucagaacaugaggaaacugagaggugagaguccucccaugagugaggaugggagacgggagggagggcucaaguccugcuaucauuggcauuucaagcuugaggaggcgugguagcauccuguucugacaagauguuugacacaaacagcuuauaaaggagaaggucauuuugugucaugguuucagauuuucauccauggucauaugagcacuuugcuggucaccacaaucuggucaccaagucuucgacacauccaaaccauaaccagguaugggacaucugaggccuaccaauucaaaccaaccucauaacuaaguagauugaucuuugaacccagguggcuaggaacuuuagccuuuaauaaccaauagcuucugugacuaaagaaucaugacugcauuuucuuauggccucagagacacuaaguggaucagaaauacugaauguugggcuugaauguuuggaucuuuucauaguccacuuuuccccucaguuugucaugagagucaucaggugauuugcccaagacauaggaagucacaggaacaaucuucgaggauuuucuaauucauugcccugugccuuguggcucuagguuccaaaugcuugaagcuuguacacauagugacuucucuaugugugugcuuucugacuuugaccuccagaaguccuaccuugaugccuuuuccacugugagcaugugcuugcucugacuuuggguuauuuggcauagccucagagguugugauuguucugugaagucaccacugguaggaacacagcuggcauacaggauguuuagcuguuuuuggaauuaaagcaagcuucuugaguugugauauagauggcuucuagaguuagucuaguuuguugagcuugcuagccccucaccuaaaugcuguuguaguauagucauguguggagucugcgucacuccugcucuggcugugaauggaucuuguaggauacauuauaacgaaggguaguuauugggaucaaguuucuaacauauaccugucucuuaugucuuccaaaguucaugucaguuaaugugcccuaaagucuaggcgaaauagcuguuguuuuuuuauuguagagacaguacagaaaggggaguaacacuguagcuuucaaaugaagucugcuuuaguuaaaccuacacuaagaaaacacaaguuauguuuagggugccaacaugauauauuuucuucaguguauugcuaauucuaguucccuucagagucauuugcuuccaugguuuaacaugaccauaaaggcagucgucccugucuauucagucauuaugugaggaauauaaacaagaguguuugguaauuaguggucauugacauguaauucuaaggguugggcuccccuucagcaguaacacagacuuuugaccuugcuuuguucuuaaaggcuccauuauugcuacagaucagaaugguuuauaauugauuuggaucaagcaauggagaguagaucauauauccuugcagauuuaauauaauuaaggauuaaaugccuucaaaaccacaccacgaaauaagucaguaauauuaauccuuauagauauaaaauaauguaccaaaucuuauaaaaugggcauaaacauuuuaaauauauugacuuuuauaaguuuucccuauaguguuauaagauacccauacagcgcacagaauuuuagaacuuacauuaucauuucuuaggcuucuccugcaagccaggcacuguagucaaaucaaaguugacuaagccccuaagaagccugcagucuaugaggagugagcccacgggugcaacaguugugaugaagauggcuaggcauggugcuguggccaaagagcaacauuaaacaaaagagaaacucuucauuuuaggggagguuucaugaggacacuuauuucagccaaauuuuggagaauuugaauaagugagggugaaggugguaaagguacuaaacacauuuugcuugaguagaggccugagguaggaaagggcguggcuaaugaggugucauuaaggccucaguauauguucucuucccaaagccucuaucaaacugggagauggcaguuuuauuucauuuuuagauuggaaagcuggugggauagugaggguaagucguggcagcaucucacucaagauugucugauuacaaaaccagccugcucauggcugccacccauguggucuucaccacaggagauagcagguaauacaacucacaggcucuaggccgcuagcuagucaguuauugauguucugccuucccuggcaucuuccagcuacucuuccuagguauuacaauccuucccuguguuccauacccaaaggauucauucuuuuaaacugugaagccuaagugggggaagccuguaaucauaauuauaguaugauuauuagcgucaaagaaaugaagcuugcaucagagauuagcauagugcugggcuggcaaggcagcucaccagcugaccucugaccuccacacacggacuuuggcaaauacuccccuacacacaucuuuuacacacauagcaauaaugaauguuuuuccuucaggugggaucucacuauguagccccagcuggcuuggaacucacucuguaaguagaccaagcuggccucacacucagagaucugccugccucugcuucccgagugcuaggaugauaagcaugugucaccaugacuagcauuaauuucuuacgagucccugguguuucaggucuauguuauugggcuuccuauggcagggacugaaccuacauacagccuugcacacaguggacaacugcuuuauuccuuggcaucucucagcccuuuugugguacucuuguuuucuugaaucuggccucauacucacuauguuacugagaauaaauaaccuucaacuccugaucgucuugccuucaucuccuaacacugggauuguaggaauguaccacuaggucuaacaucucucuggucuccuccuccuccuucuucuuccuccucuuccuuuucuuucuuucuuuuuuuuuuuuuaagauuuauuuauuauauguaaguacacuguagcugucuuuagacaacccaaaagagggcaucagaucucuucauaggugguugugagccaccaugugguugcugggauuugaacucaggaccuucggaagagcaguuggugcucuuaacucugagccaucucucuagcccuucucuuauuuuucaagacaggcucucacuguguagaccaagguggucuggaagucauagagaucugucugccuuuguuuccaugcccuauguucccagccucuuacuggauagauaacauccucucgaacuaagcagauagaucugcuuuguguauauagauagauagauagauagauagauagauagauagauauagauauagauauguauaucaaucacauuuuuucaaguuacguuuucuuuacaaauuucagaaaugugcagaaaagaggaagcuuauaugggggaacauaaugcagaaacaacugggauccuuucuaaucagaugguuuacauaggaaaggauacuguguuggcauccuguuucauccugaccccagacccaugagggaaaaucagcauuggacuuucucggcacuugucugagaccccugggucuccuguaugcccucacugggaccgggauuuggggaggugggggugugugggaagggcuggcgagcaguucugucuagccucugugaaacauuccagucagcauugugcuguuucuauaacaaaggccccuuagaccuucuugugccaucccucagggagccagcagagggagcuguggucccagaacuuuuuucagcauuacaaguuuuagcuuugggaagaaaaaaaccaaacaucuuuccugacuucaucugaacuccgaugcaauaagaauuuaacuugagauaggugguggugccagcccccuggugggagcagaccaggagcuucucuagcugcuugaacuugaaagccauaaagaacuccgauuucaaggaaacgccuguuuacuguacugauccaaaucagcagcucucaagaaaggggagugccuucuugaccucgaucuuuauugaucuugguaucagcacuugcagugacguguccugagggggcgggagaaaguuaacuagggccuuauacucagaagaaagccagccuguugcugaaggaagucugcacagaggcgauggucuagagugcccuauaggcacugcagugcagagcuuugcauccgcucugauuccgaguaguaggcagagguuuugaggcuggcugguaagagauucgccaggugguuggcucagaaucuugaucugaacaggaagcuucugugaaaagagauaagagcuucuuuuaaccccugacccccgagucacugggccugugguguucucuguggucuucagguaacccuggccuuugcagaccagcuuuccauuuugcuucaggacaucccuuagccaagccugcacuauggagaagugggacgguaaugagggcaccuccgcuuuccacaugccugaguggauggugaguucugcugcuuucuccuucugcugcuucugacaggacaaggaccacugcugggaucuaggcugggcaaacagccacuaucuucugauuaccuccugugcacugggucucuccugugugguaauugccagagagucuagggaaggggagguaaaagcagguaggccggagcagcggacugcccgguggugggugcugaccuacuaugcugauugauguacugagcagauggauuguucuuugauuguuuuguauucucuuuaaaguuaauguuaaguugugcuucguggguauaaaauaaaaaagaauauggguaaaggaagacacaaaacuagaacuuauaaaauguuacauucuccaguaucuagaaaaucuaaccauuucucccuucccugucuuuuuuagucagcuccuuguagcaaguguauugcuacaaggcaagaguuuuacuucucuucauacaguguucccagauaccauauuugccugauaaauaguuuuaguaaaauaauuuuaaguugauauuuguuaauaagaacuagcacauaaaaccaaccuugugaagcaugguggcacaggccugucaucccagcacuugcaggguagcagcggaaacucaggaguucaagcccagccuuagcgacauagugaguuugaagccagccuggacucuagcugguccuaucucaaaaacaaagaguggcaagucggcuguugauuuaaaaacucucuuaauuacauuuuguuaugaggggagguguucacugucacaacacacauuuguaagucagaggacaacuugcaggagucaguucucccuucugggaaauauaucuaguucggcugcagggguuucuguucgaugaucuaucaccagucccuuaacuguugauuugaaaaaacuccuuaguguccugacugguuucuuauaacuccuuggacuucuuggacccugucuauguauuucccuauuauaaacuuguuaaacuuuuauaaugcauucuaaauucucuuuaguuuauagaguuagggacuuaaagagauaacuauuaaaauaauaagauuaaguauauagcagauguaacaaaggcacaguagaaaauucuaccuguauauugugauugugaggcuagccugggcucuagcugguccuaucucagaacaaauggugacaauuugucauuuaaaaaagagauuugcuucuuucacaucugugugugugccugcuugucuguaugcucaccucagguuugcaggugccagcugauuccaggaaaggaugacagauccccaggaccuagagguauaggcuguugcgagcuaucuuaugugaaugcuggaaauugaacccagggccucugagagagcagcagguauucuuaaccacugagccauuucuccagccuauguaugucauuuuuauagaugcuauugguauuguuuuuaguaauuuuuaguauugcgcucauuuaaaagauaucugauggaaagcaguuguauucguaagacgauuucaaaugcagugacuuggacuaauggaaauuacucucuucauucucuggcuagguuuuuaacucguguuuugauuuuguucuuuguuuuugaaucuccagcaacuuaguaauaaccuaaagaguaggaaauuugguuuuguuauaggagggaccauagcgagacacuaaauuucguuucugaaaaggaguacuacaggagaacccuacuggacacagccauaccacuccagagcaaaacaaagguucucguaauuuacauuguguaaagagcaguccuccucguuguccccagauaacaugucugcucaaaaagagcuucucccgagacugcuccuuuugccucucugcuuauguggacagaaagcucuccuaagggacuuaggacuguuucuuaaggcaugugaccaagggcuuccuaguguauggagggcauuuuaaauauuuugauguaucucucucauuuggccuuuauuuaaaaaaacaaaacacacacacaaaaagacaggaaaaucucuuuaaucaguaggaaagaagugcagaccagaagagagaggcuuaucuucaguaaugccaugagcucaguuguucuuucuucgacuuuugaggcuuucuuucagauacugcccaagucauuagcuucugaucuggucugaaggugacacugauaacugcuuagccagcagcuagcccuaugcaccucuggugcauugccuauagauuuucagaucucaccugcaaacuguagaagugccuuuuaaucuccaauaaaaaacucuggagccagauccaacgugcagacaaaaugucaagaaauuuuuaacaaaugucugccuuacuuuucaguauguagauuaauguaaugaacucacuacugcaauggcucugcugcugaaggacacagaggccucucacaugcauuuucuggaggaacauagagcagaguuguacccugccacccaaugcccauuguuaguaaucaccagcaaagggucgugugugcccugagauugauggaggauucaggccauacucuuuccugauaugucuugggccuuuguaggacagucaggacagaguauggaaaccccaagcucaguaaaugacaagguagaccucauaggugacacuccaucagucacuggaaauuccugcugaaaccucugcuccucagcaguuuucacaugaaggaauuucuuaccuuuauccaggcaguuaagaugcuggguuauuggagggcucacucuggaaagauuuacuaccguauuuuauucucccugauaaacccucgggcccuccugucagguaaagcaucuuguucuggacccguguggacagcaguaagugcugcuggguuucacguuucaguguucuccuccugcacucucugcagugcuugguaguccuccauguggacucugguugcuuaaccuucuugaguacagagccagcuugcugcaguauucuuugggcaaaaguaauccuuuuuuuuuuuuuuuuuuuguagguaaagaguuauuuagacugcucauuugguuuggaaaucaaauacucuuuaggagaauuugaacuaucucugcuuggcaauaaaaccuaaacuuuaugcaucacuuuuaggcaucuguguauucuagguuaugaguuuuuaccuuaaaagaauagaaauauuaauauuuuagauuuguguaucauuauguagcccucaaaaccuucuuguacccuuuuuuuuauuagauauuuucuuuauuugcauuccaaauuccucuuguacccuuauuuuggcacauuuuuauguguuguggugcuguguguguagaugcuggaggacaacuuggcugugguuccucggcacugacuaccucuuuuuuagacagagacucacuggccuggaacucaccaaguaagugacccuggcuggccagcgagccccaagaaucugcuugucuuugccucucacgugcugggauuaaaaacuugggccaccaagauggcucucuuuacaugaauucuggagacugaauugaaaucaaacucaggcaagcauauuugccuauagugccagaggcucuaaguucagcucccagcaucacggcuuaaauaauaauaccaccaccuugcuuuuugugaaauuaagauaauaaugccgacuugguggauuauuguaccuggcccaggacgguggcucagcaaguaaggaugcuugcugucaagggugggccucagugugauccucagagcccacguaggaggagagaacuggcucccacacuguccucugaccaccuccccacccccacaugaaauauauguaguaaaacaucuuuuaaaagauacuugcauacacuaauagaaauaaccugugggcuugcaauacgcauuagcacaucaccucuucagagaaaucagggaacacuuucuuuucccuggaaagaaagacuagcuuugcaaaacaagcuauuauguuggccuuucuugcucucgacaagcaguuucuccuccccuuuccuguccucuccuccucuucccucccuucccucucuacuccucuccucuuuuuucuuucucuucucacugucaaaucauauccccacccaaaucuauagcaggcaccuaguguagcauuccuuggguuccuuucagaaaucagaaucgauaagagaguuuuacucuauuugguuaaaucuuuguuuggcauguaauaaggucacugugauucugggaccucagugauaaauucucccuugugaucacaccuuccaggaaacauuuuuuuuuuaauuguguagagaguuuguauguguguguguguguaugugcacaucaauguauugggugugcguacucaacauaugugcauauguacacccaccguguguauagaaggagaaguuagagaaggauauuggauagcuuuuauugcugucugccuguugcuuuaagacagggucuuucccugacccagaagcauggaagcucgccaucuccacuaggcuggccggccagugagcuccuaggagcugacuccacaccagagugccuggguaauagugcacccggccacgcccagcauuuuacuuugguacugagaauuccaccuuaucuccccccaccauacuucaaaacaaggacucuugaccguggagcccucucuccagccaaaacaugccuugccuugucucuucuucuuaaguaaaaagugaaugggaucacucaguacuaaauaagcuuccgucuugagauaaaacuagauacugaauguagaaaccagcauagaaaauaugcaaacucagucaugguggugcauuuggggaacuaaggcagccaggacagccugagcugcauugugagacucuguguauaaauaaauauacaaauaaauuuuaaggaaauaauugagaauaaaaaaaaaaaaagaaaguugauuuccuuggugauagagcuaaaucuaguguccccugccuggcuaacccaagggcagaguguagguagcauggggcuuccugaccacuugacaucauucauguuuuuucuuccucucuuuauaaauucccucauuguuucgguggcucuguaguuaauuuuuuucuaaugaggugagguuaacuaaaaucaucugacauagaaaaggaggagguaaaguuaaaagggaaccuaaugagcaaguuaauuauaucaggaaaaagugcacugguuauauaaaugagccauugauguaugcaugcauguuggaccuuaccuagggacuuguuaaggucaaaggagcuguguaauaauguguuaggaaaaaaauaauaaagcaaaccauccagggcuaggaauggccgcugagcugcuaacagagcugccucauuauuaaauccuguuggacggcugaaaggguuguuggagcugcuucagagauagccaccucccucaaaagggaaaaaaaaaaaaaaauagaagcaagcuggaaccagagccaacagaagugcugaugaggaaaguuuaaaagaccuaccacaaggguccuugggccaaagagguguccuauugccggcaaugucacugucugcuggcugguagcgucacuaugcugagcagcaagaagaaauacauugucaauagcaacucugggauuaaagcccaggugaggcuaagcuccuguuugccagucuuacugcggcggccauuaccacccaaggcaagcugcuuauucccucucuccccuccugucuagccuucauccuucccucuggcguguggugaguuacccauucuaccagccacuuucuucccuugccucgguguuagacagugcucaaguggaagaagaggggugccugcaagaucucugguuucuauaagguaggaaaguuagguaaaucuuggaagauccugccaagguaccgaaacucucagggcagaucauuguuuuacagaauugacugugagagagcaguguaaugguacugaugcagccaccagaggugccccacuuaaccacguuuguuaucggugaauaguaaacccuuguuauugagaaacugcauaacucacuauauuaagugguuucucauuaauacucuuguauauuaaaaagaugaagggggcuugaauuuagugagaacuugagagccauucucaguguacggucuguuuccuuagaaagagccgaagucggugccaggauuccaacagcugagacuauaggacaaggagcucaguuuaaugacacuaccuugugaugacagagcagcuggguuucugcaugacaguguuaggcuauguaggggcaacucagaggagugacuggcccccucuaguggucaguauguacaccuaccuaccugucugugugcacacacauguggcuguuaugccaguguguaugguuggcacagggaggugguguugcauaucugagguaagauuuaucuuuuaagccuuuuuaaaaaaggggugcucuacugaaaauguggcuuuauuguggucuuuagaaagauguucauuccuuuuccuugaugggccucugagaaagaaugaaggcauguaguuaucgugaaccacaucggugaccugaaugucggcauuugcacuugaguuccgugcaccuuccaccuuucucuugccuguuuuaucaacccuuaaaaauuacuuugugcagacuuaaugcuuacuacgcuuauuaauauucccucaaauacaggcgaugaagauagaguaaacucuuccaggguccuugauucagcacaugauugggugcauaggauacggcagguaccuaucuaugccggagaauuuaaggguuaauuacaaaucagaccauauggagccuauaauucauauagagaguacaggaaggaagacauuaugucaaaugcugugcuggaaguacagaaagauucaugggccuccuguuggaguacauaggaaaggcacuuuauccuuuuuggaguaaauugauaccuuagcaaaacaaucagauugcagugagcuccuaauccaaugaauaguccuguuacuaaaagcaguuugugaacugaagcgcugugcaggcucguuguuguuguuguuguuguuguuguuguuguuguugcucuuacggcuguggaaaugcucuggauucccugagaccugagugcuaagcuuucacuuuggcauuauuaguccccuugucucagugcucagugacucaagaguuaccucucagugcaggaaguguagcugcugauuucauucugacuuaugccaauggaggagccauuuguuuaucauuaaagguagaauccguugucagaucuuuaguucuuuucuguaacguuuugucuauaccacucaucaucucagcaacuguguaaauguuugguuaggagaaacuuauuaauaaaauaaguguuaggaguuuuggucaguaaagcaccagcagcagccuucagcuguaggagacagagguaaaauuagcaagaaagccacuauuaccagguacuucaaccauaacugcagaguguguuuugaguaugcaaucaguccagucguuuacuccuucugcaucaucuguagucauggcuaauaaucaagcauuuggcuuuuaaaaguguuuuaugauguuaaacauuaaaaauuaguuugucuacuaguaucuaaaaggcuaacacauuuaagaaaaucuuaagcaaauuaaaaugguuaccugcuguaggugggaggauuuacucucucuaaaagcugugauugaagaguuuuuauuucuguuguuauuaugggaaaauuagauucacaaaaucaucuugaucagaaucacaaagucuaugaauggcauagccaagguuucagugcaauguucugucugaauggaaaccuuccucagaacucgcacgcacgcugaggagcucacagcuccgggcagggucuuucguacucugcuguuuucucaucuagaccuauguacagagaauugcaaagauuucuuuuuccagcuugaauuuucagugaaaugauagaaaguguuucugaauaugacuuaccuuucuaaaaauuuaauuuaaucauaauacuccucucugugucacaguuauaauguacaaaguauauaguccuugauaaaggucaaaaaauuauucuuuccaaaaagaauucuuuuuuuaauguuuguuuguuuguuuguuuguugcuuuuggagaaaaggguuuuucacuuugcauccaaggagagcuuuaaacucauuuuguucuucuucauuggccuccugagagcugggauuacagggaucuaucaccaugcucagucccaaggguguguccccucccccccaugccaaggaagcacuguacugaggggaaggagaggacagggucucagcuuaaacucucucaguacuugaacaugacuuugaaguucagagucuccugccucuaccuccagaguacugcaccaccauuccagucuaugcagugcuagggacuauaccaaggguuuagugcacgcaaggaaagcaugcugccuccugagccacaucccugaccccaaagagucguccuguucaaauauggguuuguuccagcaaauaaacugccugggaaggugacagucuguaauaaugcgugcuguaaauggauugcuuucucaaaauacagguguguuuucuucauagaagguguugguuugaaugagaauagcccugaaaggcuuagucaacagggaguggcacuauuugagaaggacuaggagguguggccuugcuggaggaagugugucacugugggugaacuuugagguuucaaaaacccaugccaugcccaguugucucuuuuuuuaggccuaugaauccagauguagcccucaguaugauaaugaacuaaaccucuguaacugaaagcaagccccuaauuaaacacuuuauuuuauaagaguugccuuggccauggcgucucuucauagcaacagagcaguaacuaagauacauaacuagaguucuuuuucuuucuauaaugaagguucuuuuucuuagcagauucaguuugcugaccagaagcaggaauucaacaaacgucccaccaaaaucggacgucgcucuuugucucguuccaucucucagucaucuacugacagcuauagcucaggugagugcuaagcuucuauagacccaccugucagaguucauugguaucugcaacagaccuuccaucuacccaagaccaucauucuugauaaauagccuugaaaaaagauacuuugaauuaaaauuuaaaccaaaauucuggauagaauaucuggauuucuugggaccucagaguagaguuuuauugaggccgcagugucugacagaggcagaauaaacaggaugaggaaggaaauugagcucuuugauuuacucaggagcauguaguucaccaguagccuccacucaaugacaaguaaaaagacauucauuucccccauuguuuaagggucaugucccucuaggugguacuuacaaaguaaguaccaggacuagggacccaucccagggcuuugugcgugcuaagaaucaguccauacuucagcuauacauucaguuucuuuugcagugaaaggugggaacagggucucagcuccccuauguaguacagguuccuauguaguuaaagaugauuuugaaguucuaaaucucuuaauuaccccaagaaauaagaugcuguagcuauuugaaauaagugggugcuuugccuucuccucaaagcagugacauugcauugcuuauuacuccuuccuaccuuuaacucacuuuauuuacuaacuuuauuuacucacuuccuuuaacuuuauuagugcugaguuaucacuuaaugucacaugaguuguugcauuguaggcccccagagggacacagcagugcccaguaggagucuaaacuaaagucaggguauuuuacuuuguucuuccguuagaaggugguagggagcccuuaauguuacuucuuaacauugaacuaguaauaguaauacucaggagaaaacuuuuguuuguuuuuuauuuuuucuuguucuuccagacaguguuucucuguguaacccuggcuguccuggacucacucuguagaccaggcuggccuugaacuccuagagauuugccuaucucugccuuccaagugcugggauuaaagaugugcaccaccacaaccugcuagaaaacuuuuaucaugacuaaaauuguauuuguuuuucacacaacuaagaaggaauucuuauuagguagaguugguugggaagcauagcuuuucagcuggguaaguuguuauuacacauuauuuacauuucuggguuuauuuuccauccauaaugauuggaaaugaggaacacuguguaguauuaaccucuaugauuuuugucuaaagauccccaucuuuaaugagauugagucucauuuuauucuacuaaaguaacuguuggaaauucaugaacugguugauuuaacucuggaagccauaaugugaaaaugaauugucaaauagucuagaacauuuuaagauauguguuugucaugucauuuuaagaucaguacuaaauaauaaugauuuuaaauuuuaacucaagcccaaucuuuucucugcacagccagagccauauacaucugugcucuugaaaccaaugccuaacuuccuacccaagcaccucauaggcaggauacuuuacaaauacuguauaccuggaagaaugagugguuuccacguaagccuguagugcuuguauauagcucauugauuaauaauauuaacuggucucauccugauaaguuugaaccuuguacauugaacuauaugaaaucgccaucugugcuagcuaaauuuaugucagcuugacacaggcuagaaucaucaaaggagggaaccacaguugggaaaaugucuucauaagaucagacuguaggcaagucuguaggacauuuuuuuaaauuaaugauugaugugagaagacccagcccauuguggguggggccaucccugagcugguuguccugaguaucuaagaaagaaaacugagcaaagccauagcagugcccuuuuauggcuucuauaucuccccuuggcuccagguuccugcugugauugacuuccuuuggugauaaaauagugauuuagaaauguaagccaaauaaacucuuuccucgccaguuugcuuuuagucaaauguuucaucucagcaauagugauccuaagacaccaucuuuauuuuuuaaaauuaucauacguguuuguuuuaugccccuauacaugcagguacaaauacaaguuuguauuccaugaucaugagagccuugcuugucucuaccucaggugugucuguaucacaggugugugucuuaacacgucaaacaguauuugggucauaguaggugcuaauauuuacuguaagguugaggaaaacuggagaaagagagaugacuuuugcaaccugaccuacauuuacccuaaccgucaaucuacaaugagaauguuguacaaggagagggucuccuucagaacuagugucugcacagcaggcuuaugcuggggaaacaaagucgucagccuacuguauccacugauggauaguaaaaucaggagcuggaaaucacaacgcuugguuuuggagcaaaaaguagagauaugugguggaugcuggaauugucaucuguguggcaaauguccaucuggccucauagagaacauuuaaaugacagggucaccuggcuuaucuaguuauuuauuuccccaucagcuuaagcccuuacauaaucucuaggacuuaaauguuuuacuuagaaauaaaacucaccauuuuuagucccuaucuuuuuaggauaaucuacuaaccuggguaugcucauuuggauacauucuggauuauguuuucaaaaauagugucuauacauguaguauucacaauauuuucugaccuaaucucuaggaagcauuauuuccaugaacucaguacuuuucauuuauuuauuguuaacauuuuugaggcaauaucucuacaugccuugcugucuuacuuaguauacaaggcucugcccaucucugccuccuggcaacacuuuuaaaauauaaaacucuucucuuaagcaacaaaacucauaaaagcaaaugaacaaaauaacuucuucuucauguuuagaccagaaucagcauuaccauuuaugcaaguguuauccuuacagugagugaaucaguuacagaugagaaaggaugaaguacuuuacuuuuaacuagcauuuagacauuuugagauacuuuuagauuuuuuuuuucaaauuguguuuguuugcauugggcagcuaucauaacuucucucauacuucugaagucauucauuaguacaauccauucacagucaaacaugggucccgacuguuauuuccacuaacaaauaaauagauugggcccaaggggagccaucugacuuuaauuaauuuaauaggacuaauucaaucagaauucgggcugcuugcuuccuaacaagucucacaggugccgggagagaacaggaaaucaggugcaguguacacgcaugcgugauccugugcauguaugcauguauugcaugugugccuguguugcauguaugcagugagaugagcuguggauuaguaauucaucaaguuaugccuugguucuugaaaguuaaaggagaacaucccauaguaaaacgguauuguacuuuguagguaaucuuuucugccuaaagacggaaacauuuuagauauuaucucauuuccuuguacaauuuuuuauuagugguaguuuagagaaagggugagccuguggaggaagggaucuauuaugcucccuguuuuauauuaggguaauugaaaauuggacauucaguaaccugggaaugaagcuagauccucuaguaggugguggauuucuuccuuuuugaaaggcagcugugcucagcacuguaccacuaacacugcaccacugcucgcuguuagugacugagcugcagaguauacugauaauuacagauauuuuuagaagcuucagaaugccguagcaggcaaauucaaggccagucugugccacuuagagaguuccaggucaaucuggacagcauagcaugaauuauuuaaaaaaaguaaagguggcagaaauaaguguguucaaaacuaaauagaugcuuaccauauuaguugaauaaaguuucuaccaugcucacagaaacccuucucucggucugggcccgacacuugugcagccaugaauuacaacaguguagucgcugccuuuuguacuugccaaugcuagcucuggaaagaagacuggggaaaaaaaaaaaaaaaaccuuuggggaacaaaagcauuccugacugcuauuaagaagauaaagcccagugcacaugguggcacacaugccacgagcaccugaagcagaggcaggcaaaccuuugugagcuugaggucaagguaaucuacauagcaaguucuaagauagcuagggcuacauagugagacuccguuuaaaaagaaaguagggcuggugagauggcucaguggguaagagcacccgacugcucuuccgaaggucaggaguucaaaucccagcaaccacaugguggcucacaaccauccauaacaagaucugacucccucuucuggagugucugaggacagcuacaguguacuuacauauaauaaauaaauaaauauuaaaaaaaaagaaaguaaaauauuaguuuucucagcuuuaaaauaaggaaaugauguaaccauuuuauuuuuucauuuggaaacaaaaggccaaccacagaaauugaagcuaagguguugagauacuuacucaucuuuaaucccagcacuugggagacagaggcaggaaagucucucuuacuuuaagaccagccugguguacauagcuaguuccaggacagccagggcugcaugcggagcuccugucugaaaaacaaacaaagcagaacuaaacaaggaacaguuaaaauuggggugcuucucuuaaaggagcauugcuuuguuuuguuucgguuugcuuuccucccacuccugacuccuccuucagagcugagaagguuuaggaagggggacuauucuggguuagaggaggggcuccagucucagccucucuagucacuacagcaaacccaagaccugggacuaaagguguucuugcugaucaguguuuacuacuaaaggcacaaaagccaucaugguucuggagaaaagauuugaaacuuugaauuauucugagcuuaaacucuuuuuuucaaauucaauuucuacauaaauuuggaucaggauuggggaggcuguugucauuuuucucucaugguuccuaagccugugauuccuaaacucuaucauaguccagaaaacuauuucuagcucuguugccaaaaguacuuugagcucucuuacccuaggagaggaaccaaaaaguuuuuguacagauuaguucuuuauaagaacaaaaguccuuuggggauuuacuaauuccuucgccucccuuugugcacacaaucauuccugugcccucauguuaggacuuugcucuaaggcaauuuuccagagccaggagagaucuucaagccccugcugaccccacaguaugcagcacugugccugauuaacugggcaaggucggacuugccuuuuacagucugcccuccaaccccuacucagccccucugcuaagaaaucccagaaaugcuuuaaugcucuagauguaaguagaucagggcacuuggcccucaggaacucugagcuuuugcaauuuucucccccuagaacuaauggcagugcuaacugcacugagagauguaugcuauaggccauguuuuauguccucuauucuccccaaacugccaggauuagaaagaacuacccucuuguacaaagaucaagaaagaaauagcuucagauuaucuaguaaaugauuagcaaauaugaagacgaaaaagaucucgacuaaggcugugaauucagugucaguaacugucuguuggccacaaucaaguguggcccuuucacccuccacugcagugguucucaaccugugggucgagacccauuugggggucaaacaacucuuacaagagcucaccugagaaccaucagaaagaucagauucauaauaguuucaaaaugacaauugugaaguagugaaagacccacaacgugaggacucccccacguucugacucaggagaggcgacaccccaaaaccaccaacgagaaacagacuugcugcaaauugcaagaggauuuuuauucaagagcgcucucgggcccacggucauacaccacgcagggauagaggaccguggcgcccugaguagcugaguaaagggguauuuaaaggaaaaaaccacaacucaaggaggugggaaggguguuguuggaaaauaccaaaaauaccaguuaagagucacaaggaaguacaaagucacaggugucacaaggaauaccugguaauuguuaacucucaagacaguuucuaagagccccuaacaauagcacauuugcauugcagguuccaguaacggucagggugccauucuuugaauugaacccaggaaggggguggguggaggaaugucgcuaucuguuuuaugauuagcauaccuuggagcacugaguuuacuacucuuucaguagcaaugaaaauaauguuaugguugggguucucacagcaugaggcacuguauuaaagggcugcagcauuaggaagggugaaagccacugcucuaguauauauugcuaguugauuacucagcaaagcauugaauguaccaaaagcuaguauuuugcugcuuugggaaucugaaacaccaaggaccccuucuuaaggaggccaguaaggaggauagcacauugaauaguucguugucagggucuaauugggucugcaagaauaguucugucucagcagagccaguccgaagaagcacagcucuguuaugucagacaaacuccuuuuguguaguucuuaauuacuuucccaugaguuucuuguuuuuuagguuuuaucuguucaguuaguguacuacaaagcaaauuacuucaggcauuuaagcaacaggugggggaaggggaggggaagcgggggugggggguggguggagaggguaaauaacuggcuugcuuaggaacuuuaacuguggcuuuccuggguucagcuuuccucucugcacauucaagcauuauaucucucuguguucaaaaggaaaaguuaguccuagauuccuaaugaaugcuacagagagagaaagccuuuugcaggucucuggcuuguccuuucuggacuguggggaguaccuugcauaagcagcuccauguuucauuaaggagcuuccuagagguguuaauucggaugaugcuaaugacuagugaagccccacugguuuuccauuguggaagaagccagucuuuuucugauugauuuuuucauuuguguuccagcugccucauauacagauagcucugacgaugagacaucccccagggacaagcagcaaaagaacucuaagggaaguagcgacuucugugucaagaacaucaaacaagcggaguuuggacgcagagaaauugaaauugcugagcaagguaaagaaauaaugccuuuuugccugccugugucauuuugucauguuaauacuccugggucaucuggcuugucaaauuucagugcaauacuaaaucacauuuuuguuuauuaaauugucugagauugguguuguucuggaaccuaggcugaccuugcacucgagauaauucucuugucucagccucccaaauucugggauuauaggugugaguuugcauguccaucccugagcuugggaaacacuuuggggagggagugaaguccagugguucuggaggaaaccccuggcuaagaauuggcacauagaagauaagacuggggagcauuugucucugaaggccucucagagaacauucgggaacaccaucuaacagaagcugaccaagagaacuugaaugaauauuuuuuauguuuuuucuuucaucuuuuauucccucuguuuaauauucuauguuuguauuggacuuuuucagagaugccugccuugauggcuuuaaggaagagagcccaaggagaaaagccuuuggcuggagccaaaauuguggguuguacgcacaucacugcucagacagccgugagugcuuuucuuaauaacaguaauaaucgcaccaguuauugaaugccagcaacugccagcaccaagcuaacaacauuauuucauuaauccacaaaaugcuauguaggcagguauuccuuuuuccauuuuguaaacaaggaaaccgaggcccgaaugcucgaguaaucugucagaguuguacagccaggagggcacaggcuaagcuugaucaugaguguauaggugaacccaugaaugcuuucuccugucuccuacuucuccaucagccugcccagaguccucucucugagacuguauacaugagagcauucagcagcaagugagagaaaacugauucgaccugaccucagccuauaggaacuuacuacauuguguuuccagaaguccguguguggaaggcaggcuguggcugggguggaggagucuguuuuacugcuugaugauuuuuuucagaacugucuccacauuuuaucacuccauacaaacugacuaagugcuuacagcuacauagucaccaaggacacuauggaaggacugcuucuucugcucuccuaagagccagaaaccuucgcugagguccugcaggacaguccagcaugccaugagcaggacugguuacaugccccugcuggacuaguucuaagaagggacuaaacuccccaugacugccuuagaccagagauugcuccacucaguggaguuagcuccuauuuauaagcaagguacuuucaaugccccugaauuauucugagguagaacuuagauacaccauaaucuauauguuauaugaaauuuaaaauuuuuaauauaaaaucaaaacuauaauagggagaaauaaaaaguaauuuauaauaaaaauauauuucaauauauaaacgcuuaagcaacacuauaauagucugauaucuguacuaacuaauauagauggaaauguaggggauugucuuaugugaaugaguguuuugcuugugaguauguagguguucaugugcuauagagccugcagaggccagaagagagcacuggacacucuagaaauggcauuauagacuguggugcugagaaccaaacucugcucucaacuguugagccaucucuccagauccuguuuuuugcucguuucuuuuuguuuguuuguuuguuuuuguuuuuugagauaggguuucucugugcagcccuggcuguccuggaacucacucuguagaccaggcuggccucgaacucagaaauccgccuacuucugccucccaagugcugggauuaaaggcaugugccaccacgcccggcuugcucauuuucuugugugugacgguaucucauguagccucuacugguuucuaacuugcuauuuuagcuaaagcuagcuugaauguuuaauccuucugucuccugaguacuguaauuauagacaugcaccaccaugccugacauuauguccagaauauuaaaacaacauuuucauugauuuuaugaaaggaaaagcaacucuuuccaacuccugacaaccacagugaaaagucagcauucucuauucacugauacaauuguugcauuccuagaaggacuguuacugaaacuauaaaaaauacuucugucaguacugauagucucuaagaccaaauaauuuuaaguuaggauuuucacccaugugaacuuucauuaggacaaaugaaguuuauuccagaucagcaguuuuuucuuguaaguggauauccuaaucuucauuguuucagaucccuggccuuucuucccccgacaaucacuguggcaaacuaaguaguccuauaguacucuacaucucuucuuuugaguugucauccaaaauguaguagguuuggaguuccaaauacauugagauccaaaggaaaagugguguauugaaaacauucuagcacuuuuuaugggacuuguaagauuuaagucaucuuccuucuccccgucucuuucuucuaagacagggucucauguagcccagaugggccucaaaacugcuggguagcugaggcuggucuugaacucaugaucuccugucucaaucucccagaugcuagaauuauggguauuaugggugguauaugccaccaugcaaaaacuagcuagugugcaugugcucgcucugucuuuguucugugcgcucucucucucuguguguguguguguguguguguguguguguguguguguguuuguagaggccagagguggggaucuucagucacuaucaucuuauuuuuugagaaggguuucucaccaggcagugguggcacacaccuuuaaucccaccacuugggaggcaaaggcaggugaauuucugagauugaggccagccugguguacagagugaguuccaggacagccaaggcuacacagagaaacccugucucaaaacaaaacaaaacaaaaaacaaacaaacaaaacagagaaagagagagagagagaucucauugaaccugcagcuuacugauuggcuggaguggcuggccagaaagccucagagauacacuugucccugcuccccuaucagcaggcucacagaggcacuccauggcacccagcuuguacauggggguuggugaucagaaugcaggccuccaugcuugcacaacaagcacuuuacccagugaaccagccuuuucaagcugacauugcuacguagcagaugaaguugguauuggucaaacaccugaucuuccugccucuuuccugaguguugggauuucagaaacguguaccagacccaguuaguuaguuaaguuguuuguuuuucagugcaggagacugaacccagggccuuacacagacuggacaggcauuccuaucacugagcuuuauccccggcacgucagucaacuuggaagagacugucccucagcacucacucacauggucacauuguuaaugaagggcagacagagauuccauggagacagauagcaucugaauucccucugagacugcugaguuaaauggcucugaggaaaaggauacccugaauuccuaaaauuaacacaauaaauuaaaauuuaauuucuuuuuggagcuacagauuaaugaauugaggcaaagcaugcuuaaaaucuuuccuacgcuucucacaugagaauucagugugauagcuuaaaauaggaaguccucuacguacuggaucauguugcuaaguuauaucuaguuuguuuuuaucucagacuauuuuccugaaugaaugaauuauuauuaauuuaccaauuuaauaucauuuuauuauuucuauccuaauuuuuuuuaaucucuguaauuuuucuaacuauguuugcauuaauuauauaauaaucuaauauuaccucuauauaauauagaaauauaaaggcugagggcuagagauguagcuuaguuaacugagugcuugccuagcaccacaaagccgugaguuugauccccaccaccauuaaacccaacaugguggugcguuccuguggucccagcucuagaaaggcuggcaagaauauuacaaguucggggucauucuccacuaccuagugaacuagcuugugcccagccugggcuauuggguuacauaagacccagccccucccaaaagaaacaaggaggaaaaagggaggagucuccuauguccccucuaguauguaguuaaucauuucuuaguugggucuucuaaccuaauuucauugcuguugcuacuaaauuauaauaaauuuaagucaaggaacuggagagacaaggcucagcaguuaagagugcuugcuacucuugcagaagaccagaguuuguuuuucagcacaugcuggagggcucacaauggccuauaacuccaguuucaggguauccaaaacccucuucaggcuuagcagccaaggaauuuaccuuuugagccaucuuggugguaccuuguuuuuaauuuuucuagauggucucacuauguauguaacccaaaguagcuuggaauugucuguguaucccaagcuauccuuaaacuaaacuucuuccugccuccugagagcaagauuauaaguauacgcgacaccacacuugaacauuuuugaaugcagguucuuagucucauuaaggucgaaaguuauacuugaguuaacgacauuccuucagcauuuuuuccgugcccaacccauuguuuccuguucuuacuuaaugaguuauaaucuacuauuuucaauauuuuaaugcuuauuuuauccucaguuuguccaaaagaugccccaaaugugguuucuauggcuuauuuuuaaaaauuguuucuuucucucuuucucuccuugcccccauguauguggggcagggagaggguuucuguuuguguucauauauguguguaugcauguggaggcuagaagucaaccucaguugucucccucagucacauuccaucuuauuuuuuuaggcauacuccagcugaaucuagagcucacugauuuggcucgaauagcugucuaucuggccagcaagccucagggcccucccgucaccaccucccggugcuggaauccaggcacacaccauugggauuacaggcacgguccacugugccagcuuucuacaugugugcugggcauccguacucaggcccuccuugcacuuuaccugcugagauaccccuccagcccacuuuaaaauuuguguguguguugugugugucuguguguucauuugugccuguguauacagucagagaauaaaaucagcuguccuuuucccuaauagucauccacuuuguuugaaauggggucucuucacuagccuggugcucuccaagcaggcaacaagcuucagcagucugcugucaucagccuuucccccuuaauuuuguuuuacaugaagaucuuggagauuaaacuuggguccucaugcuugcaagccagcacuuuccugacugagucucgucccagccuuugucuuugucauuuggccuuucuuuucauuccucaaguauuuuuccuuguuucugguacaucaugaucuacuccuauccacucuucccauacacgccuuggaauaagaccuuuuugaaggaacucacaggggcuacuuucaguggaccuuggcacuauucagcucuuguuccuggauccucuuuuguuaauuuuggaaagugacugcucacuaacucuaaauggauuugcuuugcucuguucucucugucuuuacuuuugggaacuucagugacaugugucagaucauuugauaauaucccauucaucguggcuggucuguucaguuuguuugguuuuguuucccuacucuccuuugcucuuuguguuuuaguuuguaauuucucuucugcugucuuuaaggugacuaacuguccuugaaagugcccagucuagaaagacuaaggauucuuagaaccuuacauggcuuuucauuauguugugaucuuuuuuuuuuuuuuuuuuuuuuuuuuuuugucuguuuguuucuggcauuguauuucacuuguuuuuauaguuucuaucucuguuaacuucccuguuugugaauauuguuaucuuuuuauuaacauaaacauguuauuaaucauagcuuuuguuuugcuuucuuggagacagccucacuuaauccaagcuucccuugaauuggaaaucuccauguagcuagggaugaccuuggauuucuaguuggguuccucugagugcugggauuacaggcacgugccaccacaccuaauuuacugagcgcugaaggucaaauccagcgcuucaagaugcuaagcaaaugaacuucuagcuuuuguuuucacaucuuaaaaagcuuugaugaguuuuucauuuccaucagagucgugaacugccuggaauuucagcuggguugagcacuauaggcuucagguuucuucagcaguggacugaagaugauagguuacucagacugauugauuauagguuauuucccugguguuuucuacuuugcccucagcuuucagcuacuugaacaccaguaugccacagaggggccugccuuaccugaagccauugacuguuguuuugugguagggcucgccuucuuggugaggguaagugagggucuugaaucuucugauccagucaguauugacugcuuaguauuaagcaggcaucugugaggggagggcuuuccuagugucucuguugcuuucuauagcugccaauuuuuuucuuuuaguugguaagucuagcagaagauacuuucuugucuuuuguggaaaaagagagaaguaauggaucuuuuauaguauuauaaauagugaccuacccugagcucuggacagucccugugaaucuuccaguuuugcuuuccugucccccaugaagaguuuuugcauggcucuuaaugcagacaugauugcuaaacuucuguuacuuaaggcuuuugcuuucugugagagagacuaguguauuggcagucagccccuugacucuagcuuuucuugugaguacucggcaggugcucuuggaagggaccuuccuugccugugaguaugaaagcuugugucuaguaggagcaaugcagaauuccaaauuacacacuuccuuucuacauuuggccuucaguuuaaauuuucgcaaauuuuucuuacccuuauauaugcaacuaccauuuccuuccaugcuuugccaagaaugaaacagucccagucuacaucagggcuuguacuccaaauugaccucaaacuuugaaagaugacuuugaccaucugguucucuucccuccacuuagccagugcuggauucuaggccugugccacuaugccugguuugauuaggugcugggaaucuaauccagggcuuccuguauacaaggcaaacacucugcauccccagcauuauguaaucuuuucacguuggaacugucguacuuuauguaucggaaagagauccaaaacuguaugucuguauuuugauacaaaauuuuuuucucugaaauucguaauuacucuuaacuggggaaaguauagagucagcuuacuggagccuacuucucugcccuguguugaaaauacugaagcuguucuauaaaauacaacuugaaauacuuggccuaguuuacucuugauguguuguaucaagauguauagagacagaagcacagacaggaguggugugcauggcuguaauugcaaugcuggagaagugaaaggagguggagcaagagugcccagcuacgugagacccugucuuuaacagaagauaaacuaagucuuaagcaggugugugaugcaggcuugguugucuccccacucuuuaacacaggugcuuauggagacacugggugcucugggggcacagugccgaugggcugccugcaacaucuacuccacccucaaugaaguggcugcugcucucgcagaaagugguaagaguugggcucuguucugucuuuaucuuagauaagucuucaagaaguuccaguguuucaacgcaaaucuuuaaggaagauuggcuguaaggcagcugccuuugaagcaauggauccuguugauuuguucucuuggaggacuucuuuacucaaacaugauuuaguuaacuggucuuuacaguuggcaaauagcugcccgugucucauguucuagucacacugcuuccauucacaaagagaccaccagugaacacuacucaccacucacgguaauauggaacaccggagccauaguuugugcaggguuuuccaguuccugcagguuuuccaguaaauggcuugcccugcuuuaauguuuaguuugucugcuucagcaguaaaaaagacuuggccuggcagauuaauugauuaaaguguccacuaaugcuugaaggacaaaaagaaagaaaaauuuggauucugucagcuuucucuuuucccucuguguaauacacaguuugguaccaaaacuacuucugagaucuugggagauaccaggaaaagccuacagaacacacaucucucuccugugacuaguacucuugauauuucauuaguucuugaauuaauuuauaaaaauuuacuccuuauauaugauagaaaauuauaaaaauauuaaguauauauccagugaauuguaagcaggcauguauuucuuugucuuuuuuuccuagcacaugacuauugacaauuaaaaguaucuuugcucucacaaccuuauauugugauagaaaagguuauauacuuacauaaaugauaauuaaaagacugguuugauaaaaugucauaucugcuaaacccauauuugaggccaggcacagugacaucucugucaucccagcuuuguaggaagguugagaccaaaguaccauaguucaggacuugcuuggagaauguaguagaucuugucucaaaauaaaaauuuucaaaaagaaaauuggagaucauggcucacaccuggcaucacagccauggcucauaccuggcaucacagccauggcucacaccugucaucacagccauggcucacaccugucaucacagccauggcucacaccugccaucacagccauggcucacaccuguuaucacagccauggcucacaccugcuaucacagccauggcucacaccugcaaucccagacauggcucacaccugccaacacagcccucagaaggcugagacaugagaauggccacaaguuugaggauggccuggaauccaugguaagaggucucaaaacuaccugcaugaauaaauaaugagugaaugaaugaaugagugaaugaaugaauaaguugggcuagggaugaaguucagugauagagcacugguuuaguguacucugugaauucaacuucauuccccaacacuacaaaaauagauaaaccuauguucaguaauacauaaaucuaaaccgauagauuagaaacuugagauucauuugguucucacccagcucaguuaagcagccugcagaguguacaugacauuugacuaggcugugauguggagcaggcacuucaguaggucagaguuucccugugaagcauguggagauccugauagaaggaaaacaagugggcuugggagaugaugagacugccagcuugaauggaccaagaacguauuucugguuuccucuuuucccuccaauaguccuauuuuuagcaacucuuacauucuugcugcuuguccuuugagccaagaagagcagaauagcccuacaggaaaauguauggauaaggggacuugaaggcaauauuaaccagugaaagaaguuaauccaaagacuagagcaaaaggaaaucauuuagaauugucccuuuuauagcauguaacaguuuuccucuguucuuuugauuauucuuaggguuucccgucuuugccuggaaaggagaaucagaagaugacuuuugguggugcauugacagaugcgugaauguggagggcuggcagccaaacauggugggucagagucugaaugcaguucaugaggagagagcugaugaugggaaagacggggucgggcuuucccaagaaaagaaaggaaaguggauccaucccuguccaguguacacggguauccagcaaaguucagggagucuucuuaggauaccucuagauacugaacuuuauaacagcaaagaaucuuacuuagcucaguguggugguaugcaucuguaacccacauuugggaagccaagacagccaggucaugaguucgagaccagccagaaagcuuuugcauuuaucaguaacauuaaaacgauacccaggaaucacacaugacugacuaaaaugcagaagugacaccuuucuguccccuuuucacaguugcuccaguaacaguaugauaaucacaacaaacagacauggaaagcacagccgacuuguggauccagagacacuuaggaaccuagaaucuacacacugaguucuuaguaugcuuggagcacuuucaagugcagauuucuucuuuuuauuuuauaaaagaugaugcaaaaguuuaggguucuucauuuuuacuuuauuuuugcuucguuaucuaaaagaucugagaaguuauaaagcucugugguagagcuuugccugacauuuguaaagcccuugguuuagucccaagcacugaagaguaaaaaaaaaauuaaauguaggacugggggaaacccugguuuagcaugcuugaagcaagugggggggaggggaaucucacacuuuauaucuuaaauuuuuacuuuuaaauacuaaaagcacaauuauauucauagagaaagaaauaggcauaaaauaugauauauuuccugcuacgaacauuucuacaguauucugaagagauuagagaaucagcagagagagacagagacacaaagauaaagagcggggaagaaaugauuccuugcuguuguuggccauaagauggguauggugcccagccgagaagcagcuucugcugacugauguggcccaggucacauggcaccaagugcuggcuugaggagggaggggaugaugguggcuauauauaaggugagucaguucguuccugcaaauuugggugacaaaaagggagucugacugacagauaauaaggaugaugggaagcagggugcaugucucuaggguauaaagcuaauuuuauagucaugaacacagggacuguggcauuguacccagaaccuuugcagucguggagccaacacagcugcuagaaacguuaguggagacagcacaaggaucaaaagaguuguugucucacaaaauaggguucaccggacaaaacccguacuuuuccuuacaucauacccucaggaagaagaggauuaucugaagucaagaacuuucugcaguaggacagcacaggacaguuuauaggcugcagucucuaaauaaguacuauaaauagcaacuccuugacugugccagauaccuuuguuuaaaagggaaaguagcucaguugguagaguacuugucuggccugcaugaaggccuggauuuucuccccagcacuguguaagccagguguaguaacacaugucuaucaucaaucccagcaggaggauuggggguacaggucaggugggagagaugguucauuggguaaaggcuugaugcccaaacaugaggaggugaauuaggaucccuaguucacauaaaagccaggugugguagcaggcacucauuagcacagcauggggcuuaagaaaaagggagagcccuggggcucagugucagccagucuaacccaaauaauaagcuccagguuaggauacugccucagaagagaaggugggaaguagggccagaggcagaaugcagcggggauugaaauggucucuacccuucaucuauaucccuggccccucuuuuggauuucuuggcaacauucauugguucuuagggauucuaucuguagguauguaagcaaggcuaagaguucucaugagaguucugccuuggucccuacccucaaucaagauuugauugagucagacaaaauacaguaauaguaggagcagaagcaaagaucagaugauagaccugagguuggguguuuugugugcccugggcuucaggauggcauuuuugacacuuuagcguugauauccuggaaguuuaaagaagucuuaacccagcagaggaugacugaguucuuuggccacggaccaggauagguguaacaauuuggaaaaguccugcugagacccuugacaguccugaaggggugacaugccacugccuugugccugacuuauaauucagaaaccuuccucgcugauggaagcucuagugggcacagcauuguauuuaucuuuaaucucgacuugaaauagugaugagcuguucagaggcaugcuuauacaccuacaugcugcacgguucccugguuauuuuuaauuuggcuuauacagagugcgagguugagcuaggcaaaaccucagugccgccugagacauugggugggagagugcgugagcuuugggagaaguaaaagauuaacaacuucagguuuaaaagccauuguucuucaagggagacuaauuaucuguccuuuuauuuaaacuaaaccuuagcugaauuuauuuaaaguacuaaaaucagcagcuagaauugaguuuucuaaagaucugcaguguauuugagaacuagaggucuugauggccuccugagcugauuauccauaagauaaucauaugcugcaaugugguuuaaugauguagauaaugucggucuucugacugagagacucggaguuggccuuucuccccgucucuuuucuuagaguauaaugacucuuuuauuugguagguuauuguauuuacucagacuuaaaguuacuuuuuauaacuauauggaaaauuuuaaguaccuguacauugguacuuggaaauugggaagccuacagcuucaucaagacaaaugacaguccuggugcuucuguugcagauacuggaugauggaggagaucugacucacuggauuuauaaaaaguaucccaacauguuuaaaaaaaucaaaggcauagucgaggagaguguuacuggaguccauagguaagauuuaacagucaucccuaacuuacauagagaaucuuaugaucacaugucuguagaacauauuacauuauguggaaaauugaaguuuuucuauaagguaacaaguguaaggcuagucauuuauuuuaauuaacaauacaaauugcaaaccuaaaauggugagcaacucagaugaagaagcagguacgguccucauguuuucuugucacuguggugcagugacugcuugcucuuuugggacauucuuuugguaaauauuuauugagcuacuacaaugagccaggcacuguucugugauagagacucacaguagauaauaaccuuuguccucucucacagacagcaagccagggcuuuggguuccaucacaaaguagccuuggauaaaacuagaaccauuucuguuagucguauucaccaauaaagaauugaaagcaccggucagugguggcgcacgccuuuaaucccagcacuugggaggcagaggcaggaagauuaaugaguucgaggccagccuggucuacagagugaguuccaggacagccagggcuacacagagaaacccugucuccaaaacaaaacaaaacaaaaaaagaauugaaagcaugaaaaaaaacuuucacucaaaagcaugccaccaugacugcuuuaauguuuuccaaucucuugaacauauaaaacuauagcuuggagauggagagauggcuuaguggcuaggagcacuggcugcucuuccaaaagacucggguuuaauucccaguacacacauggcagcucacaacugucuguaacuccuguuccaggagauccaaugccuucauagggacgcacauggcagggaaagcaccaaugcacauaaaaguaaaaaacaaaaagcccuauagcuuucaacaaccuucugauucuuagaaugggcuaaguuauuaaauuuauauguguguacauaugugcucacauacuugcaugucacaaauguagaugccacaagaaaagacaacuuguggaaauuaguucuuuuuuaucauauuagagccacaaauugagcucagaaugucaaguuuggcagagaccuuacccacugagccuuauccuagccccaggaggugaauuuuuaauaaaacaaauacuucuccuuuuuaauggacuuaguuuuuaaacucauguauguauagcuaugcauuuuauggguuuguauauuguuaugaauuggaaacuacuaauaaugguaggauuaugcuggauuuuuuaaaguauuguuuaaaauuaguucuuuuaaagcuauuuuuaagauuguguguguguguguaagagagagagagagagagagagagagagagagagagagagagagagcaugcauuagguuuccugaagacagaguggcaggugaugccaagccacuagaugggaucaacguggaucagucucuggacaagcaggaaauacgcucucaaccacugagucacuucuccagcccccacauuacuucuuuuuuuaauuauuaaaaaggaauauaaaauuuauaugaagguuggaagagauugcucagugguuuuagagcucuugcuacauuugcagaggacccagaguugguuccuaggaucuaccuggcaucucacaacguugguuacucaaguuccagaagaucuaacauccucuuugggccucaccaggcacccaugccuuaaacauacaugcauucaaguaaacacucauacacauacaauaaagcuaguaacuuuucuaaagucucagucuugcagugggcaugguagugcaugccuuugaugccagcagaggccaguggaucucugugaguuccagaccagacaggacuccacaguaagacccuaucucaaaacagaagucuccaucuuuaaaaauaaaaacgaaaaagauuuauaugcaauuaaauauauuaagaucuuaaaacauaguuggaagauggccuaggcggccaucacuggaaagagaggcccauuggacacgcaaacuuuauaugccccaguacaggggaacgccagggccaaaaaaaaggggaguggguggguaggggaguggggauggguggcuaugggggacuuuugguauagcauuggaaauguaaaugagcuaaauaccuaauaaaaaauggaaaaaaaaaaaaacauaguuggaucaaagcuuuucccuacaugguuuuuugaauaugagcuuuauugccaggcuggauacagcuucuagaaauacauuaucuauuucucuguaucugucuuguaggauggaauuaguuauaucuuuucuuucaugcucaguccaucaguauauuucagggaucagacaugaaaccaaucguagguuguaaugucuggcuguuuuauguuccucuugccucuuuccuucccaggcuguaccaacuguccaaagcugggaagcuguguguucccgccaugaacgucaaugacucagucacuaagcagaaauuugauaaccucuacuguugccgugaaucuauucuugacggguaaugucugcuaucuuugagguggucuuggguuauugccugacgguuccagcuucuuugguuuuaguuauuucuggaacuguuucauguuuaaccacaucacacccagaacuguguaaccuggagcucaguugcuaucacucacaauuacaagaaaaaucucuuucacuuaggauauuagacuggggcuagagauugggcucagagauuaagagcccuugcuccucuuccagaggggccuguguuuaauucccaguacccacauggcagcugacagaugucuguaauuccagacccaggagaucuggugcccucuuuuggccaccacagguaccaggcaaacauauucagacaaagcacucaugcacauaaaaguaaacaaaauuuuaaaaaagaauugaugcauauguagcagagaauggccuagucggacaugaaugggaggagaggcccuugguccugugaagcuucuaugccucaguacaggggaaugccaggaccaggaagcgggaguggguggguugggggaggggagaggggcuaggggguuuuuggaggggaaaccagaaaaggggaugacauuugaaauguaaauaaagaaaauaucuaauaaaaaaaaaagagcaaccuaggcuauauaacaagucugagaugagaauaaucucgacuuauaauaauaaaauaggcagugaaauaaaaaaaauaauugagauuagcugcuguuaguaagaguuuauauuuugugcuauuaaaauggcauaacaaugauuuugaaagagaucucagcugauccuauuucagaucaugguucccauaacauacuguauaguucucauguuauuacugccauagaguucuugacuaucuagaaacuugugggaggaaaaaugaacucccagaggcauuucugcuuucugcuguaugaagguugcaggucugacaguauucacccugucuccacccuuguguucuggcguucuuucauuaacugcuagcaagacccucaugugcagucaauuccauugguguaacuaauacuugacauacucaacuuuugaaaaucagagcuugauuuuggcucagaguuuuagagguguuggucugugggcagauggccuuguuugcuuuggggcgugcagugaagcagugugugguuagucaggaucaugugacaaaguaaagucgacugcuucugacugagacguaagaaaagaguaaugaaggcacuggguccccucuacccuuucaagaaucuguugccaguuccuagaacgccucucacuagacuugaccucuuagaguuuucaacacauuuuaguaaagcaagcagggggaccaagccuuuaucauaugaaccuuugggaccauucuagauccaaaucauagcccucaaguaauugucuaaguaaaaccaucaaaauagcuuagaauguggcaagugcaguguuuccaucccgugugaguuaagagagaaaaugaggaaagguucuguggacuguauuccuagccauucagugugugcugugacacuaccggugggcacuggauccagaaagaccucaguuuaaaugcugcccccauuaccuauuuauuaacuguaaucccuugcuuauccuccuugcauauucccucaucuguaaaauaguaacuuugugaccuacuuuaugaggguuuuuuuuuuuuuaacuuuaugaguuauuaugagaguuaauaagacaggguaaguuauucaguguuguuaccuuucuccuguaaaaaaaccaaccaaacaacagucaggguggcauuucacugugcacacccagcugaucuggaacuugauacauagcgcagccuggccucaauagcacaguucuucuuucauugugcuuuaauacaggcaugugcaaccaaacccaacaccuugcuucucugucuagaacuucauguauaguaaguuuuaagauucaguuagaaucuagggagguuugucuuuuuuuuuuuuuuuucuguuugguggaauguucgauguacauuguaccuaugguggccuacuauauuacuagggagucaguaguaucacacagacuaaauguuuuccuaaauucuuagcucaguagucagcuauggaguauccucauggugagugucauugugacagauaccucaauucugaccacauuaauagucauuuguauauauuucauuaaaauacuuaacuacucaccacugucuuuugacuuuucaaauaccggaugugugaaccuaaaguuggccuauaccaggaucaguaaaagauaugugaagagaacucuacuaauucagaaaaauggauagagccccucccaaccuaguuuacucccucaguaagaaagaguauuaagguuguacaagaguguacgagagugacaagaagcagcagaguggagguuaugguuagauuuuacagugaggagcagggaccugggcugucaucuaaacuugcuaagugguacaagcucauugguaccugcaaacagugccagacugcaacugggucaagggaaauuguucucucaguagagaugaaagcaagagagaugaaaacugcuccagagacaccuaaguagaagccagggaugguggcacacaucuguaaucccagcacucaggaggccaaggaggugaaucgaauguucuaggcuauucuuucuuauuuaacaaauuugaggccagguugugcuacauaagauccugucucacaaaaccagaaagaaaaggaggggcaguggagcaggcaggcacuuuggcuaagagagcauccacaugagaaagguauuaauacuuaaucuucuauaguucugagaugguuacuugcuguauccgucccuuuacaugucgcuaggaccaaacaccugacaaaagcaacacaggcauaauccagucaugacaggaaguccuggcagaaggacagccauccacagucagaaagcaaagaagaaugcugaugaaagagaugaagauggugcuuucuccuuuucuuugguccagggcucccauccaucaagugguacugccuaugcugagggucuuccuauguccguuaaccuagucuagaaacucccucaaagacauauccagagguuuaguaccguggugguucuaaguccccuuaaguugucagucagaauucaccaucacacgggcaucagggagcccugccaacaccuccuuguguacugcugacuaagauuccacuugaggaagaagaaaaauucccccgaagcuccaaaggagcucagcuaggcuuuucacauuguagaguagauaguguuuuagcucuccuagggcuguggagcgagaagaaccaaagagaaguucagaggguugccauggcaacuaaauagcaccagguagcuuaccguuacccccaguccuuccuugagugaagucucuuuuguccuuuauccuugaggaaaauccugaggucacaggauuaucacugccuaccuggaguccguccaugucugcagccugguugucauuugcagaggugcagugugaaggaaguuuccagaccaccacagcuguguaugguuaaaaagaagggggaugaggaaaaucuucagaaaguggucaagagaaaggaggccuagaaauagauccuuuggucuccuugcugugcuagccauugcaagaccacucugauaauccaugacuugugagugugguaguccccaccagaaaguaggaaguuuuacacauauuuggagagaccguguaucucaaaauugacuggauuuuaguugaaacgcuuuuuuucuugaccaagauucccagaaaaaguagucuuuacccaaggagaaccagaacucacuccuacacauucuuuccagaaauccuggagacagcaaggaucaguuucauagagaacaagauacaaagguagaauguuucuacuccacaugaacccagaaagcucauugucuauauagugagcaucagcagauuucacagccucucugcaccguuguccaguacucucccuauuggaucaguguaagaccaaacuggguacucugauacugcuaacugcauuacuuacgguauauuccuaaaacagcaagguaaaacaguguugccauuacgucagaacugucacuuccuaaauuaaaauuacaguuuccuuauuuguaucuuugcuuuuuccccuaucuagucacaauauagacguguacauugcuuuuuuguuuacaggccacuguguacucuauaucuuucuuuugcaccacucacuuuagucucagagauuaaagagggaggcugcacagcucccauauaccuugagcucguuagauagacaaaauacagacuguauugcuuucccucaaaaaugaaagaacuaaaacaaacacacaagccucagguaggaagcuaaggauauguuuuucuaagugaaugguuugguuuuguuuuuguuucccucagacuuaaaaggacaacagauaugauguuugguggaaagcaggugguggucuguggcuauggagagguaauguucaaccuuuuacuuguuggaugcuuaaaauguauuuuguuaaaauguugccgaguuuuguguguagacggcaguauaccaugcaccauguuagaugggaacaccuaacuucagagggccuugaguucagugccuuucuuuuccuuuuguauuuuuucucauugauuuucugacuuguuccagcaucgcuguuugugauguucuuuuagcuuguguuuugauuauaaaucgugaauguggguguucucaugcauaugaaugugccaagcaggggccggggauuuguuuaugaacugcauuuauuuguuuuucuugguuuuucccgagcaugagucuacucagcaaacuuacuuugaggggaagaaucaggguccccuccgcaaaccucaagaggcuggagaagugugcuuucacgggcugugcucauugcuauguucucugacugcucaggugggaaaggggugcugcgcugcucugaaagccaugggcuccauuguguacgugacugagauugaccccaucugugcccugcaagccugguaagccucuccguggcugugacgccugccccuccuccucucuguggcuggcugcagugccacuguggaucugccgugccgcgccuuacgcccacaugccugaagcugcaagggaacucugagcugcugucuugcaaaagucaaggaguucugcucggagggaagugggaauuuagaauuccuaucgaaauaguaacagggaauguuuugguuugaggaacaaauaucccauuaaugucucucuucauauguaauccccaccacuuuggaaauaauaaucaaaaagaaaagacaggccagaaaaacgguuuacuagacuaagcgguuacugugcaaggccuaaucucagucucugacuucacagaguuguccucugaccuccacggguguaccuuggccugugcuuaccuucacacauauaucaugcaugaacgagcacacaaacacacacacacauacacacaaacacauccuaguguuuuuuguuguuguuuuuaagguucagagcuauaaucuuaguauuccugagucugaagcaaauagauuaugacuucuaggccuugguuacagaguaagaccuugucucagcaacccggccuacagagugagauccugccaggaggcgagauugggugcaguuuagugauagaacaugugcuuagcuuggacaugaguucagucuucagcaggaaggaagagaggggagugaaauacaauaggccuucugauauauaucaaagaccucugugguaguccucccaaaauguauacuguaaaucuaacuaugagaaaauauuagauuaauccaaacuaagagugaaaucugccuacuccugugugaagaauguauggaaaaguguuugugguguucuuauaauucuuaaggcuggaaucuaaacuuaaaauuuuuaaguuucuuuuuccucucucaaauguggauccuaguagggcacagcuuuaaucccagcauuugggaagcagagacaaaaggaucucugaauguaagaccaguguggucuacagagugaguucuaggccaaccagggcuacauagucagacccugucuaaaaacuaauaauagucaaauaaaacaaauaaaauauagauaauaauccuuaccucaaaguauugugaaaauuaagucacagaauggacccucacuaagugguaacuguuacuaagauuauuuccaucauccacagaaugggaaacaccacggccacuaaaagcuacuguaagcccacgcuucuguaguauauaucuacauuuuuaauuuucugugcaguguuuaccacuaagccucuggaagaaggacagugaccucgaauaaggccuguuggcucuguccugccacucacagagcccaacccuacggugccgaagcagagcuucccaguagagucucuggcuuccgcagagcuucccaguagagucucuggcuugcucuaguuggcuucacucacagggagcaccaccuuucuggucuuuucaguauagaaacuggaacaugacacugaugacaguacauucacaucaucucauagccgugagccacacacagacaguaacuuaccguauaugccguguaugcuguacguacaagcugugugcugaggguaaaugcgaaaguagauggaggggccguggcucugcuuugaagugucagaagcucuguaaacagcaugcagagcuguaaaggcacgggagagcugucuuaacagaagacugaggcacuggacacaggaauuucagcaaggcuguauuaaaaccugggcaggguuuugggcuuuuguuuuuuggguuugcuuuuuuguuuguuuguuuuuguuuuuguuuuuuggguucuucuuuuccucucauuuugaagguaugugucccaggcaaggagcaagagcauagccuccaaacaaaggauagcauagcauauuucaggagcucacagacuagauaaauuuggggaaugguaauaucugagguuagaaucaaauggcaguguaaucauuuaucaguauaagaauuuaggucuggcgcacgccuuuaaucccaguacuugggaggcagaggcaggcggauuucugaguucgaggccagccuggucuacaaagugaguuccaggacagccagggcuauacagagaaacgcugucucgaaaaaccaaaaaaaaagaaaaagaaaaagaauuuaggucuuauccuagaguauuuuaaacagguaaauaaaaauguucuaaauugcacuuagggaaaucacucugcaaaaugauuugagagauguaaccuagacaaugagauugggccaugcauugcugaccagaccuuagaaaagcuagcauguauggguaaaagggggcagaacuaggcacuguggcccacaaauugauaaucccaccacccaaagagaauuaccucaaauuuaaggcuagccuggacuacaaaguaaguucugacccugucucaaaaccaccaaaaagguucuauugggccauaaauacaagcaacuuaaggaauuaaggaaaaguauuaaaaagauuugguuacaauuucaauuagaaacaguuacuuggcucauacaguuggguuaacauuaaugcuguuguucaggguagaaaauacagaagaaaaguagaugagaguuuggagaggauaaugaguuuauuuucaaacaaaugugugauccuucuggggaauccuugagguaucugaaggaguaguuaauccuuggcuaugaagccccccaggcaugcaacuuacaaacuauaacugaaauguagauugaugguaaagcuccuccuuguuugcuggaugccuggugcccaucacgugaguggugauuuacagccaaaggcagacuaagcauggguacugaaagaacagagagggguccagugaagaaccccacaaaguuccacuacuucaauaugggaaacgccuuagaauuuagccaagugggguacaagguccuggguucaauccccagcacuauacaaaaguggggaauuggucuuuaaagaaggcaaguuacacuuaauguggcagagaaaucaaauacuguaaggcacucuggaaaaaaaaacuuuuuuuguuguuuguuuuuuccgaagguaaucaaugaucuuagaagaacagaugcagugagaauagauccaauggccaggugucauuuucuagaaaugccauuugggaauuucaugagcccuggcucggcucucugucacugggagguauagucccacgggugcaaagggagcuuuuacacuucuccuguauaaacugaagaguagcccacgccagauguggugacccaugccuguaaucccagcacucgagggaaaggcuagaggauccugaacuugaggccagccuggacuauacaguggcacugucuuuaaaacuaaacuaaacaaacagacuggaagcauuccagcuguccaggaagugacacuguaacuaccugaagagcucggugcaggcuuguaagggagacuccccugcggcuggcugaguuacuuguccugcuuuauuucugcaguauggauggauuccgacuagugaagcugaaugaagucauccgacaggucgacauuguuauuacuugcacagguaugguuguggugcguccaguggggugggaugugggaaugcuuccauggcacauauacggggugauuaaaaauauucuggauaaagccaaacuacuaaacugagagauagggguugagaaguaggaguggcucauuugguaaaaugcuuaccuuaauaaacauguuuugauuccaagaacccauggaaaaaggcaugggugacuggagaguugacucagugguuaagaacacuuguugcucuugcaaaggacccagguucuauuccuaguacccccaugguagcucaaccauaacuccaguuucagguaaucugacaccuucuucuaacugugggaaucagacauauaagcaguauacaugcaucaggcaggcaaaacaugcauacacaugaaauaaaucaucuuuuuaaaaagccaggcaugaugguuuacacuuauaauuucagcacuguggagucagaagcacacagagagacacacaugcauguaccagaaauaguagaaaaaaaauaaagucuauuucuuucacauuuuccuguuuagagcacugccaaacuauuuuucagagcaguagagcuuuuguacaguuguacagcagugcuugagggugcuagcuuuucuacauccuuaacaacacuuuuauuauuguguucuuuauuauugccaucccauugaacauaaagcaguguaugauuuagaaggcuaguaauagucuccauucuuuccuaugcuuuuuggcuauugauaucuucucuagagaaacauccuuucagacccuguguucauuuuuuuaaaucagauuauuugucuuuauugugaguuguaagaguucccaauacauuucuaguagacaucccauuugauuuacaaagauuuuguuccauucacuaaguugucuuuuaaacacuuccuuaguggggucauuuacagcaaggacuuguauguuuguugauguagucagucucuguuuuucuucuguuguuuauauuuaaagugcuguaucguuguagacuguugcagaaccugaggccacaaggauucacuuucauguuccucuaacauuucuguuaaaaacuaagagguuuuucuaguucuugcucuuaagaauaugauccauucauguuguagacauugguugaccauuuuacauacagaguugagggaauaaaaacuacuuguaguuuaucuggaaagcuauuaggaauuugccuaguauguucuuauuauuuaacaccauuuguaaugaaagcaagaauacaaccuaccuaaaaaaaggaauaugauccauauaaaauugauuuuauauauuuuauuauauauuauaauauuacuauauauauuauauauauauacuauauauuguguguguuuuuaugagguagggggucuaacgucuuuccuuuucauguguuuaucucuucuguuuuuaagggaacaagaaugugguaaccagagagcacuuggaccguaugaagaauagcugcaucguuuguaacaugggccauuccaacaccgagauugaugugguaagauccucacugaccacugaugggaccuuucuuguuucuccuucauucucuccuucccaaguaacaaacuggaagaagaaaaggcaggggcaucagcuagucugaacaggagucaugagugcucuggaauaguccaugucuguucacuuuccagcccuagggccugugcuuaggggcaaaauaaagcuuuuucaucgcaaccauuucaaaugauuaccuccuuacacccaggcuugguaccuacucagacugugucacaguggacucaguauauggggauguuuagcuuuacauaaagacacguagucugguccguggaaacacucaaaggagagaucugugggcuaggagaaguacauugccuuagaauggcugugccuaucaaccacugcaguuucuuuucucucccuuuuucacuggccuaggucuccccuuaacaucucucucaaaucacuguaacuagguuauagguaccaccuucaguucagagccacuguguaacagcauauauuccuaaaccugggaaguuuauugcuguaguucuaucuucugauuauauccaaccaaaccucuaauaaguuauccaaguagcaguuaauagagguguauuuauuucuuuuuagacuuaccaaaguaucucucaguaugacuuugacucuggcuuuaaguuuuuauggcauuuucuggcaugccugucuuucucuguggguaacuggcucaaccacagcaggcuuucaucucacugagggcugcugugacugagcuucagcauuucagguaaggaccagcugcugccgagagccguuggacgauauuuaguuuaugugguuucucuuuuuaacccuguuguucuauucuuuuguuauuagaaguauuuggcuggggaugcagcuccauguuagaguguuugccccccacacuaggcccaagguuuaauucccacaccacacagcaccagaaaggaggaaggaaauagcuagccagauagccucccagagccuaaggcuagucugggggucugaguaccauggcaucauugcucugucuugacacugugguuugcuuacaguuacuaauggaguugauaguugguuccuuggcagggguggggauccucuuacauuccaguuauguaccaugagugaaggggcaccucuacuacauggucaaagagaaagcgugaagacuuucuuuccaaaaccacaggaagcucugaauaacagaugcggccaucuaacuucugcaccuuuacuuuuauucacuccaugcccuugacuacccugggaggguuagucuuaacuuuuaacugggaagcguagacauuaaguacacugguaagucauacaacugauucagaaugaaauuuaagcacaaaauucuucaaguauuugagccggugugugugguggugcucaucuuuaaucccagcacuuaggaggcagaggcgggcagaucuccgaguucaaggcuagcauggucuacagagugaguuucaggacagccagagcuacacagagaaacccuguuucagaaaaacaaaacaaaacaaaauaauucagguguauugacuccaaggccuaguuuucccuuuaaagaugggcuaaacaugaguaauuccucagaauaaaggucacaagaccauuuaccuucaaucacaaauauuacuguaugguugcuauaugccaccuggaguucuagaugcuuggagucaacgaauauaacaaauuccuacccucauagagcuuaugaggagagugagacaaaaaacuuaacauaauaaauaaguaaaauucuaaagagaagagagaacuagagaauggcagagggcaucugaagaacuaggccauuauuuaaauaguagcuuagacugugagcccagugucgggucagucguguggauuucuagguaaggggcauuguaagccguagcugguccacauggccugaggcagaaggagcccugcuguuugaggggugaaaggaggcugguguagauggcacggugagcacaagacagggaagggaggaugaggcugaggugacaggccuaacagcccacgcuaaaaacaguucuguugugagagaaucagggggccauuguaggguuucuaaucuggcuuaguuuuaauaugaaggcuuuuacuuuaaaaggaucauccuggauaacauguugaaacuagacuugguuuugccauuauuucuagguaggccccccucccccauauuugcuauaucaggagccaagagccauucuuuucuuucuuuucuuugaguucuucauggcauaaggugugguccagaaaagaugcuacucagagggcuuuugaaaguuaaauuaaugugugaugguacugucacagagcauguaaaacaaaauuuaaaguagauugcuaggaauucaaggccagccagggcugcauaaauaagauccuaacuaaaaaacaaacaaacaaaaaccagcaaacucagccaauaauuaggaccaggauguucauucauuauuuagcaaguguaugcugaauauuuggccugcucuguaccaaguuuuaauuagaugaaguaaaagcauugagcaacaucuucugcucgugaacuuuauauucuugugugggaaauggauaauaaauaaguuaacaguuauugucuguguuauauugaguggaaaggcaagaggaggaugcugagagcaucuucuaauugaaauggccaagaaaggcauuuuguggauagacgauuggggaaggcugaaugaaaggaaaugcaagaugugugaguacccuguauucagagaaaauggucaggcgggagugccgcucagaggcagagcacuggucugagaugacugcacacaguccuggguucagccucaccacugcaaagaggaaacaaaacaaaacagguugccaagagcugaagaagcuguaguagagccagcaagauggcucagcagguauaggcacuuacauccaagccuaaagaccaccugaguugaaucccuggaacccacgggaaggagagaagcaauuccuguacauaugugauccucugaccugcacacacauaccaugaaagugccaacuuauacacaaagauaaauaaguagaucaguaaauacauaaauguaauuuauuuaaagauaaagucuggcgacaguaauaaagucugggugaggaugaggaggcagcucaaggaggcgaugaggaaggcggagcuuugugggccauagcaucuagaguuuuaucuaaauaggaaagaggcuacuggacaauuuugaacaaauaaauaacaaaauauuuuuaauaaaccagucuggcuuuuggguaaagaaaacugucugggcuugaguaggugugaggacagcaggaaacucugagagggugaaggugcuggcuugguucaguggguaaacaguagacuugauaagacucaauguuguaaccagugggauuugcuaaaccaguuagguguaaaaugugaaggaaggagugagagucucuguaaaucaccuaacguuucuuguguaggaaaguuauuugguaaucauccagauaaauaauugaucuuuuguauacaaaacuuagagaggaaauucucuauaaaucaaauuaguguuacuauguaauauuuacccagcuagauuuguauuguuuuguauuugagccaccaucucacucuauagagacucagagauccaccugcugacuagccagauaguuuugugaucaaaauuuagaauaaaucauaguacuuggggguugagguaggaggacggaguugaagccugcuugggcuaccuagagagcuccaggcucaugggcugcgagugcaguaagagccccugaguguggcuccccucucccaaaaauuacuuagguuuuucuuuuccucuuuuggguaggaauuuuugguuuuaccuaacuuugagauauugcuugcugcauauuucaagaaagaauaggucaugaaaaauguuauccacuuagaaagcuguacuuuuuuccugaaaaauaugaauugaaugaacacuggagaagugcuguaggcuacucggugggcagcucuuucuuucacauaucuccugucucacguggaaggccugugugauugucagcuuuguaguccaagugauaaagcauuauauacacaugcuuuccgcagcuuucucuaaugaaaguuauuuaacuaagucuugcuauugauucuguuuuaaaggacuggaaccacagcugugcucccugcaggguggggcuggggggaggggacgguauccuauaagaucaguauguguaggcauaauacauuuacaggggaugugcccacaguuggagcccauaucugcauaagcagcccucuuccugguagaguaagguuagugcagauucacagcaaagccaauucugugcuccuccacccccaccgcccuuuuuaaagugguaauucuagacaugaaccccgaagcacacguuuaccaccgaccuccucccccagccccaguugguugguuuuuaagagcuauucuugucccagccauaggauaggaaaggcucuuagggagcaggacagccaaacagacaaccuucacaaugaggacauugacccucccuagagagugguggagauaaguuaaccaauuaauuuuuuaaaccucuuuuuaaaugaccaucaaggguuuuggcccuuauugaagcccguuccugugccuuugcuauacugccucuucucggcacuguuuuccuauguucuaaacaguugucccuuccuugacuccaccauguccuucccaaagagcacuuccuaagauggaggacucucaggaucauguuguuaguucuuugcuaacagucaccagaauuguuuuuccucuggaagauuaaugauaugaaacaauaaaauucugaacuacuuaccaucucaucucaauauaaaaugcagggguuaccguggagcugugugcuuuggccagaagguggucaucuccauaugcuauuucaaaggcuaaaggauauauuuugauuuuuccuuaacuucuucaguuguccacuugcuucaauuaguuuaacucuguucacauccuuuacuuauaacuuuuaaucuauggugcuggggauccaguccagaauuuuacaugugcugggcaagaguaguaccgcuaagccacacaugacaccucuguuguugucagugugauuaucaucauuacacccaugucauccuccuuuucuucuuuaucuucuuguucuucuucuuuuuuuuuuuaauacccaguggaguugauuuacuuagucacuuccuguuggucuaugcuuauuugcuaguaugaauaauguuaggaugaccauucuuuauuuguuuuugcuuuuguuuauuaagauccucccaaguacuggaauuaagggcuugcaccacuacaccugguuuauauuaaaauuccuaggcgcuuuaauucuugacuugaauaaauauuuguuacaggagucuaaaaauuaaacuaauugauaaaaauuaguuaucuauaacauuuugguacuuauugccaaauagcucuuuagaacaauugaaucaauuugugaaauguaugucucaaauuuugcguauccaacauaucuaauaaagaaauguugauccagagcaugaauaaaugcaguucuaaauacacuaaaauauaauuauaugucuuuuugcacuauucaaauguuauuuccuuagagagagagagagacaaugauugucuaagcauuaauugagcacuccauuguauaucuaaagagaauuuggaaauuuaaaaaugaaaagauacugucucugcagaaauggcucacaaucuucucuugguuuuuguccuuuauuacagugccuagaauuaccauguaacuaaaaugucccucuugucugaggucuaguauuuggcaguauauucuuuaccaguauuuucaguuuuaccagaugaauaagaugggguaguuuuggaauauggacucacuuucuguuucagccacugcuaauugaagaaggaaguaguuguccuaagucugucugcacggccugugacugacauuucauugcugcugauaaugaacuucccaucuuuucuuuuguucuuugaauacacaauacacagaaguggaaagagggugagccauugggcgcuuuacucuaccacuugcauccucugaaagcuaccucacauuugcacuuagggcacagagcuucuguaggguaaaccagccuuuugagcaggucagaccgggauguugggccaugagggcagaaccaugguccccagcaugcuguuuaggacauucggcuuucuccagcuaauccacuuggcucugaucaucugucucucucuucagcacuuaugcauaccguuugcaccauauuauucugcacuuguuugcauguugcuuuguauuucuucucacauauguauuguuuuguguccccaacuaaaaugucagcuuuuugaaggcagaaaccaugccuuugguuucuuuuguauuuuccauagcaccuuuuacugugcucagcagagagugggcguacaauauauguuguggaaugaccuccugagggaucccucccuggcugggccuaagauuaaauucccugaaauggaacaguccuaaccaacccaggacagguauucuccaucuggcauguugguugcuucuuucgacuugcuauuuaaaauagcucccuucaacuucuuucuguccccaaugugggggacuugccacagcuaauaauguucucacuguguguguuccaggccagccugcggacaccagaacugaccugggagagaguaagaucccaaguugaucaugugauauggccugauggcaagaggauaguacugcuggcagagguaagacugaggcugacaaggagcuacuccacugacaggagagacugccauucccugcuccccugcccccucccccgcguguucccugauccuuucaacucugucucuucagcacaaauuuaacuacuuuaccaguagauuuuacuuauaauugugaaagaucuuuucauugagcaauuaagaaccuauucugguuccucacuuucacccauuauccugucuccaugucacucugcagguugagucagaugaugacuauuacuguggaaggaguuagcagauagagucagugcagcucacagagaaagacugucuugugugggguuuaaucaguaagcaaaguagguauuccuggcuguaacucagacugucuuugauaagcuuugggaaagucaugucuuugcugccagugucucuauuuuagggucuuugaacugaugaacugagccagcuauguaguggguacccagcuuauucugcuaaugcugugugauggaugguucccauccugugcaucuagcucauacuccuuuuucccagggcugggaacugaacucaaguccucacacaugcacgcaugcuaggcaggagcuccaccacugagcuacauauuuccaguccccuuucaggggagggugggauggagguaucauguacacguuaccucuugugcuuguggagucagaggacaacuugcaagagucaguucuguccaccaugugggucuccucagguuggcaggcagcaggucccuuuaccugcugagccaccucacuggcccgcacacuuagucuugacuuugaucccuuguagccuuaaugucauuuccuaucauuuuccuauagugcaggcucugcucaucuguccuuggauuccugggugcugggagugugucuuguuuuuuccaugaagcuuucucuuuucaaguaaaggccccaaauaacaaggggacaaaaaggcuuuuccuagguugcaguuuccuuugguuuugcuuauuauuaucaaagaaaccaaauauaaaaauauaaacagcaucuccuuauguagggacacauagggccaacuuucuauguccuuacuguucuuuuuaucuuuuguccauauuuagcugacauucuuacaugcuuuagggcaugucugggaaggcauguguauagauaggcgaagaacggguuguuaaauguuuauuaauagccuugacgucagaccccugucuggcaucauuucuaaacugcccugggaggucccuccuagcaauuuuggugauaaaagcuggcacuaaagguguuuuuggcuauauagcugagcagaaacaguagucaggcagcaaagcaagaaaggacagcauggggcaggguuuagcucucuugcuguccuuauuguccacucagaagucaaggcugccugccuuugcagcagagacacaaacagaagcacagaaauccucacaucuuccuaaauccauaguugucucccucccagccuggagagauugcuccuugccaugacuccauccuuuccuaagacagucaugagaauacccucaaaagaaggguguuuugcuacagagaaugaagagauugagagaaauacaagccuuugcacaaucaucaguguacuaugagugcuuuuaucccuuuguauauacuccuagaaauuuagaacauuuaucaaauuuucagugcuuucauuuggauauuuccaaagaagacaugcaaauggccaacauacaaaggggaaauguucagcaucacuaaucaucaggagaauggaaauuaaaccacagugagguauuaccucauuaucuuugauaagaauggccauuacgaaaggaauaaaagauaaauuaugaaaaacaggaugagcuucucaaaaacuuaacaauagaacuguuguguguucccguaauucuguugucacacaucccaagaaaacaaaucagccugucagauacaugcgcucccuuccucauuguaggcuauucacaugagccugggcgugggacugacugacgggcaugugguacaugcagcaaacacuguuuuaccauaaaguaaacgccugucauuuguuagugugacauaauguuaagugaagucagccaggcauagacaaguaaugcguauucaaucccguguagucuauagacacugguuaugggccagcagugguggugccugccuauaguccugcacucaggcaauggagacaggagaauuaggaguucacgaucagcuuuggcuaccuaguaaguuugaaggcagcuugggguacacaauaagacuaucaucacuaaaagaaaagguuaaaucuagcaugauuuauaauaucaaauaaauguaaaucaacaagagaaugcccaaguaagccagaauaccacuauucaauggauuuaugagccuuguguccaauacauugaccucauagaagugagaagaauaaauauugaugucaggcauuaaucucaacaauuuaggaggcugaagcaggagaacugagaguuaaaggccagcuuguaguuauauagugagucucugucucagacacacacacacacacacacacacacacacaugauugcuggaggcuuggaacuuugggcaguugggauucagcagaggcugaucaguggaugcugaguuuuagguagcuaggaauguaaaugguucuggcauacuauuagcauacugugacuauagauaacaguuauguacuggacauuuugagaagcuguaagaaaggauuuaaagaugauagguguuugaggaaaaagauauauguacucuuguauugaaacauuauaugguauccuauaaguaguauaauuuuuacuuugauauaucaguuaaaaguacauuuuggauaaaaaucuuaaaacauuuaaaauaugguggcucaugucuuugaucucagcacuugguaggcagaggcagaaggauuucugugaguuuaagaccaaccuggucuacauagcaaguucuaggacagccaaagcuauacagagggacacccuaucuuagggagggagggagggagggagggagggagggagggagggagggagggagggagggagggagggagggagauaaagaaagaaagagggagggagggagggagagagugcccucuuuaucuagcaaucucaauugggaaagaauuggauguuggcugucauucuucuaucacuaugcccuuuucuuucccuuuugguccccagggccgucuacugaaucucagcugcuccacagugccuacauuugugcucuccaucacugcuaccacucagguaagcucugcagugggacagggguggccugaagaggguuaucagaaaagccagguuucacagcuuugaaaggcguaucagcauucauguuucugcuuuuuuaggcucucgccuugauagaacuuuacaaugcuccugagggucgcuauaagcaagauguguaccugcuacccaagaaaauggguaaguuguucuuucuuccccauucuuacuaaauuaguucacugucauaagcucagaggcauugacuucuuugggguggguggggaacaaagggaaaaagacauaucuuugucauauaaauuaggagcuaggacucuagacucuauuccaaggugguuuguguaauuuucacacagguuuuucuagggagggucuugcauuuugcuaugauuuggaauaccuaccugagaauuauuuuguuagggccuauugcauugcaccacauugugugcuuugaguuugagucucacaauauagucaggcuggcacugaacucacuccuguuucuagucuggauuacagcauauaucaccaugccuggccuaccaaccaauuaaagauuuucucuuuuaaggcaucaugcauguaaaauucucuaggaggaggaaaguauuuccccaaaaagacuaucucuggccuugugauaucuggcuuauuccaguucuaaggugcuaaauagcuuuuuaagggauauagguucuuguuaagaguuaauuaugugggugauugguauaauagaaacacuaaacugucuuaaauuuuuaaagagccuaucucagucaucugggagauacauuauguuuauaaacucaggaacuaagucagcuuugguuuugcuguuacaacuugcuauauugucccuuuaauacaguuuggaugggucugguauggugacacaggucuuuaaucccagcacacaggaggcagaggcauguggaucucugugaguucaaggccagccuagucuacauaguauauuucgauacagcccggguuacauaaaaaaaaaaaaaaaaaaaaaaaaaaaaaaaaaaaaaugucucaaaagaacugaaccagccgggugugguggcgcacgccuguaaucccagcacucgggcggcagaggcaggcggauuucugaguucgaggcuagccuggucuacagaguaaguuccaggacagacaggacuauacagagaaacccugucucaaaaagccaaaacaaaacaaaacaaaacaaaaaaacaaaaacagaacaacaacaaaaacaaaauaguaaaaaccuaccacaguuuggaagggugugaagugaauaaaaugaauagagcagucuauagucucuuaguaguuauaaugaagcuguaaauacaauauauucaaaagaugcaaaauugcuaaagcaaagcauacauuucuagauccucccccaauuuccauggguguuaaauuuucuaggacauaaauauaguuuucuaguauaguguaguauagauaucaaggcaaaacuaaagguugaguuucccauuuuuaacuccugugcugugccauaauuuccuucuuuucuggggaaaaggcuucaggguggaaagaguuacuggaagucaagucacuggaauugaagcuaaaggcaaucauuccuuagagaugaggaggaccuaagagcagaagucaaccauuuuccgucaccuccaagaacuagaacaugucuuccaguuuuuuaaggccuagcuuaaggagagagccagcaggaagcaugacuacuuccccugucuguggucuuuguagaugaguauguggcaagccuacaccugcccaccuuugaugcccaccugacagagcuaacagaugaacaagccaaguaucugggacucaacaagaauggacccuucaagccuaacuacuacaggugccuugggcuccccagaaaucagagaaggcgggguacuuagagcuucccagagugcagcugauccuuguaucuguuaccacauaccuuuacgugaacucagaaaaauaacauauuuccuccaugucuccuaccucagaauacucugaaaucuucuuaaaacauugguguucuccaccaccccuucccgccccauaaauacuagccuuuuaaaaucacauuuuuguuacuuauuuuguaauuguguauggagguggaggugggugcuuguucaugaugcaugugcccugguugcauguguggaggacagaggauaacccgugggacgaagcuucccuuguaccguguggguccuguggagacuggcaggcuugguggcaggugcuugucuccacugagccuucucaauagcccauggccuuuuuucacuguaugaaaaagagccacagauaucuaugcuuaccauauacacuaggaaagcccuugucucccucuuacaccuuuaggcaggcuccuuauguuccagucccaccagcagauaacaucaguuucaacuuucuuuuucccuccagguauuaaguuccuguaaugcaagccagaagacauguuaaagaauagaaccaagccuuuucucaaauacuauccaaggaagaaccuagcaagcugcuucuccaaucagagcugcccgccgugcucauccuguguguuagguuauuuauuuauuaaaaucuagaauccugugccuguagccuuggcccagagugugguuacuaacucguggggccgugagagccacagaggacaggcugaggaaggaaagaaaugggcuagccauuccucgugcaucacucgcauuauugcccauuaauggaauccccagcgaugaccauguucucuccaggcucaggaguuaguucagggaugccagacuccuuguuacuuaggguuuucugaauacauuucagcagcugccuuucucaaagcuuugguccuuucccaggugaggccuuuuggaagccacugaauuaauaaggccugaauucucagccuugauaguuacugucacugccuuccuuauaaaaaggcuggggaggcaggagugguaaggucuuguaagcugcaccaagaacucagcugugccuguguccgugccuacugggaucucuucucuuacccaggacuucuuucuucuccuugacuaacuauauccauuucaaugcuuucuggcucuaagaggguugugacuccaugaucuuaacagcucugguguuggucaggcauuuguuuuacuuucuaacccuacuaaacucugcucaggaaguagccagccagcuccacugggacccauaguucugcuuucuucccauuuaacuggacuguuuccuaggaagcccccuagaugggcacugucagagaaggagagccccguaugaacagugcuucuguugugccugaaaugaugcuuggagcugaguuggcgaagguguuugcuagagauuugggggcuucagacuuuagagugggcuauagcuugauauccuaaagaaagaaguuuuuccaggaaagacuuugcagccuggcugcagaagacaggagacuuuguaaagugugucgagaugaugaaaccuaguuugagggcuggagguuagcucagugguaaagcacuugccuggcaugaguaaggcccugugcucaaucgcugggaacuaggggaagggauggggcacuaguuugaaccucaucagacauucaucccuuuggcuguuagccuuggugaaagugagaucugcagucugauagcuuaucuuucuuugcugcugcugcugcugccgcgcuguaucguuauuaugaucuggccccuucuguuuaaggauucuguuucagagaguuucuuaaguaacuccagcauuauaaaauaauaauguaaacagugugaaguuucucauucuacccaagagugauauccuuuggagauagacugagugguuucgagguuuccacugggaucauuugauuucaagaauuaaccuggagugacccuaggaaucuugaguugaaugagucccucucauggcccucccuauuuagaagucuccuguuuguuccccaugugucuuuuacauugauacaucuuuuacauuguaucaagagcaaggucauuccaacagaggacacccagaaucacugaaaccuuccucuagaucuucuccccuggcuccaccaucucugcugucccuuggucuuugugugugcccuggaagcuagucuggaaguguccuuauuuucuaagauagggaaacagaacuuggguagguggcugguuugccuuaugguauacauucuggcucaccccagaagauggacucuugccaggacagcaucuguggcuguauucuguuguauaaggaagaucagaaacacugaagaccuuaccgagauaggccguucuguuugccucauucugauuucuguauuagcggaaugcaucaaucacucucccacuaccauaucuguuuuguuuuuuguuuuuuguuuuuuuguuauuguuguugggguuguuguuguuuugagauagucuugcucuguaacccaggcuggacucaaagucacggcaguucuccugccuuggccuccugaggccaugugcuacuaugucuggccucauaauuggaucucuuuagugaaagauucauaucucugugccucauuuuauguccagagcagauuccguuaggcagguaucuggcuugggccccaagucauauccuggugauuuucugcaaagccuagcucucuacagagcuucuuauggcugccacaccauagggaagagauccccuccaaguaaaaaaggagccacauggguuucuaaguuacguuguaccugacugcccauagugagguaucugccugugaguuacagaugacaucuauucccuucucucuggagacuucugugucaucaaccauuaagaaaguagccagaaauaggauguaagacagugauaggacacuugauuagcaugugccaggcccuggggcgaaugaaucccaguacagcaggcuuguggagaguugggaagaaagaagauagcccagguucugcccuaaugcuggaaccaaaucauuguuuccucuaaccuuggaauaagagcaaauuucuucuuauuccaacucuuccuuuuacaagcacucuagcuaccuggagacaaggaagagaagacugguugucucugguuauguggcccugggcagagggaaauacaccacuugucuacaaugaauuugugcuacuucaaggucuucuugcuguuuuaguggaaauauuguuuucuuuuucuuguuaaacaaaaaugccucuaaucuaccuucccucugcccuccucccuccucauguuccccuccugggagagccaggcuccccacggccacacacuccugcaaagcuuuuucugcugcuuggcuuuucucugaaaagaucugaaauugcugcuccugugcuuuuccucagaauuaacuuuugucaugguuuaaaauaaaucagaaugcauuguugcauuaagcuuuuuuaauaaaggaaaauuauggaaagaaaauagguaacaccagcaaauuauauauugacauugacaagucuaaacauauauauacuuauauauguaaaacacauccauaucuauacaaauaaucaucuaguucuuacugucaucuuacugaaaggaacaaagccucuaaggaucaccaguucugagaagcucuuggaaaucucuaugucuaagugauuguauuagaucagcaauaaugacuauguaaucucaaaaaauaaaguauucuuaaaacugaucuguguccugagaauaccacuuaauucugugaacuaugaauucagagaugagagauaugugggcaaaaaauaacaaggauaccugccguaggaugaagaugugaaaagcugaugcaguuaccagcagguguguuggagugaccaucacccugagagucuuguuuuacacugagacacugcuaacaaauaccuugucucuccccgaacaccacgccuugacccacagcuggcuauguauaaggagcacaccucugaaccacaaccuugaggaggagaagacugugagauucagauuuuaaaaaacaaaacaaaaaccuaaaguauggaucuaggucacccaauuccacuguguuaccuggagucugucauauccagccauaggaaagaaggaaaagaaaagggucagguagagauuuaucuuuuaaaucauacuagaauaugaguccaguugccuguucugucucaaagaugacccaaguucaauucccaacacccacccauauguuagcucaccaguaucuuacuccagcuucuagugagccaacauccucugcugacacugcaauauacucuuaaaaaaauaauaaaaaaaaaaaaaggaaggagagagacugcuuaaagacacuggugcacacugauuacuacauaaccccagguccaggcacuauauagccucugcuguaucgugugccucaugugcucuguuuuauccugucugccuacuagucuagaaacacaguacuugaagacuuccugcaacauauuuuuaggcugucuuagugccagguaccaucuauuuaauggaguauuuuaucuuugugaauuagcaugcuuaaauagggaaaggaguguguuuugucucuaauuauuccuauuuuuaccaucaacauuccaucagaagccugaguuuggaaguaaaaaccugggacaagggaauuugguagcauaguguugugggaguuuuuuuauuauuauuaauauuauuguuuaaagguguugcuuucaauuauguaucuguguauggauaugugcaucugagugcaggugccuguggaagccagaauuaccuacagaugguugugagccaccugauguaggugcuggaaacugaaaucagguucucuggaagagcaucgagugcucuuaaccacugaugcaucuauauacuagcuccaguaguccagauuucaaaauacuggcagcaucaaccagccugacauuaccucccagguauacuucugguuguuucugugaccaaggauauucaugauugucacucuuugguaaauaagcugaauggccuacaguuucaaaguuuucaguugauugaaguuucuuaugacuucauccaguuuuucccccagacaucuuccacuucaugacaaguucugaauaucuaucugggcuuaucuugagcagauagagguccagucuuugcuguuuuaccauucacuagaaaaagauuacauucugauucuuagagaucuucacauuuucaauucccaucucugaaagcaaagccagauggagcucuaggcucaguuaccuuuagauagaagccaacgggagaagaccuccucagugccacuccaaacacaucagucuuugcccuagggauaaacaggaaaaggaagaaagccucaaaaggagacccugugaggauguuccugaccagcugggaucacaggaaaaucauuucugggacugucaauccuaaguggcaauugacugcuuaagacaacagguacacaaagaacagagagcuagacaaagaacucuuuaguaagaaacccaaugggcuuugcuauggcaagggugucgcacugaagcaggcauaaccuaagcauggauuguggauuuuaauguagauuguacauuuuuaagaguuuuaacaaauuauacccugaaaaauuccaaaaucaaguaguuugugccuugagccaaagacuuucuuggaaauaaauucacaugaguuuauuuacaaagccaagauauugcaacaggagauuuuugcucuccaggggauauauugcaauguuuaaaggcauuuuugguugucauaacuaaagggaaaaugcugcuggcaucuguuggggacagccaaaagcucuacugaacagcuuaaaacauauggacacucugccuuaauuuuucuguccaaaauguuaauacaccauagauugugacccccuguguuaaacauacagaaaugugguaugcaaaaccaaugaagaaccaggcuuaguggugcacaccuguaaccccagaacuuuggagacaggaagaucaggaguucaaggucaucuucacuuaaaccaugguuuaagccagccugagcuacaugagacugugacucaaaaaauaaacaacaacaacaacaaaaaaccacaacggggguuggggauuaagcucagugguagagcgcuugccuagcaagcucaaggcccuggguucaguccucagcucuagggaaaaaaaaucacaaugaagcuugacccuacgaagaagcuuacauccacaguggcguaggagugggacuggaagacuggugaaauguuggggaccaugaaaaguacccagaaaucuccaaagaauauggucuugguugauguccuccuucccccuaucaccugccaacuagcagaaagguaaagaagaaaaaaguugagggccuggggaaauggcucagucauuaaaaccacaaauugcucuugcagaggagcugagaugguggcucccaaccaucuguaacucgagucccaggacaucuucccucuucuagccuccaugggcaccaggaagcauuugcugcacagacaaaagacucauaugcauaaauaauauauuuuuuuaaagaaaugggguuaagaucuguacaaagucucaugucuguaguuccaguacucaggaggaugaaggaggguuaccauggcuaggcuacauaguucuaggcuauucugagcuacaaugugaaaccaugucuaaaaaagaauggaauuauuccuaagaaaaggagaaauaauuccauugguugagaagaauacaguacuagaauuugggaucccagcaaaguugguuugauagcaacauaccuaauacaguuaggaggaucaaaaaaaaaaaaaaauguagagaaguaggagucaucuuaaagaucaguagcugugcuggcugguuuugugcaaaccugacaccagaaagagucauuuuggaagagggaauuuccauugaggaaaaacaccccagcagucugaccugugugugcgcaaguuuauggggcauuuucuuggcugaugguugauguggaagggccuggcucacuguaagcaguuguauuaaaaagcgaggagggacaagccagaaagcacaguuccugcuucccuagguaaugagcuguaggcuaucagaugaaacaaacccucucuuacccaaguuacuuuuggucauggauuuuuaucacagcaauugaaacgccaagacugaaguaaaccaagugaacggaaguuucuucuauagagcagcauacuuaccacacugagacaagacuuaauguaauccuuggguguucucugugcuucagaauuuccucaucaauaaaaacuggauucgu

SEQ ID NO: 2878 - RNA, 1740 nt, Mus musculus
cuuacuuuuuuauuuuuauuaaauagagccuugguuugcuaacaggugcacuucggagcacccauaacagcauccaguacggaaaggggcccuuuagaaauguuggucuaaggaacgagagaauaaauuaccauauugcuuuguaccaaaguuccccguuuacagaucugguuggggcuuugaaacagagaaacaaagcgcauuucagagaggggucgaggcgacuacgcaaaggcgcgccgaguaaaaugugggggagccgcuuuggagcggaggucucaguuccccgcgcucggcuccgagcggagggcuccuucggauuagcaaccaucuugggcggcaugaaccacuucgccgccgcguccgcgacuugcucagccgguugcccuccugguccgggccccggccagcgcugccgagccgcaccagaggccgacgaggcggccgggggucucagagagcgccgccgagagcccccuccccggagccgcagagccgugcuggccucgccaucauggcggucuccgggcggggaagccgagccgugcgucgcgugcgugccuccucccuccccucccccuccucggcggcggcggcggcggcagaggcggcagcgcucgccauugccgcugguggcaggaggcugcgaggagccggcgcggucgcagucuccacggcgcaggcccacgguagcgcagccgcucugaggugagugcccuaccgcgcaaucuccagcuauuucagccccggcgcagccgcaacacgccgcccgcccgccggccggccggcccgccccgcagccggcacccugccgcccccggcucggggccugggcccccgccggauucggccugccuggggcggggggcccgggcccgggcccggcccagccaaaccgccaccccgaggaugcgcaggccgcacuaggccccgggcguccuggcgggcucgguagggaggcggcugcccucccgagagccccaggguuccggccuccccuaccgccucggguucucccggccgcggccuccuccgcgccguggaaccccgggccuggucuuccuucugcgggcucgggagccggcggcccgggagagcgcgccgggcccgggagcgggaggugggugggcugcgcgggaccggagcggcggcucggcgcucgcccccucggcucuucccggcucuggcccgccgguggcucggugcggccgggcggggcgcgggaguggcugucucuggcgggagaggaggcuggugguucggccgggcgaccuccgaagcuucccucccgccgggguggcgugggaugguuacccagguggacuggggggcgcugaauauggcgcgcugcccaccuucuugcaaguugugaggaggcgccuaggcggcaguucgaggaggaggaggagggcgcaaaguccuuuuguacgcagaaauaaggagcgacauuguguuuuuccucuccggcggagauacccaccgaggggccuggguucuuccugggacuggcgugguggucuccgggggacaggagggggagguggcgcaccccuuaagaaggaacggagccuuugccucggauaaaacagggggucugggguggucuugugcuugauucucucccacaucucccaggcuuucguggauucguggguuugccauugcauguucuguagugauguccacuguuucucaccuguugugucguugcugcuggccccaaacuuuguucggugcauc

SEQ ID NO: 2879 - RNA, 105473 nt, Mus musculus
ccucggcggcggcggcggcggcagaggcggcagcgcucgccauugccgcugguggcaggaggcugcgaggagccggcgcggucgcagucuccacggcgcaggcccacgguagcgcagccgcucugaggugagugcccuaccgcgcaaucuccagcuauuucagccccggcgcagccgcaacacgccgcccgcccgccggccggccggcccgccccgcagccggcacccugccgcccccggcucggggccugggcccccgccggauucggccugccuggggcggggggcccgggcccgggcccggcccagccaaaccgccaccccgaggaugcgcaggccgcacuaggccccgggcguccuggcgggcucgguagggaggcggcugcccucccgagagccccaggguuccggccuccccuaccgccucggguucucccggccgcggccuccuccgcgccguggaaccccgggccuggucuuccuucugcgggcucgggagccggcggcccgggagagcgcgccgggcccgggagcgggaggugggugggcugcgcgggaccggagcggcggcucggcgcucgcccccucggcucuucccggcucuggcccgccgguggcucggugcggccgggcggggcgcgggaguggcugucucuggcgggagaggaggcuggugguucggccgggcgaccuccgaagcuucccucccgccgggguggcgugggaugguuacccagguggacuggggggcgcugaauauggcgcgcugcccaccuucuugcaaguugugaggaggcgccuaggcggcaguucgaggaggaggaggagggcgcaaaguccuuuuguacgcagaaauaaggagcgacauuguguuuuuccucuccggcggagauacccaccgaggggccuggguucuuccugggacuggcgugguggucuccgggggacaggagggggagguggcgcaccccuuaagaaggaacggagccuuugccucggauaaaacagggggucugggguggucuugugcuugauucucucccacaucucccaggcuuucguggauucguggguuugccauugcauguucuguagugauguccacuguuucucaccuguugugucguugcugcuggccccaaacuuuguucggugcaucugacuacccaccagaacuugaaaauguuaaacauacauuaauguuguuagagcuucaaaggcuaucugcucugaccaguuggaggagcuguuagcaggucauccccaucuucccugccauuaaaguaucuuguacugaugauggcuuauguuagaguugguaucgguugggccgauuuuuuuuuuuuuuuaaguaggcaaagcaaaacuuccauuuuaguguuuaaaucuccauuuauuggagaaaguuggugggagugaaccugucaguugggacagugcucuguaggagaauggggacagcuuuuguccuuggaggagugguccuuuuugguccuuuuuccaaucuucggcagauccuuuuaaaugccuuuuccuuuagucauaaacaguaaguuaauggauuguuccucacuccggggaagagaagaggggugacauauauauuaaaugaguguugauuuugcuuuuucauuuaguuauguccugacucccuaacauuguuugaaaguucuugacaaguuacccuauaaaguaguagaaauauggcuaguuaaugaguacaaaguaaguguauaaucgucauguguaaugugauguagugacuuaauuugggugcagacuuaacuguaauuuguugaguguagauuuuugggaagguguuacccuuccucuuuauuuuuuugugcuuugcuggggaaucuaacagggcauuggccaugcagaccguuugcugcugaaauacauuggcagccuuuuguuguuuguuuguuugccugauaggaauucgacuguugcuaacaauuggguaccuaacccacaucgaaacaaaacaauagucuuuuagcccacuuuauuuaaaaucuugauuucauuauaaucucaaacucagcauacagaaggggagaagaauuuuugucuacuagugagugguuuauauucucauuuaaccagaaccagccaacucaaauuagguguuuucacaaaaauaccggaauuauagaaggauuauaaaagggauuuccauuucccucgacacucauacauauuucagugggaccuaagguuguggguuuucuguuuuauuaagguauaauuacacacccguugcuaauuuaguuagggaggugaaggccaacaauccugugauuuaaauuugugaauugucuuugcugauguacuacauuuuuaaccagaccuggcuugucuguacaaagcauuuuauaggaaacaaaagcaagcauguaccuuuuaagggaaaauuaagguucuuguguguguauguauauauauauugacaauguguagccuugguuauccugaaacuugccuuguagaucagacuggccucaaaggaucugccugccucugccucuagagugcugggacuaaagguguguaccacuccacccagcuggcauuuuauaucuuuuuauuugcaauaagacauuuaguaaauguuggaauaauagugacgaugaacagcaauuacugaaguuggguuuuguuucugaacaaaaaaaucagcauagaaaggcauguugauuuauuuuugcuuaggauggagguggugggagauaaacuguuagucuugagaaguagacuccaggaagcgaaccugucaacuccugucagguucuuagacacgcucagugcuccacacugacacacacuugcucaccuacucaaacuuggaggugugccguuguacuucacaaacgucugcucucuccuccugacuugggaaguuucgucucuccaaaaauggcaucuuuuacuuuagguguuugugacuggaugaugcugauuauauauacauguacguauauguaugugugcaugacuauaauuugaaagaucaaucucacgccagccuguuugggaccuggugguauauaucagugguagagugugugcuuaacuugaggaaggcacuugauucaaucacuaucaaggaggaggaagaaguaguagaaguagguuguuuagaaaucuagugauuuuuuuuuucugccuguguauuaugacaucacuucuuauuugugaguguuuggccugcauauaugucucuguacuacuugcaugucuagugcuaguaaaagucagaaaagggcaucacacccuuggaguuggaguggcaggcaguugugcaugugaguacugagaacuaauuggguccucuggaauccacaagagagcaccauccccuggagcugaaguuagcgggugcuccugaucuacccagcaagaguaaugugcugggaaguggucugugcugcuuuggaagaguaggcagugcucuaaacggcugagccaucucucuagccuguuuuuguuuguuuggauuuuccuuuuuaaugugcauugguguuuugcugcguguaugucuauggaaggguguuaguuucuagaguuaacagauaguugugaguugcccugugggugcugggauuugaaccuagguccucuggaagaacagucggugcucuugaccacugagccauccccagcccccaaaacuguuuuguguuguuuugauguauaugaguguucugucugcauguacacuuacugcaugccaggguuggggcaccaaaucccauuacagaugguugugagccaccaagugguugcugggacuugaacucaggaccucuggaagagcagacaaugauuguaaccacugaaccaucucucuaaccuuuguuuuguuuuguuuuuguuuuuagauaaggauuuguguaucccaggcuggccuagcacuuguaguugagguugacauugaacuucuucuaaaucuucugcuacuaccuuccagauguugggauuaaaggcacguacauuuuugcaugguuaagcaaguacuuuaaacaguugagcuacauccuagcucuuaguuaauacuuauccaucauuauucuaaggugaacaggcuggaagggaaauagaguugaaacaaacugagugaguauagguauuuucagaccacagcuauacuaaacuguuggaaacuuugacucuuauagcaauaagaaugcuuugaaguuaauuaauguaauauggugaaaaucauugagaaagugauuuuuuuuuuuuucgagacaggguuucucuguguagccuuggcuguccugaaacucacucuguagaccaggcuggccuugaacucagaaauccgccugccucugccucccaagugcugggauuaaaggugggugccaccaccgcccagcgagaaaguaaaauuuuggacucugccaggaaauuaaauggauuauaccuuuaccccauacaguucagaauuaggcuacugucugucagucucucucuuggauguacuuagcaagauuugaggcuucaucaugagguggucaugccuuagcuguccuaauguguucacacuuaauagacauuaaaccacuuuugaacugaagaaaaacuaaauguuuaacuuuuuggagauacuuacacacauuuaaaaaaaaaaaccaaaacaaguuccauguggcugacuuacugcaugcugucccuuaagacacucaucagggucuuagaagaucacccugacagaggggucuccuguuuugccuagcucagaguuuugugcuuaaaacuucgccugcuaccacagcaucacauaauuucuugauguaggcaaagccauauuuaguaagggccuguguuuguaggcaucugugugcaugauuagauugaucacugauuuuaggagggagaauaauuuuucaaagaagcuacaggagcuauucuuuguaugggucaucugcucggugauuucagcuacuuguggaaauuguuuugcuugguauauaggugacguauguauucaggcuugcgucaacaagauggcucaguagguaaauauauauuuuuuuaaguuuagucuuuguuucagaugugcaaaguuuggcuaauaaucuaaguagauauuuucuuggcaucuuuuuaagcagugccuguuggauaaacuauacugagccuuuuccagaaugccuucgaagagugagcuuuguaugcauuuguucagaccauguuuuaaggagccuacacuuuacuguuggcauuguaagcuuuuuagaacuuaggagagugcugcuguugcugcugcugcauguuaauguggucaggcuggcagcuaaccuacaaagaacaagaggaagugaggaaaugucucugcaaaacacugcuuaaagcuauuuaagcaguggacuagaaauggggagcaggaaacacagagcuggauucuuguuuuauguuugaaagugggugaggccauguccuccauugaggauuuaagccccuugaguguguccucacuuucagaguuuugcccuugucaaacauuaaagaugaguuucuaggcccuuacaagauaccugagucacaaaauuugggccuuauauuggaguggaaaaaugagcuugacucuucuauaacuuguagaaaauaagaaaggguaaaaaaaagggaggaauuaguuuuuggggagggaccaugacaaagggaaaacaaauuagggaggguuauguguauuaaguagagucucaggacuuacagacaggagggaggccagcagucaugcaccuugagaaacagcaaguggauuuaacuuguacuuggaguguggaagacaaaguuuucuugggaaaguuugggaaguugguaaucagcacucacgagugcagcauaggucucaucucuaggccugcggcggggguggggggugcuaaggcauucaggagaucuagcauucuguccauaacuuuguacugguggugcugaguguugaguccuagcccuuggaccugcuggucaagcacugugccacucagcagcaucucuaguacucacuggguuuuuaaagauugacacgaacauuagauuggaaauguuugagacuuugggguuguacugucacuggagacaauugcuggggacuaugugauuugugugaccauugacuauaaggaguuaggucuguaauccaguuaguggauguucucccuuaagguagagaacauguaagaacaacuagauuggaggaagaauguagugugcugagcucugugggaauugacuguaacucaaggagauuugggaauggagcagauugaugauuuucacucaucaacuaaugucacagagaauugugagauguacaaucaagagugaagaaaaaaacacuuuuuaaaaagacuuauuuauuauauguaaguacacuguggcugucuucagacacuccagaagagggcaucagauuucauuaugguugguuaugagccaccaugugguugcugggauuugaacucaagaccuucagaagaacagucagugcucuuaacugcugagccaucucaucucuccagcccccgggaaaaaaaaaaaaccaaacaaacaaacaaaaaaaacaaaacacuuuuaagaaagauuuauggggcuggugagauggcucaguggguaagagcauccgacugcucuuccgaagguccggaguucaaaucccagcaaccacaugguggcucacaaucaucugucaugggaucugaugcccucuucaggugugucugaagacagcuacaguguacuuacguauaauaaauaaacaaacaaacaaaucuuuacaaaaaaggaaagauuuaugugcauaugugaguuuaugugccccacauuuacgugaaugcucccagaggucaaaagaggaugucaugaacuuagccaugugaaauacuauagagaauucauugggauaagagcgagauuuggcauuucagaaguaaaaaguugaguuguuaagauggcucagcaaguaaaggcccuggcagccugaguucaauuccuaggacccacauggugaaaagacagagcugaccccacagauuguccuuugaccugugugcaugcacagccauacaucaugauaccugcauguccccuacuccacucaaagcuaauaaaauuguaggagagaaaaagucuucuguaauauauguguguuauuuugccagaucucuuaaaauauaaguuuaucuuggcuuuaagacuuaggcuagauacaguuuauaaaguuuuuaguucuggaguucagggauguauucuaacugugugacuccaugucuugaaauuacauacagaauuuugugugugugccuauuugauauuucugggguggggcccagucucacuuuucugagauucuugggggcugucaagacaagagucaggggccuuuucaguaauguuaaugaggaaguccagcggugguuguguuguuaguuggcugaaauagguuccagggaaggauuucgaguggaugucuaacugagcuuugcugaggcacuucuuagauagacggagaggagcacuuaguggagggaggguuggagaacagagcagagcuuaggcagaaauuggccgauuccuuguagguuuuauuguucaagacucgcacuagugucagacuguucaugcacaguagauacaguuaggcucugggaggggucaguaaaggaaaaauagguuuuguuuuuugggucuuuuuuuuuuuuuuuuuugguuuuucgagacaggguuucucuguguagcccuggcuguccugaaacucacucuguagaccaggcuggccucgaacucagaaauccaccugccucugccucccgaaugcugagauuaaaggccugugccaccacacccgguagaaaaauagguuuuuuuuuuuuuaaagauuuauuauauguaaguacacuguagcugucuucagacacaccagaagagggagucagaucucguuacggaugguugugagccaccaugugguugcugggauuugaacucugaaccuuuggaagagcagucgggugcucuuaccugcugagccaucucaccagcccaauaggcuuuuaaagaaagaaaacaaauugguucacagauuguguucagagaaaaaagugauucuaaguaaaaaaucacuuuucuuuuuauuuacuuuuuguuuuucaagagggauuuucuguguagcauugacuguccuggaacucacuuuagacuaggcuggccuuaacucagagaucugccugucucugccaccucaaaagcugggauuagccgggcagugguggcuuaagccuuuaaucccagcacuugggagacagaggcagguggauuucugaguucgaggccaaccuggccuacaaagugaguucuaggacagccagggcuacacagagaaacccugucucaaaaaacaaaacaaaaaaacaaaaacaaacccuauuguucuguuuuguuagagccuuugagacauaacuguagaacagaaugcuuugauauuccagacaguucagugcugacgcauugccuaguguucauauuuaaagucauggaugaaauacaugcauucaaacauacuccuuacaaauaaacauucuaagcuguguguguuggcagaugcacuggagaggcagaggcaggcgaaucucuguagguuccgggcuagccuauucuacccagugacuacauacagaggcccugucucaaaaaauagaaauagaaauauauaagccauuaaaaaaaaccaaauugcuuguuucccagaguaguucauucugaaauuuuagauaacuacucauuuuuuguuuuuuacucaaaucuuuggccuuuaaaauuagauuaggagacaauuuuuaaucacuuccuaguuucugggugguaauuucuauaaauucauuuauucauucauucauucacucauucacucauucaguggugcugggauacugaacccaggauauuguucuugcuagacaagucuucuaccuauaagccaugcccuuaucccuuaaucuucacacugauugccacguucacagucaauacugguugacauuguuuauaggcuauccugcagaaauaguugguaaaugcaggaauaacggguaaggauauguuggguaauaugaaacagauaaaguuuaugguacacaacuugugauuaguuuguguugauugcuuuuaaauuaaacacaugauaauacuuauucagcgaugcagucauacugauuuaacuguaaacaguguguaguauuucauuaguacaguuagcaccacaaacauuuuuucuuuguguuguaaaccuucaacaucuuuuuccuaccuauuaguuaugguugcuauaccaugcuguagaacacgagaacuuaaugcuaacuguauuuuuguacauguuaaccaaccuuuguguauccuuuuugucacuacccucccucuggaaaccacugccuccugcauacuagugagaacauguggugccuuccugugccuggcuuccuucacuuguuauaacaggucaugcauauugcuguaaaguggaccauuguaugcgcuaaucuacaacaagaauccgaauagaagaaaacuauuugcuauguucuuuaggucuuacuccuccuuuguucucucuguccuucccucccucccuuccuccaccccuccccacgcucuuucucuguaguuaugaaauaaaagguuuagcgauaaauuuuccauauaaaauagccuacauauuaaagaaucagccagggcuugcuuagguguaccaucucugaacacugucuuggcuugcaaugggcuuuuugguuuuaaaucugaguaagaaaugaucuaguguauugcuuguuuugugacuguugaaguuucugccucugauuuuuggcuuuauaaauuucuucuaaauaaaaguuacuuuaaaaaugaaucugagucuguuauauuaauaacuacugaauauaaaaauacauauaauauguauucacuauagaaaaguaaaaggaaaucuaaccuugccauguaaagaacauuuuuuuuuuuuuuuccgagacaggguuucucuguauagcucuggcuguccuggaacucacucuguagaccaggcuggccucgaacucagaaauccaccugccucugucucccaagugcugggauuaaaggcgugcgccaccacugccuggccguggcaccaauuuuuuuuuuaagauuuauuuauuuauuuaauguaugugaguacacuguagcuguacagaugguugugagccaucacguggucgcugggaauugaccccagaccucugcucguucuggccccgcacgcuccaacucugcucacaacagcccaaagauuuaguauauauaaguacacuguagcugucuucagacacaccagaagagggcaucagaucucacuacggaugacugugagccaccaugugguugcugggauuugaacucaggaccuuuggaagagcagucagugcucuuaaccgcugagccaucucaccagccuguggcaccaauuuuuuuaaaaaauauuuauuuauuauauguaaguacacuguagcugucuucagacacuccagaagagggcaucagaucucauuauggaugguugugagccaccaugugguuauugggauuugaacucgggaccuuuggaagagcagacagugcucuugaccgcucagccaucucuccagccccgugacagcaauuauaguagugcuaaagagucaacuuuguccuuccaagaaagcauuaucucuggauaguuuaaauacuaaaauacaagaauauuuuugcaaaaaucuauauaauccauguucucccccaaugaaauguguucuaucuuuucguuuuagauaaagagugacuggucucucucagagucuccuuucauaaagguuuuacguagagaaucuucuuaaguauaguaauguaaccuaaccuguuuuaacccuguaguaguuuaugguugacuagaugcuuguuucuuuguaagacaaggacucuucugugucguuuugucuguuuuggaacucccucuagacccggcuggccuugagcucagacauucucuugccucugugucucaagugcuggcauuaaagguguaugucaccacaccugacugguuuuuuuucuuuguacaaaauacaaacaaaugcuggguaaauaacuaguaagcuaauguaauuaguaucuaaaguaauucuuacucaggucuaguuaugccccaauugccugucuauccaucuauucaugcauccauccgucugcuauuuuucuuucauuuacucauuuauucauuggcagggugucucuagguagccccaguugucccagaacuuacuauguagcccaggcuguuacaucuuuugaagacaggaacauacuguaauaaaugcacccuuaguuuugcuuuuagaaauuucauggcuaugcaccuagaugauauggaagacuuuauuguaauacacaaaauaccacaagcaguuuaacaacaacccaaaaagaggugcaguaaaaauacagccuaaaggauuuuuuaaguguauuguaaagcacuuaaccaugaauggcauuugugagacuggagauuaguuguucuguaccuaguuagucauuaguaauuuugugcaaaggccuagguauugcuguaccuuacuggaguuuuuugaauaaauggugugcacuuaaacuaggcuaaacuuaggaagagaauuucuucgauauguguuuacugcaacuuuuuaaaaacuuuugggcgcucuuaucacucuuagcuuaaaacaaacauauuaagcagggcauuguaacgaaugccuguaaucccagcacacaggaggcagagacaggaggauugauguaaauuugaagcaaacuggaucuguguagugaguuuaaggcuagucaggacuaccuaaugggacacuccaagcccaaagaagcgaccccuuccauugaguauacaguauuuuauaccugucccacucaccuacugucaaauuuuaaguauuuuagagcguuauuguuuaaaacacauaaaagcugaacaugguagcacaaucuugucuuugcauccuguggcagcuacagaaggauuagaaguucaaggucaaccugagcuguaguggaauccaagaccaaugugggcuauaugagaugcugucucaguaaauucagacaaauguauucuaaucuaaagcagugguucucaaccuuccuaaugcugugguuguuuaacguaguuccucauguagugaccucaaccauaaaauuauuuuuauuauuuuuuguuuuuguguuauuauccuuuuuuuuuuuuaccuucuuguuuguuuguuuguuuuguuuuguuacuaaaugcacagguugggagccacuaguugcacagguucacaguagugucacuggcauccaccucuaccuuuuguuccacuugaacguccaggagcuguugucuuguaaugacaaagcugccuucuggaucuuuggaucugcuagaggcccugagaaagauagaaaguugauaagcagaaaauacaauaaggucgauuacucaauuagcaaaauaucuuuuggcauuaggaucacaucagauaugcuuauuuuauaagacauaaaaauguaaaauuacaucaguuuuacacacacacuuagaaaagacugaaaaaugaagguguuuggguauagccccuggggaaaugcuagagagcugagggcagagggaacagcagcuggaguugaggaagcauggcugcuacagaaugagguuugucuuuguccucaccuuguuggggauaugaucaggucugugcagggcugggcuugcuggcaccugccugcaacuccagcauacucggaggcaagaagauuggcguuuugaggcuggcuagggugaucucuugucucaaaaaaaaaaaaaaaaaaaaaaaaaaaucagaguguuugguaugaacacuuuuugaggcagaggcaggcagaucucgugaguuuagggccagucuugucugcauauggaguucuaggccugccagagcuacaucgugagaucugucucaaacaacaaaaccagagagguagagguagcaaguaaaguugugucauaauuaggauaggcuuauaauuaauaauauccuggaaaaguucugugcuucuuccaggucaauacuuagccccuaaccuaguuuaccaagucuuggaguuauuuguaucauugcagaagucucacaaaaugcauuugaaauaauuuacuuuucuggguaccaucuaauauuguauaacuuaaggaacccaugguaaaagauucaaaaagcauuuccucaaaguugaagacuucaucccacuuugagcagcuccauugacaguuaagucuaacugcugcuucuccagcccaguguuuccuuagaggcggaucucaagcuuuauacacagaacggacauuuaaugcaugugauagucuaaccuuuaaacaggacagugcucaccaguacaguuuggugguagccuuauguccauccaggcagccugauuggagagcaggguuucuacugcugcugugacaaugaugugagcaaacagaacuuagauagcaugucucaguacuucacacgaugaaauagcuaaauacaguuugauaauacaaugaugugagcaaacagaacuuagauagcaugucucaguacuucacacgaugaaauagcuaaauacaguuugauaauccuucgauuucaagccuuguuagguuucuauuagugucuucuucuuuuuuuuuuuuuuugucuaauuauguaaggugacuucucaaguaggauggacugaucaggaaagcaaacacgaauuuaaauuuuggugggucauuauguugauuuguuagucuuuugauaaaggaccauaggaaguaaaaugugaaaaagagugguuauaguggguaaauuguuauuucauccgcacagaaauaaaguggacaccacuacacuugacucuaaguuuuugugguuuuauuuuuuguuuuuuuuuguuuuuuguuuuuuguauuucaagacaggguuucuuauguagccuggcuguguuggaacucugccucugccuccgaagugcugagauuaaagaugugcaucaccuccacccagcuaguuuugcugauguaaaacauuauuuuguuggguuuuuuaacuuugcauuuugucuuaaguugauucuauaucauugccacauguugaggcccaguaaguuaaaucuuaaaccuugacuaaauuaaaaguguguguguguguguguguguguguguguguguguguguguuuaaagacuuacuuauuuauuauguaaguacacuguagcugucuucagacacaccagaagagggcgccagaucucauuacagaugguugugagccaccaugugguugcugggauuugaacucaggacuuucagaacagcagucagugcucuuaaucgcugagccaucucuccagccacuaaaaauguuuuauauugagaagaacuuuauauuauaaaauggcaguuccaguaagaucaccagugggugcaagccugagcuggauugucccuagguccccuugggaaaggagagaaccaacucccuaaaguuaucaccuccucauggacacuguggcacauguccaaacuuagaacacaucacacauacacauauacacaacggggagagagagaguggguaugcacaagaauuagcugggccuggcuacauacccucagccuuugggaggcggaggcagaaggaggucagggucauccuugccuuaaguccaaggcuauccuaggcuacaccagggcuuggcuuuccuuuuuccuuccuuccuucccuuauuuccugaccccuaccccuuccuuucccuuugccccuugcccuuucauugcccuggcuagcauggaauucacuauguagccaaccccaaacucuuggugagccugcuuaagccugaaggugcaaagacuacaggcagaagcugugaugcccggcugagaauccuaagggaaaggugcuuugaguggacuggggccuuaaccacggaggaacagcuacagucuacaagaugauaaagauuuuuaaaucuaccauccuaagauaacuguuuccuugguuguguguguguguguguguguguguguauguguguguuguuuucauuuaauacaaaaggcauuugguuuuauggauuauguaaaauuggaaaauagucacauacagcuguaaucuaauuuuuguugaaaagguaaaagaaaacaaaggaauauucccauaugagacaugccuaguaaauguaccaaauauugagugugugauuauaaagacaucauauaacagcaucuaagaaguuaggugaugggcuggagagguggcucagaaguuacgacuacucuuccagagguccugaguucaaaucccagcaacugcaugguggcucacaaccaucuguagugagauuugauggccuuuucugaugugucagaagacagcuacaguguacuuagguauaauaaauaaauaaauaaauaaauaaauaaauaaauaaauuuuuaaaaggugauauugcuuagcauauuuuaaauuuuuuucugaggggugggagucagcucagaggguaaaacuauuuggcacaucagucugaccugaguucaauccccagaacccaccaaaaaaagccagauguggugaucuacaucugucacccaagcacuucuauggugagaugguagauagagauaagaaaauacccuggaagguugcuggccaacuagucuggaguaugcagcagcguggccgagacaaugaaagccaggcagagagagaaccggcucccuaaacguugucuucugugcgagccugugcacgcaagcuuguacuuguucaucauagcacacuaacaaagcaauuuuacauuuuuuucauacgcuuuuucuaguaaacauauuuaccaaauaggugauacggaccccuuuaaauauguuaaguacuauuuugguuuuauuuuuuauuuuuuauuuaauuuuuuaauagacuggcucuuacucuggaguccuggcuggccuggagaucugccuccugagugcugauaggaaggccaucacccauaugccugacuaucuuaaggcguuuguuuguuuuuaugagaaaccaugaaaaugaaacaauacagauauuucugugcuguuaaacagggguacuauguauguauugcuuauacuuuuaucuuggcaauuugaggucacuauagaaagcaaauuacuggccuguauugggauuuccuucagggcaguaccuuuguauuaauuucucuuguacaccuuuugguuagcauuuuaucggcaggugggugccacuucaaggagagaggagaaagaccauggcauggaguuugaaguaguuuucccacuaaggcugcagugggaaagcugccagcaaccuugucucuuuaauggauaaaccggaacuacuguccugaucuuccucugucaguccauacauucauauauucagcacuaaagaauugugagcugugaauguguuuacaauuaauaaauggcgcuuuaccauuuccaguaacauacuguggacauuuuacuuaugaauaaagcacuuuguccuucgggucuugugugguauuccucugaacuaacagggcugcuacccuguugugcacagcacauggacacuguuauagagagugacauagguggucuguacaccgccacugugcucgauguguuuguaguacuccccucuugcagagauuguaguuuguauuuucuuacggaugcugucuuggcagaauugagcauaacacauuaauuccagauauuucugcaaugagaaagggaguugaccaaaugagcuaagaaaguugggcaagcagcuguugguggguugagagccaucaccuaugcccauuguggccaggaccaaaugagauuucacuugaugccucuuuuccuccuuuuacgaauuguaucaaagaacgcauugagaaaaugucaaugagaaaaauguguuauucuccccauuuucaucucccccuugucuggagacuacccuucuaaaauacuuuauuagaaccacugcagacuuugacuugucacuagggaauuuggguauuuuuuuaaauuaauguuguauaaacauguaggcacuucaggugucuuuaaacuucuaggguaacauuuuagaaauggauaccccuuuagacuuaugggucuauugcagauuaaaccaguucuacaauagaguuguucauuccaauuuuagguggucuuuuaguuuuauaaucagucacuuucuaaacuccauugccuuuacuccugcagccugcuguucuguuuucguaucuagaaaucaaacauauuuuucuuuagaccgcugugcuuuugccuugauuuuagugauauacuaaauuuauuuuuaaguaacucuagauaguuuaguuuaaugaauugcaaaguaaauguggaaauuuuaacuuuuuuuuuuuuuuuuuuuuuuuuuuuugagaaagucccuuacuauguagccguggcuggccuggaacuugauauguagaccugcuggcucuugaacucauagaaaucuaccugccucagugcugggauuaaggaguggucuaccacauccuacagaaauuuuaacuuuugaucaacuaagaaaaguucaaauuugcauuucugauacuguuuggaauucuugggagacuuuuuuuuucuuuugguauuuggaaagguuugucuuauuauuaaguaacaaaauagguacuauuuaucuaccuuaacauauuugacguguuuucuucuccaaguaauuuaaacaguucuguuucacauccauguaacaagugaguucaagggauugaauggcuuucuauucccauuugucugcuuucuuucauaauaccaguuucacaguuguguuaauucagugugguucuauuuauuacuacaaaaaguaaaccuuccuuuggaugguggcucacaucuguaauuccagcaaucauggugcagagacaagaggcuggacacacgaguuuuaggucaaccuggucuacucuggcaaguuccaacccagcccagggccacacagugagacccugaauagaaaagaaggcaaagcaacaaagaagugacaucauucagagagaagcacuuucacaggccuuucuuuuucuggcgugguguggugugguguggugugguguagcagaacagccgugguuacugcuguugcuggcgugugaagcagguauaucccugguguagaccugugauacagucccuggaagcuggaaacaagcucaaccucguacaaaacaccaaaaggagagcucaugaaagaaacuguguauuauuuuaggccuauagaaggcaauuucauacugucuaguguaauaaaauauuaaacugucuuauauauaaugcugggcagugguggcacaugccuuuaaucccagcauuuggaagacagaggcagguggauuucugaguucgaggccagccuggucuauagagugaguuccaggacagccagggcuauacagagaaacccugucucgaaaaaacaaaacaaacaaacaaaaaagccaccaaaaccugucuuauagaccucaaaaaauuaugcauauugccaagauuuuuuucugacaggauuuuuuuucugacauuuccuguuugcccaguagccaguaguuuaccucauuugucuuuucaguuuaguucugaaacagggucucaugcugcccagguuggccuugucuccucccuaugacuggccugccuccuccucagcacugggaguacaagugugugccaccaugccagguuuauacagguuuaaagaauguugaacccagggccuuaggcaugcuaggcagguacuaccagcgaagccacauccucagccuggauguccuaacauccauaaagaagaauauuugagccaauugagguauuagguaccuggaauucuagcauugcagaaguggaggccggagggcuacauagcaaagccuuguuuaaaaagaaaauaugacaaaagucauaagcaaauccaauagguuauaacuaguuuuguaaugcugcuacuuuugaaaaaguuaacagugguguuucuguaacugauuugccaagaaauuaaugguccuggaucauaaauauuaucaaccugacaggugguggugcugcacgccuuuaaucccagcacuugggaggcagaggcaggcggauuucugaguucgaggccagccuggucuacaaagugaguuccaggacagccagggcuacacagagaaacccugucucgaaaaaccaaaaccaaaaccaaacaaaaaacaaagauuaucauaaugcuuuucacuggguagacggucuucaauagugcgaacaagaaaggucaccucaguccaguguaaugacacucuguccuuccggcccuuguggcauauguauauguucggcccucuuguccaccuggugacuccaguacagcugcuagugacccuuuugcuucagauggccagugaggaaagggcaauucuuaauuauagucuucagaaacagaacagaaauaacuuuuuucucaaagcuguuuacaaaaagccaucaguugucauucugcuuaauguuuccccuuagaaguuagcaucauaacucgugacauucacuccagcucaaaaacugacuguugaguucuuugagcugccaaauaaaaccucugggagucugggacugcagauguuccugguuccaaucccugucacuaaaaagaagcaaaguauuucaaaauagaaauaagaaauagcaugggaacuaaacccacuuuaacugcucuuuuacugucuuucaucaaaucaucaggaaaucuuggcagcuuugccaccaaaaacucgacagugucucacaaccucugcugcugcucccuggucuaagucagguucaugucuuaguaguagccuuauaguaauuccagucuccacccuccuucagccugauccuuuuacacaucaucacagugaccauuaaaaacagaaauuagaaaauuagauugugcuggauagucguauguuagcuagacagaaauaaguuaccugagaggaagacaccucaguuaagaaaaugccuuccuaagacugggcuguaggcaagccucuaggacaucuucuuagugauugaugggggagggcccagcccaugugagugaugucauuccuccacugguaguccuguguucuauaagaaagcaggcugagcuagcuagccauggggagucaacagcaucccuccacagcuucuguccugacuuccuucaugauaaacagugauggagaaguguaagccagauaaacccuuuccucuccaacuugcuuuuuggucauaguguauuaucacagggauagaaaucuaagcuaagacauagaugauaacuguacucauaaaaaucuuccaaagacuuuccaucucacucugaaguccaaggaucuuaccuacccacaaguuuugaucccugguguugcuucuguugucucaccugccaccccuguccacauguaggguccauuuugcuguccugcuauccauaccagggacacaccagagaacuagaguuuggugcccagauccauauaaauacuaggugccacuuguaaugccagccucagaaagugaagacaagggccgggcggugguggcccaugccuuuaaucaggccagccuggucuauagagugaguuccaggacagccagagcuacacagagaaaaggaaaggaaaggaaaggaaaggaaaggaaaggaaaggaaaggaaaggaagacaacuggagacaaggagugcccaaugcaagcuggcuggugagacuagucagaccuccaagcuaugaguuugauagacucugccucagugaauaaggggugagaacaaucagaagaugaguuaagaccuuggacuugggggcuggugagcuggcucagugauuaagagugccgacugcucuuccaaagguccugaguucaaaucccagcaaccauaugguagcucacaaccauccauaacgaaaucugaugcucucuucuggagugucugaagacacauuacaguguauuuacauauaauaaauaaauauuuuaaaaaaagacauugaacuuggcccuccaggggcacgugcacauacacaugcacacgugcacacaccccucaaacacaugcauaacauacagaaaaauggagagcuggaggagggacauuguuugagcaucacacaacacucucugcucucacuugcuuuuuuguuuuauuauuacuuuuugggcuggagagauggcucagcagguaagagcacggacugcucuuccaaagguccugaguucaaauuccagcaaccacaugguggcucacaaccaucuguaaugagaucugacgaccucuucuggugcgucugaagacagcuacaguguacuuauguauaaaaauaaaucgccgggcagugguggcgcacaccuuugaucccagcacuugggaggcagaggcaggcagauuucugaguucgaggccaaccuagucuacagagugaguuccaggacagccagggcuauacagagaaacccugucuugaaaaaccaagaaaaaaaaauauuauuacuuuucuucuugguacuuaacuguaccuaaaauuauuguauguguuuauugcuagccucugccucuguaaggugaaagccaagaggucaggggcagguugguucacaucaguguuagugaauguaugaaacuuugguaaguuacuguucuuuauuuccuuuauggaacucggauauguugaucucuugccuuuuggcuuugcaauacuacacuauugucuucugcuucucauuuuccuuuuacauauuuuuuucuuaccuuuuaaugaccucuuaauugucccccaaguuuuuuugcuauuuacccuuuuuuuuuaaagaauuacuuauuuuauguguaugaguacauuucuucagacacaccagaagagggcaucggaucccauuacagauggcugugagcuaccauguaguugcugggaauugaacucaggaucucuggagugcucuuaaccucugagccaucucuccagcccacuauuuacuuacuugguuugguuuaauuuuuauucuauuuuauuucugagaagaggucacuauguagcccuggcuggucuggaacucaccaaauagaccaggauggucuuacauucacagagauuugaaugccucugccuuuugggugaugagauuaaaggcauauucacccacacuuggcuuuuagagucuuguuuucucaauuuuuauuuuacuuauuuuauuuuauuuguuuguuuuuugaaguagguaucaaucguucuugagcccaggcuggccuggagcccuuggcaguccuccugccucagcaucccaaguguucugaggaugugagcccugugguuggaguuucuucuuuuaucaucuuguuugauuuuuauucucaguuuuguucauguucucugcuucguuuaccagcuucugcugaugaguccagaacuucuaccuucauuacagacuucccccaaguuucaaaucugagucuuuugugacagugccuucagaaagcuacuaucuuccuccacaaccucuguuuaccuuucuuguuuguagucugccugagaaucacacuaacccagccagaaggagugcagucuugacuuuccucaccuucacacaucugccucuucucuaagucccuguggucagcacucacaucuuggggcuucuuguuggguuugguuuuacauuuuuagacaggguuucccuguguagcucuuccuggccugagcuggcaguguagaucaggcuagucuccagguuacagagaucugccucugccuccucagugcuagaguucaaggcaugggucaccacacccaacucuguccucauugucuuaauuaauuaaugcuccaggauccccgaggauccuugaacuagucacuugaccagcuugccuccagccucaguccuccccuuucuguaccaacuagaccguugcaaaaccccacauaacgauucagcgccucaucuucauuagcaaaggcugggacuuugaggagugccugcagucacugcagaccuguaauaguagaccagaauacauuguucucaguauauaugguacugcuuacuagcuuuuaaggaaacuaauguuuaguauagucuucucaccucauuuuaagaaaagauuugcuauuuuauaugguuggauauucaauacguauauaugcauguguuuggguauaugcuuucaaauacagcugucucugcaggugcuagaggcaacagucaaaucuuuguaauuacaggugguuguaaguuccuguuguagguacuggggacagaacuugggucuuuugcaagagcaguaugcacucuugacugaugauccauguauccagccccucuucuuaucucacuuuauaaauaaaucuuguaaauugcaagcagucuuaaaacguguaguaguagaaauuucucuguaccuuuguucauucuuguauuaggaagagcucuuuccuauuaggugccacugagcaguuagaauaacaacgggugauuuugccuggugucuaagacucccagagccaaacccauugggugcuccaaaggugauguuucucugcuuggaaugucagcauccuggaccccgcugcuccccuacaucuccuguauacacauuucagagagcuucucugucagugaaguccaaaggccuuugcaaagccuaugauuccagcaguccuuccuauccucuccucuuccgcacacuuuuugcugcuugcagucaugcaggcccucuguauguguauauguucaugugggagaggagaagacaggguucaaguguucaguacauacuguaaguugguggcuggucccuguuuuuacauguuaguuucuguuuccuuguuccuagauuuaaaaaaaacaauaaucugcagggcauuuaagaauucuagguaaagugguacacuucuacuccucuagaguagcuguguuugcuucccagcacccagguguuagcucacaacuccucuuauaauggaggagaucugaugcccucaucuguccuucauaaaauauaaaucaguuaaauuuuuuuucauauugguaugauuacaaauaaaaauugugagccaaaauauuuauuagaaaaaaaaaaacagcuucaugucuuuuguauccccacccccuuuuuguuuguuuguuuguuuguuuuuuuauugauugguuuuauguauaugaguacacuauagcugucuuaagacacaccagaagagggcaucagaccccauuacaaaugguugugagccaccaugugguugcugggaacugaacucaggaccucuggaagaacaaucagugcucuuuaaagacaguguuucuuuguguagccuuggcuguccuagaauuagcucuguagaccaugguguugaacucauagagggcuuucaugccugugccgucuaagugcugggauuaaaggugugugccaccaacaccuagcucuucuucccuuuuaaaaaaaaguugauuacuuuuauuuuaaauguaugaguguguugccacccuguguugcaguacccacaaaggccagaagagagcacuggguuuggguuagaguaagagaagauugugagcuaccuuguggauucugggaaucaaaccuguguccucuacaagaacagugagugcucuuaacgggggcucuuaaugagccaucuucaguuuguuuuuguuuuuggaaacagggucucaugcagucucagcugguguagaacuugcuguguacgccaaacuagucuaaaucuuagagugauucucuugccucucucuccuaaauguuggguucacaggugugugccagucacauuuguuuguuuggaugagaggccucauuuuuagguauccauccucaaaguagcuauccuugugagacaguggugguuggagugggcuaaggcugggaggaacaggacaguugcuaggccuuggagaugggugacugcaggggcagcuugaacagucacuccacugugucauuuuaaauacagauucauuaaauucucagugaaaaaacaaaaaaacaccacuugccuuuaauauguuuacgacaguuaaauaucagucaaggagcccaaacaaauaacacguaaguaacucugcucccgugcagugcugguuggugggaagagggaguaccugguugggaggaaggaagugugaacuugaauuuugcugccaacuagaaauaagucuugaugcucucaaaggcuuuagauguuuuagauuugucucugguuaagggacaaccugugaauaguugugucugacugcuaauaaauauaagauagaguuuggagagaugaaaugaaugguuacagguuuuccaaucaguuuuuaucagcccgcuguuuauucugauuagcuagaaagccauggagagugcacacugaaucuccaugaacaugaaugaggggacucucagucucccuuugcccggcuccaagcccugcuaacuauaaacaacccuucucuuuugcucauaguuucaggcauuugauauuuuuauuauuuugaaaaacauuuauuguauuuauuuuugaacauuuacucauuuuguaugugcauguaugugccaugacaugcauguggaggacagagagcacuuuuuaugaguaauuucucugcucuuaccauguggacuccaggccaucaggcuugaugacaaguuccuucauccauagagaagucucacuggccuuucccauucacuugcucacuggaagucaaacucagggucuuacacaaucuaggcgcgggguacucuacuccugcgcuauauaucaccugguccguuuuuguuuguuuuugagguaugcucagagugcccuuaacuuaauguguugcuaaggccgaccuggaacucaguaauggauccuacuguaucugugugugagauuaugugugcagcacugagcccagcuagcuuauauuuauccuuacuauuacaguuuaguacuggcgcuuccguuuaaggcaccuugcuugcaagguaagcacucugcuacaugcuauccccaggccacuuagguuguuuuaggaaucagagcugggcaggaugucuugucuugccauuuuggaaaauggaguuauaaaugcuguuauccuuuccucuuugaggauaguaguaccuccucuucugagacacagccaugcuauguggcccaggcugcucuugaacucuuggacuuaagcaauccuuuugccuuagccuccuguguaucugcaaaaaugaucauuuaauucuguccucugaucaccaucugugcugaucuuugcuguuuuacuguaugaacuuucugugcuuguuuuaacuguguguucaauaccccauaacuguaugugcaacguuguaacgucguucaaaagucaaggaaauuauuggguauguacuuaaaaucuuagguuagcaaaccacuuuuuaaaaacucacuuauucaacaaauacugaauucaaggaaugaguacacacacacacacacacacacacacauauauauauauauaugauaacaauuauauuuagaaugguaaaaguuggaacuaccuaauuaucuggaauaggaaaguauguuggcaauuuuuaugccagcuugacuuaaacuagagucaucuaaaaaaaaaaaaaaaggaaauguuuccguaagauuccgcuguaggguauuuucuuagagacuuggggggggggggucccagcccauuguggguggugcuauuccugggcagguggacuucccucggugaucccuucagauaucuggaagcauaagcugaaauaaacccuuucuugcccaacuuguuuuggucgggauaguggaaggaauugggacguuugugcaagcaaagccauggaguguucaaugcuuggugagcuguuuuguaguagcuuggaagauaagaauauugagggcagugcagaagauggaggccuggcuugugacauuucagagagguuaaacauggggccauugcuaguuugaauuaagagucugugguucuggauaucugggacugaagaaucagcugugauuaacaagacaccagaacuaguaaagugaaacuuuugcugggauaggcauugaucaacuggagcugauaaauuagcagugauuaagaggaggccagaauaaaugagggggaaucuccuggaaaguguuuucugagcucaguacaccgaagcuguguuucagaggaggacuagacuguauuucuucuuauggcaagugagcuugguacuguguaagaaucacccaggugguacuggguuugaaggcaggaagggucauggagagaagcugaggcuaggcacugagagaggccaggagaggcaggccaguggugaaggugcagccuuaguagcccuuaaaggcccaggacugaaggggucauucagagaaguugaggcucggcacuauggagagagccuauggugaaagcugagccuaugcccaguuguagcagagaccccagcauuuuggagauggcaguagcaugacggagcuuagggaugaccacuuaagaacagcagcagccauagaguggagccugccagagcuuagaagacaagcugugugugcuggaaggaaggacccagagagcgaggugcaaaucccagacauuggaaguugaguuauuuacacuucgggggcuuggcuuugcuuugcuuugcuuugcuuugcuuugcuuugcuuugcuuugcuuugcuuugcuuugcuuugcuuugcuuugcuuugcuuugcuugugaccgugccuugguucuuuucucuugaagugaguuuuuauuucugaccuuauuggaguccacaauuuugagacuuugaauuuucaaagacauuggcuuuuaagagagcuuggguuuuuuuaaaagacugaaugugcuugaauuuguaaaggcucuuaaaaguuguuuauauuuuuaauaugagaccuaggggaugaaugagaaaggaaagguuaugugucugugucaaguugacaagagcaguuguacuggauaauuuugucagcuugacaaaagcuagagucaucugaaaggagggaacuucaauugagagaaaacgccuucauaagauccagccguaggguauuuauaauuagugauugggggagggcucagccuguuguagguggugcugucuaucccugggcuuuguucuauaauagaguagacugagcaacugguaaggaacagccaguaaggagccccuccauggccuccugccuccagguuccugcccuguuccaguuccucaucugacuccccucggugauaguauuaucugaagugugagcugaaauggcccuuucuuccccacguugcucuggucagcagcaaacacccugaccuaaguaaugucuugucuugucuuuuuguggucuuuagagucagaguuucucgguguagcccuggagguucuggaacuugaucuguguagaccaggcuggccucaaacucagauccacuugccugucucgcaagugcuggggauuaaaggugugugucaccacugaccgacuuuagacauucuuuugaaaaaauuauaaacuuauaauacaaguuucguuuuggggguuuuguuuguuuacuuuuauguauguggauguuugacugucugaaugucugugagcugugcauaccuggugcccccagaggccaaaaaauggcucagaucucccagaacuggauucacagaugguggugagcuggaaaccaaacuugggucuuccacaagaacagcaagugcucuuaacugcugagccaucuuuuuggccccuacugugccuucuuugcaguggauaugcucagcuuuuuuccuguuugcuuuucgaugaagaugcuuugugcagcucagucuggccucaguuuugcuucauagcaaccugccaucaugucucaagugcugggauuucagguuugugccacuaagcuaggacuaacuaaaaguuuuagaaugauacaaaacauguuaagagugugaggaauuuucuuacuuuguaucaaaugcaaaaaguacaagauauguacaaaggacuguggcuuaguucccgcuuuuuaguagcucacagccaccuguaacuagcuccagagaucugagucuccuggccucccagggaaccaggaaacacgcacacaaaguaagaaaacuuaaaaaaaaaaaaaagacaauauaggccagcuguagcucaaaacagcacauuaggaaacuagaaaagacuggggagguggcuggcucaguaaguaagagagcacuugcugcucuuucuuucagaggacccagcuucuuuuccuagcacccacauacaugguagcucacaaccauuuguaacuucaguuccauggaucugaugcccuccucugcccuuugcaggugucagguacucgugugguguacauacauagacacaggccaaaugcccaggcacaaagacugaguguaaauauuagaaaaacaaggacacacagcagaccggcaaagguguucucaguagugauuuaagaugcuuuuaauuuuuuauuuuguuuccucuuggggugugucagagaacauguguuauuucuauaagaagauauuguuuaaaauaaaaauagaaagugagaguugagggucacaguuuuucucagaauaugcacucuaaagugauauuauaaugucuuacaagaacucauauuuguugaaugaaugaaugaaugaaugaauaagggauugaauugcagauuccagaugaaugaauggcauuggcauuuauaauaucucuaacucuaaucuauaacucccaugguuuuuuuguguggcuuauguacuuguucauguauauuugcacaugcucguagguacacaugcauuugcauacgcguguacacacuuguguaggugugcacacacgccuguggguguggucccaaaguugacuuugggugccuuccugcauugcuccccuuacuuuuugagauagggaaucuuauuaaacauggaucucauccaucggggaaggcugacuggccagagagcuucagggauucccaacuccagagcuccacuccucuaagacccuauccuuguccccaggacugggaucauagucacaggugcugccugccacgcccacuuguauguggguggguggguuucaguuccuacagcaagcaguguacuaauugagcuaaccuccuaauuuuaugcagaaaagaacucauuggcucaguuaucucaauuuagaucucacauuuguuuuuguuuuuguuuuucugguuguguguauguguguguuguguguuuuuaauguuuuuauuauuauuauuauuuauuuauuauauguaaguacacuguagcugucuucagacacuccagaagagggagucagaucuccagaugguugugagcgaccaugugguugcugggauuugaacuccggaccuuuggaagagcagucgggggcucuuacccaccgagccaucucaccagcccccaguuaucucaauuuaaagucaugacaguaucauugagccuauaccuacaacccagcacagggguguggagucagcaaggucuggugcucaagguuagcuacugaguacaaggccagcuuguuuuauguagugacacuccccaaagagguugcugugguagcucaugccuuucuuuaaucccagcacccaagagacagagaggcagguggauuucuguguguucgaggcaggccuggucugcauagugaguuccaggacagccagagcuacauagugagacugugucucaaaaaaacaaacaaacaaaaacgacaacaacaaaaaaacuaacaaaacaacaaagaaccaaugagggagagagagagagagagagagagagagaagaaaauucaugcauugaacuguuuuucagaaauuaggaaacagcuuuccgugaguguugauuguauggugacagauccagcagaauuaagggaggccugccccagaagcagccaggccacaaugcuauuucacaguguacggggucugaauaaaaguggccuuugugcuggucucagacugaggggcggugcuuguggccauuuauguuauuucuccuuaauggaaauugaggcagccuuuaauccugcuaucacaugacagcuauuuauuugauuuuugguaauuugggagcagcugcagacaaacaauuauucuacaaaaagagccaagcagcuguauucagacccagucaccaagugguugguuaaucacaccaaacuuccccucuacagccuucccaaaacagguauagcuuuagccacucgccugccuuuuaagcauuuauguguuugaaauguauuuucuuuuccuucuuucccuacuucccucccucccucccucccucccucccucccucccucccucccuucuucccuuccucccuuccucccuaccccugccucucuugagacagggucuuacuauguauccuugacuggccuggaacuuaccgugcuugccgaccaagcuggaagagccagaguagcuagcuguguuggacucagucaccaagugauugcucauacuucccuuccauagccuucuaaacaaggcauagaaagcuuuggcgacccauguuuauuucccuuucuaucuuuuucuugaagcagggucuuacuauguagcucuagcugguuggaacucauagagaucuacaugccuuugccuccugagggcugguauuaaaggccugugcuacgcacuguacuugacaaaaaauacaucuuccuaauucuuuuuaucauugucaccuauuucauuggggguucugugccagauacuggcuguaagcggugcugcaguacugagaguagaagagugcuuccccucugacaggugggugagcauuagccacauuuuuguguaguaaguugcuuaaagaaucuggugugaaagauugaacacagagggcuguguuggcuuugguuacaaacucccucagugucugcugucuggguguucauugucaccucugucccaugccaugugcuuucucaagcuguagcacuuuucugucauucuggagccuaaagacuguguccuucacacugccugacagcccuguccucacggcguugcuuuacuuagcccuugacgguucuugcuagaaugcgacuguuccuuuuuaaaaaauggcacugccuacuuucuuauugacucagccuuucaguagguacuuuaauaaaaguuguuauagggccuagagaaaugaaacaguuuagcaguaggagaauuccagaggacuagauuuugguuuccgguacccacaacagaugccucacuuggaacuguaguuucagggguugguucugacaccaccccugugaccucugugggcaccagcauacacaugcauauucauguguacacauacacaugauuuuaaaacuauuauaaucuagagguuuaagccuuugugugguauguaagaucuuuauaggaaauaaaggcuuuugauuuuguauccuuacccccguccccaggcaucucccuuccuggggcaucaagucuacagaauuaggucauccucucucacugaggccagacauaugugcugggggacccuggaccagcccaugagacaaugauauaguggucuauaauuagaagcaagucgggcuggugagauggcucaguggguaagagcacccgacugcucuuccgaagguccggaguucaggucccagcaaccacaugguggcucacaaccauccguaacgagaucugacucccucuucuggagugucugaagacagcuacaguguacuuacauauaauaauaaauaaaaaaucuuuaaaaaaaaaaaagaagcaaguccuuucaaaauaaaaauagaauguagacugccccauucauuauagaagcuaaaaaccacauuaacauaaacauuauuaaaguuaaauugacuugaaaccuuuaauccuuaagucacaauagucacauuucaauauggucaauggcuucagguauguaguggcuguuaaccuuguacaugacaggucaaaaaugucacugcugaaaguucuguuaguuggcaaagucuagagccuacaaaagaguaggcaugucuuuaaagcauuuggugaaguggauuagccuaacuggucguuauuuaaagauuuaaauguguuuauuuacuuucuguguagaaaugguuuugccugcacauaugaaugugugcuaugugcgugccuauuggauccccugaaacuggggugagcuacuaggaaucuaaccugaguccucugcacggcaccaaaugcucuucaccagugagccaucucucuagcccuaacuauucuuuucuguggagguguguucuaguugaacauuuuaaggacuuggccuucccuguguauucuccacacuucacuuuuuccuuugguuguggcaccaucuagugcuuacacuuugaagcaaugcagucuuggaauguucugauuuucauuugguuacagucaaagagcccuaaaacaauuuugcaagucucuuuccuuccuucccaccauccccacccccacuucuuccucucgugcuuucccucccugucuguauauuuuaccauucuccaaaggacccaagauuuaaaaacagcaacugaagacuugcuuuuugauauaggucucuguauguguggucaaaacucuuaaagugaucuguaagcauuauuucuucuuuaaaaggaaagaaguauaguauaacuugaggcagcuuuauaccugcaguuaugugugaacuugugaaucauugcaugcacaccccauuggugaguaugagcaacucauuugggcuucacgacaauucuaucuguucuccaccuauauaugaugaaacuagagcaaagacaccaaaugaaacuuguguaauauguuaguaagugccagagccacuacuguggcuucagaguguacucauagccaccauauuggagcagugaggcucuguguugaaguggcuaugagguggauagagagaagacuguccagaucuuggggcccgugucuaagaagcaguagucguagucauugucguuguuguuguccuaguaguaccagcacuaguaauaauagaacuaugaguacugaccacccaggagaauguggucacuaccugucagugauuuucaguauaggauagguaggcauggcagcccucaccccaugguuuuguuucuuaugguuucaguuaccccuggucuaaagcacuaaagggaaaauuacaggaguaagugaucugcauggaacuugugacuuacauaaugaccugagcagagugaauguugacugcagcccuccuugccaucuccccagaugcaccagucauccuuugccugcgugcuguguaggcugacuucuuauuggucacuugcuaaccuuaaaucccacacuuacuccuguaauuuucccuuuaguacuuuauaccacacugacucccugugaguaaguuccacuauuccauuccugucugcuccuuuucuaauaauuauaugguaauauuaauccaucucaucugcagcuuucuucaucuugaagguugggcugcauugcuccugccuacuuucucgccucucccccucgcuugcugcuuugucagcucuguauucaccucuauguucuguuugguagcauuaggguuugggugcuauggugcugauugguuuuguuugcuuugguuugguuuugauuuuuugacacaguuucucuguaacccuggcuguccuggaacucacucuguaaaccagguuggccucaaaugcacagaucugccugccuuucuuugccucucuaguccuggaacuaaaagcaugugccacugccaccugacuucauuaguucuucuaauuauaaaaauuauauuuauauuuuuuaugugugcacaugccaugguguaaauaucagaagacaacuugcaggagcccucugaauucagguugucaggcuugguggcaaauaccuuuuacccaccgagcaucuuaucuaucuaucuaucuaucuaucuaucuaucuaucuaucuaucuaucuaugauuguauaauuuaggucuggaagauuucauugacuuuugagcaugaguucuaacuuagugaagaauuuuagguuccagauguaucuaggaguguaacuugagccucuuuucccugugggcaccgcuuggacugauuuuuagaccauucuugcugauuacccuuuuucuuuugaaaugauaaugcuauugauuagacuaaugcucucuuuuauacuuuguuaugcuuugauuagauuuccuggccugaucuucuuucuccuugauuuuuaaauacucuucacuuaaucucauccauuauguguggauuagacugaauuuaagccccuugaugggcuccuccaaauuccagcagcucccuagguacuucauagaggucaugucagcagggugcuggaaacuaagacaguccugcuguguucucugccacugcucccugguucugcaggggaaaagcagacacucgcaaccucuuacaguuugguaauagagaguuucuuucauucauucauucacucauucauauuuuugagguaaugucucauuuuauauacaccagugauucucaaccuuccuaaugcuucaacccuuaguagaguuccuuauguugugauucucaaucauaaaaugcuacuucauaacuaauuuaguuacuauuaugaaucguaaauaucugauaugaagguggucuuaggugacccuaugaaacagucauuugacgcccaaaggggucacaaucucagaaccgcugauacagaucaagcuggccuucaacuaugcagcccaggcuggucuggaucuuuaucccuuagccugccugccagugcagagguugcuguuacugcugccauguccucauuuuuuuaaaguuagugucugugcaugagcaugugcaugugaaugugggugggugccugaagaaaccagaagcuuaagauacccuggagcuggauuuauagaugcuugugaguacugggaaccaaacccuguccucugguggagcaguacucuuaaccauagaucuauuuauuucuccacuccccaggaauaauaauuuuuaaaucaaguuuuggguaguuugcugaacaccacugucguagugggauagaccauuuugcuuuucugguucagaaaacaugagcuggcacucccucuuccucccccccccuucuccauuuuguacacuaucacaaaguuuuaaguguguuggcguucucacuuuaugucuuaagacgguguuuccugcucagauuaauauaacaugucgugucauagcacaaaguucucagauagagucagaagccucaaacaggugucucgaugugaagaaauggaggaggcacagugaacagugcaugugagacugggaagugagcuaggaaaggcagaugccagcguguaggcuugcaucauaauuaacauuacaauuauguguugggaacuguguucuagacuuuguuggucaauucauuuaagccucacaucacccuuuagagaauacauacuguuuucuucuuccucucaucuuaaaagacaguggcagaauuguggcuuaguggucuuuaaguaacuuguuaagggguucuggauaucuggauaagagucuaugcugucuuuuaaaaugcacauuauuucauuacucacccugcccccaccgccccaauaguaauucccauuacuuuugcuagccagagaaucugauucuuugaggauaaaagcugaagcaguuuuacuaaagcugcccugggggagaggggcuggaggaauggcuuaguaauuaagcacuugcugcucuggcagggggcaugguuucaguucccagcacccauaugguggccaaugcugcccauaauuccaucgucagcagggauccaacacccucuucuggcuuccauggacaucaggcagacaugugguacacacaugcauacaugcaagcaaaauacuuacacauaugauauaaaauaaauaaauuuugcuuguuuguuugagacaggggcucacuauguagaacaagcugaccucacagagauccaccugccucugccuccagagugcugaaauuaaggauguguucuaccacacuuggcccaaaacaaauaaauuuucauguaaaguugaccuagggaugugguggacuguuuccaucuucauucuuuucuguuaaguaaauaaggaaguggaggccugauccagcaauacguguaugucauucauaccuggcuuagaugaccuuacuuauugaugguuuuaugagaacauagcaauauuuacaaguacucuauuucugguucagaugagaugccccugccuuugcuuuuuacagccuccaagaggcuagauagaaaagcuggcugaugggugggggguggagagaaaagaggcaccaggcggaagugacaagccugagaagcagacagcccuauugauucaugcugcaagcuacauucuggagcaaagaacugaaauccauuauaccaagcacacagcauuaugaucccuuugaaaagcaguuuagaugccaucuaaucccaaaucauuuaaaaaaacaauuuugaaguagccagauuucuaaaaugcaauuugucucagacuagcacagugaaauuaauggaaaaauaacacuuuauugguaucuuccuuuuauauauuguguuuaauugugugacuagguauaucaaauuguacuuuagauaaguaccaacaaggagcuaggauauaucccuuguauauugaaaaacucacacaaagauaggauagaaaagagacccuaccagacauuucaccuuuuuucuuuaaaaauaugucacaaggacaguauaaaagaagaauuuuauacaaauaaucuuuauucuuucuacauauagguauuauuucugcauaugugugguugccauuucuuuuuguaaauucuagauaugcagugcuauauacuacuacuacaacaaucaaaccuuacuuuguauuaguauugcauuaauauuguaugacgagaggugauguuaucauacaaguuaaacuuucaacucuuuuuuuuuaaaagauuauuuauuuuauguauaugauuauacuggugcuaucuucagacacaccagaagaggacaucaaaucacauuacagauggaugugagccaccaugugguuguugggauuugaacucaggaccuuuggaagagcagucagugcucuuaaccacugagccaucucuucagcccaaaccugcaacuuuuaaucauaacuucaaauucaugucagaugucuauacauuuugucaguauguuucaucuagcaacuuucacuguguacaaacuucacaguuuucugucaagaauuuaaaagaaaaaaaaacuucuaaaguuuuaagaguugcauagaucauaaccauuuggaucacaugugacuuagacaaagcacagcuacaaccccagaaugugagacacuauucuuaugccuaguuuccaccauguagcucaaaggccagggagccaauuugugguagauccaaaugcuuuucuaaauaccauucuuguuccuucagagccagccuuccucucccuacauugccauagccaucaggaaugucaagaauuuauuuuuaauaguuaucgaguaauguacuuuuuuuuuauauauauauauaaagauaagggcuuaguuuauuuuucugugaguaccuauuuauucuuuauucagaggaaguuagacuugggugaggguugauuguauuuuaacuuucagauugugguagagcauauauaacaaaucuuagguggugcccaguucaguaaugcuaaaguacacucguguuauugugcaccugaucugcagaacucacacaucuuaugagacaacuccuuagcugcuugcacucagccccuggcagcuauuuuucuuuuucuuuuuuuuuuuuuuuuucuauuuuauuuguuuguuuguuugguugguuuuuuuuguuuguuuguuuguuuuuguuuuuuguuuuuuucaagacaggguuucucuguguagcccuggcuguccuggaacucacucuguagaccaggcuggccuugaacucagaaaucugccggccucugccucccaagugcugggauuaaaggugugugccaccacagcucaggguucuuuuuuaucauuaaaauaauuuauuacuuuuuaguucauguacauugguguuucaucugugugugucuguaugaaggcuuuggauccccuggaguuacagacaguuauuagcugccaugugggugcugggaauugaacccagauccucuggaagagcagccagugcucuuaacugcugagcuauuucucucgcccuggcagcuacuuuucuauagauuauucuaauuauuuuauacagaugaacuacaggcuggggauggggagauggcucaccaggugagagccuuugccaugcaaugcccagaacccaggcuggaagggaagaccugaccucuacagucaggcugcagcaccccugccccaucaugcacauacacacauaaauaaaauaaaacccaaauggacucauacaguauuugccuuugugacuagcuuauuuuauugagcaauuucacccauagcauuucaaauagaacagcuucaaguguacagcaaaauuaaauagaugguacaaggguuuccuaaaugucuccugcccuugauauauugcuuaccccucucuuaaauguuucacuuccuaaauaauaccuaugugagguaaugcauauuuaauuggcuagauuuuaucauuuaugauguguauauaauuuucaaauagcaugcuguauaugauaaauaguuuuaucucucuauuugaaauacaaauuaaacuuuacaaagacuucacagcgucuccuguuuauugcaggggauauguucacuggacuucagcagacaccuaagacuggauaguaguaaccuaagccacagucuagucgcucacuguggccauaacauuuuagcuacuucccuccaccuucauguagcuccugugcauguuuucguuuauaccuuaauauuucacuuuuaggaggcauugauagaagugaaacuacaucugauuccaaaugcuacuuguucauuguugauacauaagaaagcauuuauuuauuuauguaucuaccacauccuacuuguuguucaauccaggagucuuugguugaucaccuuuauauguagacagucaugccaugcaaaaacaguuguguuuuccuucucagaggccccucuccugcuuuaucuuccucuuugcuccgcccucucucucuugcccucccuuaccacuguugccuccuuuccuuuccuuuuuuccuuuuccuuuuucuugugguuuuccgagacaggguuucuccguauaacccugacuguccuggaacucucugccucccgagugcugggauuaaaggcgugcaccaccaccgcccgggugucuccuuuucuuuuauuguucuuuucuuuguucuuuuacuacauaaacugaguuccaguauaauguugacaauagaagacauccuuuucuugcuccugauuuuaaugggaaagguacuacuuuuucaccuuuaaggauaauggcuauaggcauuuuuauagauguucuuuaucaaguugaggaaauccucuuuauuucuaauuugcauuuucuuuccuuuuuaaggucgaaugguaugugguucauguagaccacauuuuguuucccucucacccauugauggacacuuggguagcuuccauuuuuggcuguugugaauaaugcugcuaugaacaugggugugcacagagcucucugagacgcugcuuucaguccuucuggguaaguaccacaaguugagcugccagaucauaauaacagugauucuauucuaaaaacaucaggaugucuacauguaaaagcccuggcuguccucucuuuguagaccagccuagccucaaacucacagagaucaccuaucucugccucccaagugcugggauuaaggggugugcuaccaugcccagcuaguuugcuuguuuaaauaugucuaaaugucuagauauauuuuuauaucacaacaucaaauguuaaucccuggacuguuuuaaaugucuuuuauuguuaaguacauaucaaagauauuuagcuggacagugguggcacacgccuuuaaucccagcacuugggaggcagaggcagaggcagguggauuucugaguucaaggccagccuggucuacagagugaguuccaggacagccagggcuacacagagucucaaaacaaaaacaaaaaacaaaaaaagauauuuaauguuuuugacuugauacaugugaaugcuucuauauauuuaugguaguaaauuucugucaguuauuucacagagaaaauauucuacuuuuuaaaaagauuuauuuauuuauuauauguaaguacacuguagcucucuucagacacaccagaagagggaaucagaucucauuacagaugguugagagccaccaugugauugcuaggauuugaacucaggaccccuggaagaacagucagugcucuuaaccgcugagccaucgcuuuagcccaaaaauauccuauuauuauguuguuugaauuuuccacaccuugguguggucaaguaauaaaaucagagcuuugucaaaguuucuuugcucuuaauaaaaaccuuaguuuaagcaucguguuacauuauacacugaaucuccucccuuucccuccccuuaccccucuuuccuuuuuuucuagcaguagaucuucauggaggagcacggagugacccaaacugaacacauggcuaccauagaagcccaugcaguggcccagcaaguccagcagguccauguagccacguacacugagcacaguaugcuaagugcugaugaagacuccccuuccucccccgaggacacuucuuaugaugacucggacauccucaacuccacggcagcugaugagguaacugcccaucuggcugcugcagguaauguuugugcuagaaguuugcuucuuuccuuaacuguggguucaugccuaucgaaggagccuggaauucuagcacucucucauuucuuuucaucguuuuuuguuuuguuuuuuuuucagugcuggggaucaaacccagggccucgcauauacuaggcaaguacucuaccacugagcaacaucccaagcccuucaucacaauuuuuaagccugcaccuccaacuuuagccuguucuaugagaguugaguuuggggucccuuacuacuaguguuacggcguugguuuucuuccauucucacagucugguuaacuagaguauguauuauauuuacauuaaauguaaggacugacauuuagauuuuaauauuuuuaagguuaaaaguuuuuccuaguauggguuuuauucccuuugugcuagaacgaacccuagaguuucacaugcgagaccagaguccuacccugaacaguguccuucagcccuaauauagcccucauuagacuuucugaugagaguggguuucuccaccuguucggauuugcacuguaaguuccaguuuguguggaaauuuauuacuauuaugauuuuagauuuccacagauaaccaugugauuuuacuguucguuuguuuguuaguucuucuuucugaggggcuuguggaucugucuaccauccauguuacugacaguucuuuuuuguguugacuauucucuucauauacugguuaaauguaaaugaccauucugugauguguuuggaaauuaauuuuaaaaauuauuuggggucuaugauaugaugcugcacaugguuucuguuugcuucugcuagauaccaagaaugauccuuaauugucucaggcuuuuaaguuuuucacaauacuaagagacuuaaagcuggcuguguuuuguauuauuccauuuauaguauguauuuagacauauaaaccaugucuggguggguauagugcugggcaggacagcagucaggaauggccgaagcacuacauuaauaaaguauauauguuguauuuacuuaaggugaagagaaucguguaauaaucucguaccaucacuuauucacaauacuauuuuuggaauguugaacuuagaaacuaauggaggggcugggaaucuagcucagugguaaagcacgugcuuagcuagccauguguuuaaauguuuguaacauauauuuugugagauuuuuauacuucccagaagagggcauccuaacauaaugaacccaggacaacuucuuuccuaugaaggaagaugcuuuugagacauggcuuugcuuugcuacuguacugugcugcguugcuauggugugaggaugaugaaagcugagaccgugaugcagagguugagcacuugccuagcacgugugaggcccuggguucagcucccaacaucacuaaacaaagacuagagcuggcuagguauaauggcaugagccuguagucccaacuacccaggggguugaggcagggggaacauuugagcccagguauuccauagcaacuuagacgacacagaccuuaucucaaaaaugagcagugaagaaaagaacagaaaaggacuaaagucuuucauuugucgaguauaaaaauagaggcccuucaaaucucuagugaguugcuacuaaggaauuguaauuugauauacugcaagguauagagucuuugacuaaaacggcuuacuuugaaggagcugucaggccaccagccguaguaucagugcaggcaaauguugaggagaggacaucagacagaggacgugucacaggcaagggacuuugagaugaaaagggaaggaggccaucguggcugagcuuugugaggcagaagaagacaguacagagggcuggcauaagugugaccgacugcacagggcuuaggggcucugcaggaugcaagcuugcagaggcugcucagugugaggcauacacgcuuacacucacaguaaacaagagaaucuugcagagguguccgagagcccucauuaauucaucagucaugauugauccugaccugucacauuuguugcuugcuagagaauuuuuuucugaggacuagucuauaguauggacacaccuaaaagacaacucagaaaagucaguaucagucaauucaugccagguuaccuaucaaaaaugguucuaauucucuucaguuaagacaacucuugaucaguguugauucucaauggaaaaauaaauucaggagggcccgggagccggcucacuuagcaaagugcuuggugugcaagcaugagggccugagucugaucuccagaacccagagaagaagcugggcgugguggcuggcauuacaguuccacacuguggagagacaggcagaccucuggaaccuucuggcuggcuagcaccuuaggaacacgcaugugugugcacugugcacagggcgcuuggccuuuuucauucaguaauaccuucauuacaagugauauauucugauuuuuuuuuccugauguucuaauucacucuggcuuuauucuguuuuacuagaaaaauacucgauaaacuaccaaaggguuaccauuugcuucauggaaaaaaggaaaacuugguggaauuucuuuuugaaaggguauucuucaacuacuuugcucuuauuuucacuuauguauaugggaggauggaguccacugccugcagaagccagaagaggccaguggcuuccuuggaguugggguugcgugggugcugggaauguaaguggggcugaacaccagucuucugcgagagcagcgugugcucuuaaccacugacccguuugugcagcucaagagacaggcuucugcuauguagcucaagcuggccugaacucucaguccuucugccccaaucccucuagugcuuagauuuuuacaagugcucuugacaaacauacuugaagauguguccaggagaguaguugagggucugaagauaggcauauuuucagcuuauuggaauuugccaagccaggcacuacucugguauguuagagcaggcacucuuaacuucuguccccguguuugcuaugugcggucucaccuguccuuccucaucagguggguguuuguuaacuaguauugguucaaacagcugacuguccauagccaaaauguauuucuccaugugaacagugagcaccagaucuuugauagccuacucuucucacccuugucuccugacauaggaucauugcaguucagugauaggaguuugugucucaggauccagucccagucuuaguaacuuaaccuucaagauaacaugugacaggauaaggccuaugcuuaguaucuucuaaauugucuuaccucuguuuggucuuuuguuguuuuguuugaugcccuguacacaguagcaaacgcacacacacacugacacaccauucagaaggggaaaucuugcuacaugugacaguguagaucaaccuuuuuucuuucucucucucucuuuuuuuuuuuuuuuuuuuuuuguuuuucaagacaugguuucucuguguagcccuggcuguccuggaacucacucuguagaccaggcugggcucaaacucagaaauccgccugccucugccucccaagugcugggauuaaaggcgugugcuaccaccacccggcguagaucaaccuuaaagacauuauacuaacauaaacagcccagccacagaaggacagauacaguauaauugcacuucugugggggacugaaacaugugguaugguuuccagggcugugggaaggagguguagggaauuacugucagcaaaucguugcaaggcuugggauggagcuuagcaggagucacuagugcuagagccacaauucuugccuaggaugcaccggagcaggaggaggaaagaaaagaaaagagaaaggaaguccagaagcagggagagaaggcaggccugacggcaggcaagcagggaaugauaguauauaccgcuaaucccaggaggcagccggaggagcaggaguucaggguuauccuugcuuccuuuaugauucuaaggucagccuguccaacagacucuaucucaaaaaccugaaaaggagggaagcuuucaguuauauaagacagauaaguuauagaaaucugugcaugguggauggaauuaauacuguuuugugcacaaaauuuuauucagagauggaucuuauguuaaaauauugccacaguuuuauaauaaaaugucaggggcaauaaugucggggcuuaagauuuucaugugauaguuggguacaagguaccuauaaucccagcacugagagcagagguaggaggaucacuuugauuccaugcuagucugcguuauguacugagacucuggaagaaggaaaaaaaucucuaccauaucucuaugguagaaagcgagccagccucugacuugugcuugaucugggggucuuuuagagggucucucuucagcaaggacaugauagcacugagcagccugcagacagaaaggcuugcugcaguucaccuauuuagaauaugcacgugaauauaauguuagcaguuuaauuuguaucuaagccuuuuaugggcuggcaggaaaggauaaagugacaugcugucuuugaugcuaacccauugcuaucaaaagugaguaguaaggaauuacuuagacuuacccauucaaacaaccccaagacuuguaugcauuggucucagcuuuuauugaaaaaauuuuuuucuuuucuuuugguugaacuaaggaaauguucaucuccuuggccaggauccuuggcacacggucugguuuaguucuuccguguggucgcucaaagucacccaguuccuuaauuugcuagucuugaagcaguggaaggaccauggagccagaagugcagugugaagcccugcacuugucucauuguggucguccuuucucucaaugcuguaguguuuucuggucccuuugcggcacuguucuaagagugugggcaugcugguaaaacagcaacagcauuguacaaaauucaagacaguauuuggcaggaagguagaagaagccuuuugcuucuuaaagacugacuauaaauguauaugguucaugggaaacaauagagaagaacacugaucacagugcaaacauucuguuuucacugacaguguguugcugucugucuccuacccuugcagucuccugccuaaucucaccacauacuuauuauuucagguccugugggaauggccgcugcugcugcuguggcaacagggaagaaacggaaacggccucauguguuugagucuaauccaucuauccgaaagagacagcagacacguuugcuucggugagggcugccuuaccccaucuugucuuucuucacaugcuuccucuguggaugucaagagcuagaacguucuuuucuggauuccucaagacacuggcauggaguauuugauaacagguuuagacuuggaaucacucccguaaaaguaaaucgaugaaaauccagaaaauaggauguaauacauguauaacacuggccagcggugugguucaaaccuuugauccgagcaucugggaguuagagggacggggaucucugugaguucaaggcccaccgaagcuccauagugagacagagucuuaaaauaaggaaggaaaagggagaugucuaacgacacuugguucauccaggaaaccugcaccugcuauguucaggcagcacucuaucuagauagugggacacugagcaacaaaggaccuuaaaaaguuuauguucugaaagagagagaaaguaaacagacauuauauuuguuaggucucaaaccaugguacaauggcuaaggugccuauuuaacauugaaaaacagaccuggccuuccgguuuucccagcaucccuuaacaggguauagcuggcuacguaaacuuauagcccccuacguaaacuucugcagcccagggauugggcugcccuucucuauauaauccagccauuuuagcugugccacucucuugaucagucucuuuaggccaggcuaccccucuugguuagcagcuccucuccccuaccugccuccucacacggcucagggucacgcccacucugucugccucuggcugugcucucccuuuuauguacaauagaguuucuccuccaccacaccuaggagcagaucucuucuuuccuucucuuucuuuuuucauucaauacuaaaugagaguaaguauuguggguagaaaagaaauuagaaaaaauauuucuggacaucaaagaacauaguuguuucucuauucuaagaauggucugagaaagccuucugaaggagcagccuuugcccagagcagggaggaauugaauaaauaacugugcucaugucuaaagaacauuucaggcagagggaguuauuagcaaccaagguagucaguuacuuauuuauuuauuuacuuacuuacuuacuuuuuauuuuugagacagggucucacuauguugcucugaauguccuagaauucaauauagaucaggcuagccugaaacucaugaagcucugccugcugcuuccugagugcugugauuaaauguguccacuaccacacccagucaaaguagucauuuuuaaaaagcagccagggagagcaugagagcaaugauuacaggaguagaggaaaccccagcacaucacaagcugguuugugcuugugaucccagcucuugggaagcugggguggaggaggauugccacagguucaaggcaugguuagggcauaucuguaauccuagcacucaagagacugagcuaggcaggucauuggcuuugagcuagccugagcuacaugaagaguggagagaggauuggagguggugaauaucaaccauucauucaagaacugcugcagauuuucugugguacuaugaaauagaggcuagucccugagcugcuucuagcuuggucucucacuuuauuggaggguuugcuuucugaggcuagucaccucagagguccaaaaacaguagaugcagaguucuaaaguagauaaugaguuuuagauaauuuuacugaagauauuguuauaauuugaaucuucuuauuuuaaaauucuaauuuaauuauuuuauguguaugaguauuuugccuguauauguauguguaccauguuaaugccuggugcccacauuggucagaagaggguuuugugugccugcaugggucuaugugcucuugaggaaaccagaggcauuagacccuuaaaccuggaguugcagacaguaggccauauaaggguguacuaggaaucaaacccagauccucugaaagagcaguaaguacucuuaagcauuaagccaucucuccagccuguuauaauuguuucuuugauuaguuaucauucaucucuuauuauucuuagcuuauaaauuaaacuuuaucguugguauguauguauguauaggaggaaaacacaauauauauauauauagagagagagagagagaggguuugauucugucucaacuuauaggucuccaguggggguuuggagcagacucccaccggcaaguggggcuaaugcagagacccauuucauccucauuggcaaacacuguggguuuguguucuaguuucuuuuuugugauaaauacucugaccaaaagcaacuggggggaagaaagggcuuaagucaggucaaggucaucagagccgagccuggcagaaaccuuggaggaaugcuccuugcuuguucccuucuaggcgauauggauuuugucuugcaaucuugguauuugcauuuuucauuuuuauuauuuuuugcuaugugguaacucaccacauagaccagguuggcuuugaauugacaaagauugccugucuguuucccaagugcuggaauuaaagguguguaccaaaguacacuuacaggcuuauacuuuuaacuagcuuucugacgcagcacaggaccaccuguccaaagaauagugcugcccaccauggccugggugcuccuauaucaaugugcagucaagacaaaucucucgcagacaugcccacaggccagucuaaucucaccaauugcucagugagucugccuucucagucugugucaaguugacaguuaaagcucaguaggacugugucucugucacaauacaguacaaagcuguagcuaggcauggugguguagugugcacacuuccucugguagacuuccauacuuaccucuccuucccauugucauauuucagaagacguccgaucaaaauugucuccacccacagggaguuugcuccgcuuccauuggggcaugcauccucugucacaguaaccuuguuuccguucuguucaggaaacucagagccacguuggaugaguacacgacgcgagugggacagcaagcgauuguacucugcaucucacccuccaaacccaacccugucuucaagguguuuggcgcagcaccuuuggagaaugugguaaguaagaucugagcagugcccagaggcccucugcuuuguguagacuuuggccuuucuucuuugcaggucaguacucuggauggaaggaggagacaguuuuugcagauggaaacagauaagaucagccccaugcaguggucagaaagaugccuuguuagugguccucuuuugucagcugagagcagcgagcagugggaggcuuuuguugaaccuagcuugauguuugacuugguggccagagcucuucugcucugaguauacauaauauuuuaaagaaucauuacuguuuuuacuuacuaaaacaauguauuguaccccaccagaugcaguuuaaaaaaaaaaaagagagagagacuauuuuacugaagaagccagugcagggcugaggauauagcccagcugguagagcccuugccuaaugugcaugaaguguuguguucauccuaaggaccuuacuaauugugguacaugccuguagucucagcagguaggaggcagaggcaggaggaucagguauucaagguuaucuggcugguuccaaggccaucuugagcuaaauuauacaucuuuuuaaaaaagcuaaauuagacaucuuuaaaaaaaaaaaaaaagaaccaaugugaaauuuugauuuauaucugaagcaaaacacuagaugacuccaggauguuaauuuuauaagccaaauuggaagcauuuuauuaaccauguauuuggauauuuaaaaaucccuuugcagccgggcguggugucucacgccuuuaaucccacacucggaagcagaggcaggcggauuucugaguucgaggccagccuggucuacagagugaguuccaggacagccagggcuacacagagaaacccugucuggaaaaacaaacagaaaaaaaaaaaaaaaaaaaaacuguucaggggaaauagcauaaagaacccugagcucaggcagagguggagcuaacucacgggcugcugugcucugagggccagcacagggcucugugcaagccauuggcuuucuugagcuugacaggaguagccugaaauauuuucuugauaacaaagugaaaacuucucaagagguuuuccagggcuuuugaagauaaaacucuucagucaaaaauuggagccuauaguauuugcuagggcccagugagcacacucacaaccacggggcagagggagcgcuggaguuagcgccagcuuccuacaagucaucugacugucuuuauuuauuucaaugcucucccugauagaucaguggacuguccuucauuuguuuauauaggguuuuaaaaagagcuucacuuguauaaaauguaggccaaugcuuuccauguaguagcugugagacggggagguuguugcucaguugguaaagcaagccugagggcccgaguuugaauccccagcucuccuuuaugcuucagaugacaagcuguagucuacaugggauagggguaaguuuuuaaaaaggucuuugaugcaaauuuccaaagacuccuuacaucuagaaagcuucagaaauucagaaaaaucauaauaucuaguccaagacuuuuucuuuuucuuucuucaaccugaccagaaggccaguuucuaaauuuucaaaaguaaaucuguuucuagaauucaaaugaucuuuguaaauguacuaaaccuaaccuucuauccuugauauucauaagaguauuugauaauguaccuaccucccugugucugaauacaugauauauuucaugauacauauuaaaaagaaaggguuuuuugggaggcagagcaggcagauuucugaguuugaggcuauucuggucuacagccagaaugucucaaagaaacccugucuuguaaaaccaagaggaaggaaggaaggaagaugggaaggaaagguugcucugcucagcagggucagguauuggugugcacaguguauucuggggauaauaauauauucgacacuaagaauuuaaagcgggaagauaacuaagacaggaacacuugcuaagguuuuucggagcacauguggaaauugaguuggacuuugaaaaaugaacacuuaggauaagaagcagaaaagaauuugguagaagcaaagaagugaggaggcugacuagcaguuuuagaguuagguuuuggggugaagaguggggagggcaucuccgaauugagaggccagguagaauugaaacaccagccuucugauuugaagaaguauauauacuuuacuaagcuagcuuaggugggagugcugcauuaaccuggaauuauuuuguuguaaauuacuacaaaacauaauucuaucagcauucuuuuaaucaguauuguuaaggaauuguauagcauugauaagucuaacaaaauaccagaaucugacuuuuuuccugauccaugaaaaggcuuacuggauacugacuaauagaauaguaauagcccaguguuucccaacuuugaguuagucuuuuuuuauagugagucuaguguuuggacuauuuuugucucauccccuuggcucuccuaucuggaggauucuauagcuuuggaacuagacugguuacuacuguugaggucagugaaguacaauaugggaucuuucucuuuggugccucacaaugagaccccccaguaaggcaguaaguucacagaacagaaaacaugguuggaacuucuugccaaaaauuuuuccccauccccaagagaaugccuuaaggccuaaaaacaaguuaauuuccuaucccaucuaguuauauuuccauaauuccuagcuuuauuaucccuagacacauucucauuccccuuguguauucuucuaagugaauaaacccauuauugaugguggagucaguguuugccuacucuugcuuauguuggaagaaugugcauaugcgcugugcugcggcucuggaagguucugcugucuuaagauggguuucacuacaauggaugagccagguucagaccuggaccaacacacagagcagcaccauugcuuugaaguucaccacuguguccaaccauuaccucaagguggaggagagggugacgauggggcucccugaccuugggccuugcugguaaugguacuuuucacacucauucuuuucaguccagccucucucuuaagcaguuggaucuuuugucuuuaugguacacacacacacacaaaagcauuuucaaaugcauuagaguuuagagacauaagcccuccaaucuggaaagugauuuuaacaguuaacugucauuagauggggacaugggaaaugcagaguaaugaauguuauuuauauuauaccuggaacugguaaaagaucucuguagcuugagaaaacgugacuuuuaacugagaagcaguggacuucucccacuggcuccuuccuacugcuguuaccuaaaauuucaucaucuuuucguuugauucuguucaauguggugucuuuggggccagcggguauuuucuccuucuacuuggaggaguauuuguucuuggaguucugcaguggcuaagggaaccagccccacccacugucuuguugcuuggcaccagcucucccuggcuguugagcaucuuguuuacuucugcccuuaauucccugcaggugcgaaaguacaagagcaugauccuggaagaccucgagucugcucuggcagaacacgccccugcgccacaggagguuaauucagagcugccgccucucaccaucgaugggauuccagucucuguggacaaaaugacccagguacaaggcgggaaaggaggaggagaugcaaagauaagagaugcagaugugggcggccucucuucacuccucuagcuuugugguuggcgaugugaccagagcuugagacccagacuggaguguguggcagccuugggcaaggccaagucccaggaggagucuccugacucagcacacacugucaccucugcccgcugcccacgcucuccuuucaccagguuucugugcuagggaagagaacuuucugcuugggguuagucugaccuggagacuguucaaaguuugaggagacaaguuuagcaggcuaggcugcuccucugcuccuccccacucuuacccccaccccagguuuuugagauaggguuucucuauguagccuugagugauuuggaauuugcuguguagaccaggcuggccucaaacucagaauaguugccucagccuccaggugcugggacuaaaggugugugcuaccacaccuggcuuaauuacuaacuuuuaguuuuguucuguuuuucuagguagaauuuuaaagcaaugacuuuuuuuuuacacuuggucuuagccaaaaggcugagaaauggugacuuuuuauuuuauuuuuuauugcugcucaguuuagcugcucaacaccuaaaauagcaugucauguaaacaauagaaccuguuuaguaaauagccuaagaguauuggaacaaagcuaaauucaguauagcagggaucagcuugaaugggucugaagcagagacuugaugagaaauacaugccuuuuauaaauauaaagcuagaacugaguuugguaucccgugggcugucauccuagcaccugaggagagaugugagagaaucagaagaguucagggcuagccuggaauacauagugagcgcaacccugcuuuuuuuuuuuuuuuuuuaaauacauucuaaaccuaaacugucaucuuuuggaacauauagcguucugugaacaugaaggaucuuucagucauucagaaagaaaggcauacccugccccuucacaguugguguuacaaucuguugcugguuccauuuugcauggcuaauuguaggaauguucucugucucucaaccauaaagugcaugaaaagccagcugaaccgcugguguaggauacuagugcgaauccucuucugcgauggguuuuucucccccacugccauuuuagauguguuaguugaaaugguccaagguuuugacgauaauaaacaugccuaaauguugauuuucaugaagaacagccaauagcugcaaaaaaaaaaauggagcaguuacuguuuggaaagcagaacaugggaaccucagugugcuucauuccaggccacaugcgugguaaacagcauagcacagugacagauccaaggagaacugacccuucauccccagcugggcagccuucguuguacgccguguucacugcagucgaggauugaaaauaaaacauaacaaauaguuuaaaaaugcuucagcauuuuaaaggagacccaugagaugauuaaaggcacuuacaaccaaaccuagcgaccugaacccaaucuccagaauucacauggugggaggagagaacuggcccccaaaaguuguccucugagcaccuccugugcucuaugguaaugcuccccauaauaaauaaacauuuaaaaaugacaauguaaagaggacuaaguaggaugauagaagaccagccauaccugaauggaaacuuuucuaaguguucagaaaauguuuagauacucauauuuucuccccucagccuuauuauuguuuugcuuccucauaucuuaagcugagccaaauaacucucuauguuaaaugaucauaaagcuuuucacuuuuaguaguagcaaaagaagucuucaauuucaaacuaagccugguuuagacaagaggcacaggacaaagcacuucucccuacuauuuaugagaguaugaacugguacacuuggucggaggcugcuucagagugcaguguggacaaauggcccagaguuagccugaauuugcuucucagcagcugugcuugcaggggcuugugacugccgagcucuccagguccagagccugacagccucugcaggcucacugaauagucauccaucuacccuucucauggaugugugcacguaaugaacaguagagguauaaauaaucuuuaaaagguguguggggcugcuggcaagagaagcagcgacguuugcuguucgugacagcauugcuuacaacaggaaagguuccagaguauagaauuuaacuagugcuuaaauuauaauaggaaugccaacugcuuacaugggaggaggcauaccauggcccagacgacaaggccguugacuauucagugaccuauggucucugugauaguagacgagcgccuaggagguacagcaaacaguaaaaaggaaaguugccuuucuuaccugauuuuaggaggugaaggcuuuacuguuuuucuuuuucuuuuuucuuuuuuuccaaaggcuagauuugguuuuuaaauacagagaacacaaagugcugguugacaucaucuuccaaauuguguacacaaaccauacucaaguguguacacuaaagcuuguaagaguguacaucaaaaugcuaagucauuaguuaugcauggcaacggaguaauuuucauuuuuuuuguagauaagcauagauuaauaauuuuguggguuuucuuuuuauggguguuuuuauaaucacagaaaucaaaguauuuucaguuuuuacauuuaacuugaauuuuuuaggguacagguuugauaauguuucugcuuugaccaaauuuuauuuuuuuucuuuauuuuggaaugaaaauguugugaacucuuuuuacuaccuuggaucuccauagagaguuggaaggcauacuacuacauucuucacaaaggcauccauuuguguucuuucucucucccucccccgccaaaguuuagaaagcacaauucagauaugacuguagccauaaaaagccaaaugauagaauguuaauucuagauuucagacuauuguaauuaauuucagacuuuagacuauacuacagcuaugcucuguuaacuaucgcagcucuacugugugguguggagcuaaggcagaugugugauucuggguacagaccuggaguguguucugagucauccaaggagacucauuucaugcuggccucauguuagcuuuauugacucucuguaaaucaguuuacuuguuuuuauaagaauacuaaaaucuaguuucuaguccaaauacuacuauauauuaacucuaggccucgcuuuuuuccuuaaagauuuauuuauuuguuuguuucuuugcuuguuuauuguaauauaauauauaugagcaugcugcuccugacacaccagaagagggcuuuggguccaauuauacagucgugagccacccguguggucgcugggauuugaacucaggaccucuggaagagcagucagcacucuuaacuccugagccaucucuccagcccucuaggccucaguuucauaagcuuuccugccucauaaaauuggaggaagcaaaaauuagguauuguggaggaaagugcuuugaaaauuaaaccaucucacaauuuuaucauuacuguuagcauuuauuucuucucaaaggcuuauaucaagagagagucuccaugugcagccguggcuuaccuggaauuugcuauguauaucaggcuggccucaaacggacagaaauucgccugucucugcauccccuguguuggaauuaaaggcaugugccaacacacucaggugcaguuggcuuuauuuuuaauugugggggagggagagaguauguauacauguauaugcauaugccuguagaagccagaagacaacaccuuuuacccugcaguacucugcaagagcaguaugcauucuuaacugcuaagucaucucccuggcuccccuuucuuuucucuuuaaacacugaaaauuggcucaugcaaguagaugggcaucacagaacggagcaguugaacuccaugcagagcugacugcccugaauucagaagcagagcugugucagggcuuugcuguuguucuuuggguuuuucuuuuugcuuuguuuugaauguauaauucuuggccaagggcaauggugaacaucuguaaccucggugcuuaggaggugaagugaaggcaggagggccagaaguucaagcucaaggccagccucagcugcaaaacaaguuugaggacagucuggcaguaugagaccuugucaugaaaagcaucucacuccucucucucucucucucucucucucucucucacacacacacacacacacacacacacacacacauggggcggggggggggaagaugaggaaaaaaagaauucucuuuuuaaaccacucuuacauaaaaauuugagaagguuaaaauaaggauuagcagaauaauccauuuugggggggugaguuggggucuauguugccaagaguugacuugaacuuuuuuuuuuuuugcccuugaaacugagacucacuauguagcucagguuauccuagacucacugugugaucaggcuggcguuaacacacaaaccugccucugcaucccaggugguagaauuaaaggugugugccaccauacucagaaggucuugaacuuuugagcucaagcaguucuccugccgcaacuucccagguaguagagacuauaaguguauacaacugugaaugccuuguuuuucagaaaauuggcaggucguguuagcaaguuuuucuagguaugcuggaucaagugugcuucucaggugcccaguaugaucgguagauguggaguugggggcacagggcacaguucagugaugccaaccccugcugcuaguucucaggggcaccuggagccagaaaccauucuuuccugaagacuuuccacauauuaaaaacagucuccuuggaggagaagccucacagccuuuacuacagcauuugggagguaggagcagggcagguggaucucuacauuugagcacagucuggucuccauagugaguuucaaaccaaccaacuaauuaguucucauugccacaauugaguaggauaggacuuccauauucuggagaaguuguacguuuuggaaagagcuguauuugaaaggauaugguaaagacucuuauuauggaaggaauuccagaaucaucucuaaaaagccugcccaggauaacugguucacucuaccucucuuuugggugguuuuucucccugcauccuugaaauugcugcccuccucuguauucucacuggggccaucuuugucccuggagcaaugaugcaacugggcaguaauucacuaguuucaggaaagccuucuaaaauaguccacacagcagaugcuucgucaggaaggguuagucacagcauuugauucauuuuccuuagaaaacauugcgucugcugucaggguuuuucaaggguuuuguuuuguuuugauaaaucauggcugugguuuuuccuauacuaacaguaguaaacacaugccaaguguaauaaagggaaauggggcagucucuaauggguaaaaccauacugauaaaaaguagcggaaagguuaccagggacugggggaguccaaaugggaguuaagguuuuaacagaauuucuguuugcaauaaaaugauucuggaaauaguggugaugucaaacgacuuagugagugcaguaaguguccccgaauuuuguguguuaagguaguagauuuuauguugacuuuaaaggagagaaagggggagcuggauuaaaguguaagucugguggucuucggguggcuucacacuaacuuaccuggggaauuuagaaucuagguauaugguucauacuugaggccagcuaaaucugaauuuuguggcugaaacucaaauaccuguaguauuaaccccucagauuuuguguuacccacugauauauauauauauauauauauauauauauauauauauauauauauauauauauauauauuuuuuuuuuuuuuucaagaugccucuccaugcaaagcaggcuuccuuacauuaucuuauaacucaggcaggcuggugcugaacuccugauccucccgucucugacuuccaagugcuaggauuuuagauauuugcuaccauauccagcaggcauucuuacuaucugaggguuuucagagugugaaugugccaugccaugcuaugccaugauuuaccaaauaucaguuagaggggauggggauauauauagcucggugguagagugcuugccuaacacauaccagacacuagguuuaagcugcagugucaccagaagggacagacagacagucaucuuccucuguggccuccaccuggcuggggagaugccuugguguauaaagggcuugucacacaauuaugaggaccuaaguuuaaauacccagaaacacucccuuccccaccccccaugugugucugucugucugucugucugucucucauacacacacacacacacaccuuuuuuaaaaaucaggcagauugggauaugguguaggggcagcaagcacguggggcacuugccuccaagccucccacaacugaagcccacuaccucaggcccauaugguagaaagugaaaaccaacacacauggccacagaaaauaaaucaaucauaauuuuuaaaauaugugauguaagcuggacaugauggcacaugccuuuaauccuagcacuugagggaagcaggcaagugaucucugaguuugaggccauccuggucuagagagugaguuccaggacagucgucucaauaaaacaaaacggaaucaugugauauauucuuaaauaggacauaguauauuuuaagcagagaagcauagguauauucaagaaugcuaaggaaagccaggcgugguggcacacgccuuuaaucccagcacucgggagacagaggcagguggauuucugaguucgaggccagccaggacuacacagagaaacccugucucaaaaaacaaaaaaaaaaaaacaaaacaaaacaaaaaaaaagcuaaggaaagggaugaugaccaaggaaauuacacauuuaagauacaauaagaccaaggagauauuugcaacuuauaugauaaauaauuaauaugcagaauaaauuaaugcuucuuucaaauuaaugagauaaauuuagaaaaauugacaaagcauuauaaguagcucacugaaaaaacaaauaaccagcaaauauauaaaaaaaaauucaacucauuaauaaauaggaaaccuuuccuccauaucagauaagcucgaaccagaaagcucaguaaguaacaagggggggugggggggggggagggaggaaggaggaaggacauacgggaaguuugacggaagagauggcucggccauuaagaacaguuguucauccuguaggggaccuggguucaauucauggcacuuagguggcagcuuacaaucuucuguaacuccaaguccagggaauccaaugccuucuucugaccucuguggguacuagacaugcgugccuguaguaauuacugggaaaaaacaccuauaacauaaguaugaaccaguucguacugucagcuggggugggaaagggaaagauggugucugucaguguugagugugaguuccuuugaccagcaguuucacuuuccacaguuucuuccuaagaugcacacacuguagacaugugccugcuuuuaaccgcuuacucgugagucaggagcaggcaggucucugaguuugaggaggaagagcagugaggucugaggcgacagcaccaaccucccuagagaacuuaaaugccugucaagaggagaugccugagaagcaguuauuggcagcugcuagagaacaagccgugagcacagucguccagagaccugucuggagggagcuguugaguggaagaagcacacugcaccgagugcaggacagcacugaucgguuugucuucagaaacccaggugccuuucuaaaaugguaauggaaugaguagaauugggccuacagggaaagauauuauucaucagucuagucaggacacugaauugguaggcaagcuagcauguuauuuuaguguguaguuuacauaaagaguguagcuaccacaagcccgcagagacugaccaaccugagaguaagaaaaccugaggcuugcagggcagcacuugaagagguuccugggugugaucaugggaagcaaaaguguggcuugucugaagaaggccuuggauggguccacuugccaguccuugaccuuacucauucugagguuacaguuucuguuuucauuuucuuuuuuguuuuuguuuuuccaaaacaggguuucucuguauagcccuggcuguccuggaacucacuuuguagaccaggcuggccucaaacucagaaaccugccugccucugccuccuaaguacugggauuaaaggcgugcgccaccacugcccagugagguuacaguuucacaccggcucaucccauguuuucuauagcagugugcuuugaguggggagggaauaagauugagaaaaaccaguguucaagagaugccaguguuugugcuagcaauuguaggcaacuauauucgcauaaggauuagccacuuucaucaucucugaaccaaaauugguagugcaaauaauccagcuaacgaguaaggaaaucauuuggcucuaguucucuaaugcccuugaauacacauucagauauguauuccuuuguauguaacuggccugucaaccugcaaguuccucauuucaaauuaaaauagcaaggccuggcugggaaggugucucagagggaggagggcuugucacaaguguguagaucugaauucaaauccccagaaccacaggaaaucuggcauggugauauaugucuguaauccaaacagagagauuggagucagagacaggagaauggccuggagcucgcaggccagcuugcuugcuggauucuguuguaacaaaaguggggaccuucauccagaguuguccuuugaccuucauaauaaugcugaggcauggaucauacacacagauuuaaaaaaucaucuccaguuuaccuucucugccucaacacaauuuucuuguagacuguagaccuuucugcaugguuuaauauaugcuacuuucucuuauguguuacacagcuguccucagaguccauagagaacccacuacugauacccaaauccaccaaugcucacuguauuacagaaaauggcacauaguguuuguacgagauauuucuauagacuuuaaaucaucucugcauugccuauauacaauacauaauccaauguaaaugccauauaagugaucguuagacuguauuaucuaagaaauaacuauggaaaagaccaguugguacauauucaguacagguaauuuuuuaaaaauauuuauuuauuuauuauauauaauuacacuguagcugucuucagacacuccagaagagggcaucagauuucauuacgggugguuaugagccaccaugugguugcuaggauuugaacucaggaccuuuggaagagcagucagugcucuuaaccgcugaaccaucucuccagcccguaauuuuuuuuuuuaacccugaguauuugcuuacaguugagugaaccuguagauaccuaacucacagauaugguggugauuuguauuaucugaccaguagagguggaauuguuagacacgcuaacuugaaaguuuucuuacaauugagucuuaaauaccauuggggagccucagauaucccugauguagagacagagagacugaguggccaaugcuguuuuaacauguguuaaggauaauacauuugcugaacagcagauaaggagcugaauuuucaaagggcagguuucuagcauaguaggaaugauuguuucauuuuagcuaguuuaggcuuuugcuuuuucuccagauacuagauugaaacccacaucuuaaauaugcuaauaaaguguucuaccuuccauuuagcagcaugucucaucccuucaguuaggcuguuuagcauuugagaaaaucuuauuuuaaaaccaucuauaguuuguguacguguggcugccuuggcuaaggaugaccuggaacugauacuccugcuucugccucccaagugcugggauugcagacaagucaccaugcccaguuuacuuucacguaaucuuuauuuuuauaugugggugugucugugcaccacaugcaugcagugccuguagauaccagaagagggcauugaauuucccuggaacugcacuuaacagacuuuagaacuaccaugggaguugggaggguggggaacuaccauggggugaauaggagucaaacuuggguuccccuggaagagcaaccaguguuccucacggugagcucucucuccagcucuugcagucuuuacuuuuguuugcuauuaacauggauuugaugcccuuucucucugguuguacccuggaaggagcaguauuuucuacugugcuuggaguaaguuuacuggucagccuagggcccuuuaggcacacacagagaccuaagucagaaugagagcagccaagcaagcuuauucuagcccaauuaaggacagccugaacaguccgauccuguugauugucucccuguggauuacagcagaccuuccuuaacaagcacauugagaggcuuuacucucacaaccucuccaggaccacuaauuaggccaacuggcagugaacaagacacagagucaaauucuggaagggaauuacuuaacuguuucuaugcuggacaacugguaacugauuuuccccauguagucagucccuuucuggucagucaugaugaucuaugccucuagucuuagcauugaggaggcugagcaaggaaacucucaaguucaaagccaggcugaggggggugggagggaggggauagauaaauaagaugaaucuucuuuuuuuuuuuuuuuuuuuuaaauuugggacagucucuccuuuuguagguuguuauuaaugggacuaaaaaaggaacuuuuaaguuuguagcaucaguuuauuucauuugugcauuugugcucuuguuuuuuaagugaagaaauagaaaauguauauaagcccuuuucugcucgaggcuagaaaagacagucaagaaacuaggauaaaggaccucaugaggcagcugauagcauggguuugcaaauagauauauuucuauuagcccucuguuugaugccucagagccaaauauacaugaaguguauuauaucauggccugagggugggagaugugugagucggaagcauuuaggaagagaugccauggcauggcccacauaggaagucacuaggccuaucuuugucauauaagcauggaugauuugccugcaugguccccugcuguauaacuauuugaauuaucuucugauauaaugagauuccuuuuuuuuuuuuuuuuuuuuuuuuuuuuuugguuugggggguguuuuuggguuuuuuucgagacaggguuucucuguguagcucuggcuguccuggaacucuagaccaggcuggccucgaacucagaaauccgccugccucugcuucccaagugcugggauuaaaggagugcaccaccacgcccagccgagauuccauauuuauuauaaaaagaauuauaaaaacaccuaggagauccauucuuccauauuaaaguguuggcauacucauucacugcagcuuaauccuuaaguauccccuagcauuuuugcuuuaccguuuaguuacagccaucgccaaguccuugauuccaacuccuugcucaaaauguuccucucccucugguuuuacagugcaaaggcagcacagauguguucuugauagguacaugaucuaagguuuaaacuugauaaacugcuuuucuugccccaaaucaucaaacgugcugaagaauauucacuccacagaccuacugucuuccuacaugcguacacugguuccugugccaggaaaugugagucaguaugucagcugacugugguuuaagccugguuuggcuucaguuagcuucccaaaaucaagcugagugaaguccauaauguauuucauauagauguugcuccaucugcauccaagccucuuacugcugcuuccaaggaacuuggaauaacucuuggguuaguuucaccuuacuaaauggaaaagcaauuucuuuuaacaucuuauacacaucuaccucuucauggauauaauccaccuuuuagugauugugguauuuuucgccugcuucucuggagguccugcuccagucaucuugguuccagauaacagugguucaaccugcuacucacaucuagucuacuugaguaccaccuccaaaacaguguuagcagcaccuugacguggacccuuaacucauggaaguuauagaaggaaaaucagcccuuaguguaguagugucucuggaggcacaaaucauguuuggagauaggcauuguuguccuuuuaagaacaagccuacaaaauguagcuccuauaaucaucaggagugcccuccuuuaguuggccauggggcagaaguaacuguaggaagcagugagcucucggcagucccauuuggaacuuucuggacuuuuaggggugcucccugcuuguuggucuuagggguguggaguccaggugcacaucccauguguuggucaugagaucacuaugaugaccaugcucuugucuuucaggcucagcuucgggcauuuaucccagagaugcucaaguauuccacaggucgggggaaaccaggcugggggaaagaaagcugcaagccuaucugguggccagaagauaucccaugggccaauguccgcagugauguccgcacagaagagcaaaaacaaaggguacauuccucaguccucauuaguuugccaugcugggucacccgccucaguuucuguugguacaaguuucauaccauuucauaacagucaggccucuuccuccaaaaaagucgguuguucucugauauacaguccuucuuguuuauuacuguacacagaaagauuuggaaaggcuguggauuuauacuuuguuucuucauagaugucuuuuguaaaagcuuuaaaccagagaaacuuggaaguaagaaucauuugaaagcuuagaaauagccuugcuucugauuagcaagaacuacuguugagcgguuugguggcacauucuguaaugcuagcacucagcaggccagcgcauggaaucucuaguuugaggccagccuggacaacauaaugaguucuagaccaaaccuaccugaaaacaaaaaacagacaaacaaaacaaaucacuagagaguuaguugagugguuaagacagcuugcuguuuuugcagaagaccugaguucaauucccagcacucaugucgggugacuuacaaccacacguaacucuaguuacagggauccaacucucuucuggcugccaugggcaccgucacacauguaggauacacucacacagacacacccagauaauauacauacauacaaagagacauaauacauacuucuugaucagaguguuaccucuuaugagaaauuggagaguuuggccucaguuuggaauaggacacaaaagcaaaauccgaacuugguuaggaaggaaggacagaaaaccaucaguugcuuugcuccagaauaauucugugggaaguccuaaaaaacuaacucuauacgagguuugauaaauacaugccugauucuccugugguggcauaaauccccaauuucuuuguggcuuauuaugcuuuccuguuguuuugaugacagguuucauggacccaggcauuacggaccauaguuaaaaauugcuauaagcaacaugggcgggaggaucuuuuauaugcuuuugaagaucagcaaacacaaacucaggccaccaccacacacaguauagcucaucucguaccaucacagaccguaguacagaccuucagcaacccugauggcaccgugucgcucauccagguauguaagccugaugucucaggggagguggcucggugcuaucucaccucuaauggagaaguuuccuguguucaugcucucuucucugcacauccuaacagcugcucucgcucucgcucuuccugccuagcagucgcuuccaaacaguuucauuuauuuuuuauuucauuuucuugugcugcuuggaaugggaaaguccucacccacauggccacaucuuaucuccagccuuugaaccauauuuuacauugcaugugcuuuauuuaauucagagcuauaaguagcuucuggaacauuuccaaacaaagcaccugaaaauuguuucuuggguuaggguccaauuaaauaguagaaugcucgccuaucauguagaagaccaucaccuucaauccccaucaucuggagagagaaacagagaggaggauuuuggaggaaggaggaagggagaaagacagauagguguguaccugccagagaaauaccuuuucuaagguggaacacuguuuauugacagaugaggaaucucuaaaguucagguugggguuagaguguagaguguugguugacuggcaccaaacuccagaguggaaugcaguuauucuucuaauauugguucacgcuagucucugagagcugauuuagucauucucuuccugucaggaggcauauuaugcagaauuuggggcucagcgagucuuagcuuaugugugagggcuagguagaaggucugucuacuggcauuuaacuuccuguguuuccuagguugguacaggggcaacaguagccacauuggcugaugcuucagaacugccaaccacagucacuguugcccaagugaauuacucugcuguggcugauggagagguaagaaaaggguuucuguauuucccuacuggaguagugcaugaaugaguaggaagaagucaggcccagaagacgaaggagcagccuugcaauaugugaaacuuuuaguauuuauccaaccaugacaauuuggagaaguaucuaauauuguguuaauuguaauaauuaaaauucauggaucacuacugcccaaaccaaccuguuagaaacuuagaauuucacauuuguaauauaguauuuaauauaaaacauaauaaagggauuuucucuuucauauuuuuacaagaaaggccauuugagggcuccaaugcuuaguauaggcaaucuccauaguugcaaaaagguuaaacuauguauguuaauuuuauaaguauguaauuuauuuaagaugcaguuggcuuaagauuagauucuguacccaaacuuaguggugccacaugccuuuaaucccagcauguggaggcagaggcaggcagaucucagugagguuaaggccagccuggucuacacagagaaauccugucucaaaaaaaaaaaaaaaaagauucuguuguccuuuggaccauuguugguauuggucauguugaaugcauuagacaucagaaauuuaaaugauaucuaaugauaauaguaugugugacucugcuggacaaaggaaaaaaccaccaaaguacaaagacauuaaagaugugagcuuaaaguggggcacuagcacgugcgauggguuugagauuagaugacacacucugguaggauuuaaugagcaucaauccagcuaaaauauagacagguucaguaacaaguaggaagagacaggaguauguucuccugccauacguucagugacugcucuaucgccuaugccaggcucugcagaacagauagcagacaacaaacuguucuuguccacagggaccauacauggugggugggaaggacacccgugggaaagcauucauugagcagcagcaggaagggggagaaggaguggccuguggagugcggggguuugcuucugugugccuuggagaggagucaugcaccugagcucggacuagagggggcaagcaagaacaaaggguucugggauagaaggguucugugcaaggcaagcaggcauuccacacucugaguuuugaaaacuugaaauggcuacagugaccugcucuaaccagacauaacaggggccaccauuugaagggccucagcacaaugaguuucucucagcaaggcaguaggacaucuucugaauaacucuaccucuugggcuuaaccuucucuuuggacaugguagcauacaaacacauacagucacaugggaaggaagggaugaacaaggcucaggcaacauggccaaggaaagcacugcuuagaagcagggccugccaaguuugccucugccucccauccaaacccaacaaguuucuuccccauccccuuccuccauccaucuuucccugccuuguucccuuccuaucucuugacacgggcuuacuauauaggccaagccgaccuggggacuggggaccuccugagugcugggcuaggcaugugcuaccauacuggccuccagaaaguauuuucagugauuucuuuuagucuuccagaacuacuugguauagacacaauuaaauucaaauguaaauucuaacagucccccuuuuuugcacagaauacagcaugcugaaacccucccuauacauuauaggccauguugugugcauucauuuggugaaaaacauaauaauguuauguuuugacuuuugacuguccuuguccuuucugccucagguggaacaaaacugggccacguuacagggcggugaaaugaccauccagacgacgcaagcaucagaggccacccaggcgguagcaucacuggcagaagccgcaguggcagcuucucaggagaugcagcagggagccacugucaccauggcccucaacagguggaggcaggggcggggaagacugggauugcaggccugugcuaaguaagagagcugccgcgguccuccucagucaagcauaaagcagacauucugaugcugagcuacagaacuuugauuucuaaccagccccaccaagaaacauugaacccuuucuuuugaagacuaucuaggaaggacacacugcagaaagagagaggcauuuaccaaaacagcauugcauguuccuuucuggccacuuccuccugaguauugacaggaaaggucaucacccuauuauucuugauucuugacccaauuuuauuuucagcagacccaagaauuguuauuaaucauuaagaauggggaccuuaaagucacucugcccugucauuugcuggcuggcugaccuugagcaguuuauuuaaacucagugcccagcucucuuucuguagacuaacuguaugccucucccugccgugaggagguguugaaagaacugaaggcaucagugugagugagauccuaggaucagugccuggcguauagucagggccgcugcuaaucauugugugcagucuuuagcucacauaguccuugcacucucuggcaagccagcgcucuuacaggugagcuaugaguagagaggaguguugcagcagucucugcugucaaagaaauccuccuuggaccugggacuuaauuucagugaaccacaaaacaguugauauuagaaugagcauuguagauauccagagaggaauacaaaugucagcuaaguguaguuugugggcaucuuuuuuguuguuaagcugcuuuuuaaaaagguuuagguugguagggauagagggcugguuuuuguuguuguuguuguuguuguuguuuuuguuuuucgagggcuggagagcacagaugcgcuugugugcagugaguugaaugaggcuauacaauguguuguuugacaagaggucaaacauagauuucugguuugaauccuggcuaaacucuuuguuagccauuugccccuaagaaauuuagucccuagugugaguuuccucuuuguuacuguaggauaauauucauaaacagacuuaagaacucaguaauacaggauauaugaaguuuuuagaggcaccugcucauguuaacacucggggaauuaagucugucuuccuuguuucuucucuuccuucccucuaccuuuccuuccuucguuuuucccucucccugccuuccucccucucuucagcccccucucccccuaccucuuucuuuccagggagucucacucuauccuagguugaucuagaacucacucugucccaggcuaaccuugaacacgugcugauccuccugucuuuuuuuuuuucccccgagcuaugguuucucuguauagcccuggcuguccugaaacucacucuguagaccagacuggccucgaacucagaaaucccccugccucugccucccgagugcugggaucaaaggugugcgccaccacgcccagcaauccuccagucuuaaagucucuggaguacugggauuauauuauaggugugagccaccacgcucaugauauuuaaguuauacugcaagggacuagggacugagauuagugggggagucugaccugcgugaggcccuggauuuagguuguguuuuaagauuugucuaucagaauugauuauagugggauauaaguauaaagccaguuaggacaaggcaaacuagagccuagauaugcuuuguuaaagguuugaaaguccuugauuugaaggcagucaugauuuagacaugguugaucagacucuaugacugagacucaagcaugcacacacucuuguccucuuaagacuuaacaugugcuggggccacugaugugugcuuugcagagucgugggaaauguaacuguucucuagagguuggccuucuuccauuccuuccuucaagguacucagauaaauuucuaaaagcucggagggaaacccaccugccuuuggacugguguccccuuacuguuacuuugggucuaaaguaaaguaagccaucacuaaaaaccaacaaaaccagaaccuugcaaccaacaccuugaacuucccagugaagugugguauccugggaacccugcacauaguggaaaaucugaggcauauucuggcucccuucgcugugaggguaaaguuuauuucuaaaggcagugagcauaaugguauccccugagggcuuguuaacagaacuaagaugcagcugcaguguuuacuccagaaaggagaguggggggucacuguggcuugaaggagaaaagagauguugaaaucuguuugcaaucaguccaaugccccagugaguccuggggugauguguugccacuuccgacagaagccaagccuggcagcacagcaaacuguaacccacaggugacugcucugucaggaggguugagugagucaguguacuuacuugagauacaggggaucccuuuauccccucaaaauucauuguuggaaauccucuugaugaacaauacagagaaugcuggugguuguuccugugguaacaaggugguuccauaaucugcccuagucuguuucagguacagcuggaacaagcaugauucucuaauagccaccugcaccucugcugcacuauaaacagcagaugggagugcagggugagaaaggagaagcaagcuguggggaaaggcagauggauggggccuaaggaggcguaggguuccuucauccacuagagggaaaguggggacagcugcaggacagaccuguuuuucaacuaugcuguuaaaagaguuuuuacagcaagucagaacaagacccagagcugcacagccucuuagcccacccuggcuuuguaacaaaucuaaaggggcucuaacaaucuaaagaguuaucaguauuagaaacugaaauugguguucauuuuaauguauaaaauaaagaaugaauuggcacuuuuagggaggaggcaggaaaggaaucauagugaacaaauaaggagagcaucauacacauacacaaaacaaaaacaaaaccccaagcaaaccaagcaucucuucaucugcacaaacagcagggcgaggaggcaacugugccucccuggcuagggucuucugcacuuaaccagacccuccugcagagaucugacuuaagucccccagugcagcccugcauagagauagaugcaugcaugggagagguuugaacucuguuguacacugggccuguauuuaccuuaggaaaaaccuacuuuacauuguuuuguaaauauagcauuugugugucugcugaccacacugcuuccacucagcaccguaaggaagcuggggccuggucuuucuuuccagggagcuuagaagaugccuuucuuuaacuguggccacugcuuuaaaaagaagcaaagcagaacaugaugguaccugcccuuaugggcacuugaagcacuugauuggcuagaaucugcagaucauccaggcucaaacaaacacaaaaagacaagggacaggaggaaggaaggaaaagaaaaugaaccauauuuuaaaauaaaguucauucuuuuuucuuuuaauugacugauauacugauacacauaucuagaaagcauugugacauuuuaaaauauucuuauacucuucuucaagcuaaaaauacuauuagagcuauuauuuacauguauauauauauauauauauuaauaugacauauauuaauauauugaccaaagauccacccccuuuuuauuuauuuauuuuuuuuauuuuuuuguuuuuguuuuuuugagacaggguuucucuguauagcccuggcuguccuggaacucacuuuguagcccaggcuggccucgaacucagaaauccgccugccucugccucccaagugcugggauuaaaggugugugccaccacugccgggcacccccuuuuuauaaagacauuuuaauuuuauauuaauauauacauauaacugauauagacuauauuuauuaaccauauuauggaugugaauguauauuaaaauaguguauaguaauaaguauuauguauuauauauaaacuauauuguuuuaguauauagauugacuugacauugguccaauaagaggggauggauaauguagauccgaacauccuuaccuauaguaagaaagagugcaucuuucuuguagauuaaaauuagacauauacuuaauccugacacuagggaggcagaagcagguggaucacugaguuugaggccauccugguccuacagcgugaguuccaaggcagccaggguuacacagagaaacccugucucaaaacaaacaaaaaaauuagacaucuacaaaaguugaugagagacauggagauaucauaguaaaguguuaggagguggggggagggcagugccauauuugauuccuauccccagccacaggguauggugguuugcuuuuguaacucagcagugcucgggagguagagacagcagaucccuggggcucacugacugccagccuagccucaugggugaacuccaggccagugccuuugaaagaggggaguggguagaucccuggccaguacacaugcaguguuggaaucuguucuggugugaaaguggauugugacuaaaauuuacaaagugauaauauuuuaauuaguauuuacaguuuuaaauaaugaauuuuuaaaaauauuuauuuuauauguuuguaugccaaauguaugcauggucccauuggcagucagaagagagcuucagccucccuggaacuggaaccacaugggugcuaggcuucuaaccugaggccuccgcaagagcagccggugcucuugaccacugagccagcgcuccagcccagaaaguauauauuuccccuugguaucaaguguugaacuuaggaucucacacaugcuaggcacuugcucucccccugagcuguauauauucucaguauuuuuuuuuuuaagauuuauuuauuauuauauguaaguacacuguagcugucuucagacacaccagaagagggagucagaucuuguuacggauaguugugagccaccaugugguugcugggauuugaacucuggaccuucggaagagcagucgggugcucuuucccacugagccaucucaccagcccauucucaguauuuuuaaguuuuaauuuugugacaaggugucacaguggugccagggcuggccuugaacuuauuacuccauaguucauaauuuauauauuccuccugcucagcuugcuaaauaaguaggauuauaggccccagauaugacucuaacuacuccaacuaacccagaacaagacccaguaagcuucaaacuuuggguauuccuucugccucagccuuccaaguaauuccaguuaaaggcaggacccacucgcagcucuuugggcugaugucugauacaguguucuuaccaacucuuuaguuuaucuaguuuauccggagauucaguuuuucuauagaaagcacagacuuuaccaaaggcucuccuuuguuucuagaauaacccuguuuccucaucuucuaaguggcgcuugcuccauccauacuucugagggaugccccagugugugcuggcuuuggucuccagcucugcaaaacaaaauuucaguaugauucugcuuauuuguuugauaugugauagguaguauuucugagaauuuaaauucugcaagguucuguguguguguguguguguguguguguguucauauucauuuuacauagggggcagggcuuaaaagcaaagcagauuaguucugucugucugucuggccuggcauuacuguacccuugcuuuaucugcugagcuucuccuaugaaagaacuguauguaauaagguaugcuuugguauggucugcucagugacuugucuauaccagccagucccuacucccucaccagucuccacuagagccuggggugcaagaggguaaugugaguagugcaaagccugcauagucuauucugguacucccucaggaaccccagauugucagcugauagcuccaucuucauaguggagauucugaaauuccucugggcuguuuguuuuguuuuuaaaaucacuaaaauuuacaugacaaauuuuagucgucuuuaggaauuuucuuccuuaaaauaaaaaauaaagcugggcgugguagcacacaccuuuaaucccagcacuugguaggcagaggcaggcaaauuucugaguucaaggccagccuggucuacagagugauuucuaggacagccaggacuacacagagaaacccugucucgaaaaaacaaaaacaaaaaaacaaaacuauauauauauaauaaaaauuaaauaauugucuuauuaagugguuuaaaugaaaagauaauaguaugucuuagaggacaugacauuacagagucaagaaaaauggaugauuauuuauauaguaaaagcagauagcaaggagaaggaaaaacugguagaaccaugagcucccuuucagcagcugucucugcucugugccuuguaggaaagggaggucaugguucccuugaacuuaggaggcaagaagcugggucuuacgguaaugacuuaaaugccaagacuccauguguagugaugucuacauagaagugaagcaagaggaggagcuggauaguucaaguuagccagccauugcuucacauuuaaaaagcauguauauaaacuguguuguuauuauuuaauaugggucagauagcaagucuagauugcugacugcuuagauuaucauucaucuuuuuggcauaaaaggauaacuucuaauggucugccuuauguugucauaagcagaagaggaaacauugugauugacagccaaaaugguuuuguaugagcauggaucagagcuugcacuuguaccauugauaucaauacggaaggacugauaaugagcaucuucuguccucacucauuaccauaucucagcuuaaagaaaacuucacauuagcuuuagaaaauauguaugacuugagauucuucuagcuguuuauaaucacugaaauuacucuuacccuuuagcccuggugacuagcacccauguugcccaaagagccuagggaagacaguguugugccuugacucaucuugcauauaccccuguccuaucucuguacccacagugaagcugccgcccaugcugucgccacucuggcggaagccaccuuacaaggugggggacagauaguccugucuggggaaaccgcagcagccgucggagcacuuacuggaguccaagaugcuaaugguaagagaucaugaauauuuuauugacuguauucccuguuuccacuuaaaccuuccugauauagccagcaacaaacccguuagaaagacauugagcuugguuugaguuuuucuucguagguaggcaauuaaugccuaggaaaaucuaggggcccccgauuccuuuuacuaauaggauucuugagguucccugaaggaaaaugcuauaauaauggcuaccuaauuggaguauuuuuuaaaauuagcuguuuugcuaagaugagaggugcugaggcauacuuaagcauucgcuuuggagcacuuucuuccuuuacuguccuacgggguaggguaaguuguugaucuuaagccgggcgugguggcgcacgucuuuaaucccagcacuugggaggcagaggcaggcggauuucugaguucgaggccagccuggucuacagagugaguuccaggacagcuaaggcuacacagagaaacccugucucgaaaaaaccaaaaaaaaaaaaaaaaaaguuguugaucuugacugcaguagagacucccacggguggguggaacgcaccgacucaggccaaaaggcacagcaaaacaaaaaggguaaaguucauacaagugcgguggcaaaaacuuauggcuccaacccagaucuuuggguccacuucagcgggcucuggagucaguggggaggcccugggcucccggggugucucagaagaccgggggggggggggggggggcagccugaucuguggcacugccugugccuagcaggacuacuuaugucuuauguccuggcaagaggguaaauagauaacaucuuuuuaucuaggcagacaguuccuuaguggcauuaaaugucugaaagagaaguuucagcugagugugguggcacaugccuuuaaucccagcacugggaaggcagggcaggcugaucucugagaaguacuauagugagacugucucagaauaaagagagcaggguagagguggagggaaggaggcagagguuucuuugcagcacuauuucuuugguuuuauugucggcccauaagaacuaaauacucugcaagucaggaaugucuuugggggaagacacaauguguccuuuacaguaggaaaagguuuuucuguaguacuaggagagagagcaauguagggacuacaagcuaaugucauuucugagaauuguuuuuccaaaaaagaaaacaaauuacauacuacaacuacuggcuguuuuucucugagacugaggggcuuucuuucuuacacuaaccugcauggagauagugcugguuuuagccagaguacuguaggauaaaggacacagugggccauggagggaauuaaggaacaguuccuucuguggcuaggacccugccucuugcuuuuccuuugcuuuuccucaucugcguucucaucuccuuacugaggggaagguaggcucucuggccacauggcauccuucugaacuacaguucucacucucaguggaacugcuaagacacuuaccauauggguuuugugggagauuuuguuacucauucugauaggcuuuauauaucugagagagaacuggcugcuuuaggguucuagcuccuucccagccuuaccuuuucagaacgacaaauuuauacugaugucuaaagaugcucuggcuauccagccaaauagacuugaugggccauauaauaaaguugaaucacauucucuccuaucuagugcuagaaguugccuccucuuuaguaguuuccguguugcuggcuguauucuugauaaaagaacauuugugaucuguaucuaagagcccacaguuccagccaagccuagugacacaugccuguagcccugcuacucagauggcugagaauggagggucacgcacacucaugagacuacccuggccaauaugggaagaacuuagucucaaaaauaaaguuuaaaaaaaacuuaaaaagcuguuagucucccaagcaaauuauugugugccaaguucgggauuuuugacuuggacucgaccuuuucuuacuguagguucucuauguaccuaaaugagugccuuguaccacaucucggugauucuaggcaaaagccuaucauuuuuaucuguucuugggaaucuagacaguccaguaugggagaugacccagguugcucuggcauuccuucuguacugacauccucacccagagugcuauaagguucacuguggguuggagcugggcauucacccucacccagcuaaugguagcuggccugaccagccaggcucucuucauucuuccagauccugccacuguguaaugauaaacuuuaagcauuugccaguaaacuaacagaucucuuuuguuuuuaaaucaaaaaguuuauuaucaggaagaaucuaaugauggcagaauaaaguccuacuuguaagaguagaacuaacuuagaaauggacacuucuugggggaaauguguuucagacuccagaacagucuaaagaagaucuuagagcgauucagauaugguuucugaccugaagaggaguuaguggagcagaguagcaggaauggauuggccacagaauuugacagaguaaaguaaccacaggcgguagguuaggguguccuguagacaauggugaugauccugacugggugacagagcaguccucauaaguguacucuccgucccaggagacauccccugcuuuucugggcaccacuuucauccuaacaugacaggacgguggagcccuaguauggcuucauucgguuuaaauucuaugaggcuacacacuuuagacuguucauuucccuuuucucuaccauccucuucucugcuaggccucggauccccugugcuuccagaaaucauggccuccaagaccagaggauacaggcacucuugugggagagaccuuuauaggcuuuucuccuuuuuccuauuauacagcaaaaauaaugaaaggauucuguuggcuccugcuaccucaggcagccccugcuuuuaugucagaaauauuaucacaauucguguggguaucuuaucuuccuaaaaacaagaugaagcggagcuaaacagaugaguguugcuagguacccgugcuucuccugagagcugcugacccucuuccuagaucuggaagggaaacaaaggacaaagggagccuuugcuucagccuuugcuuuuauuuucuguuugcuugcuuugcaggaggcaauauuuuuggguuugccuugauugaauguugauguuugggggguuguuguuguuguuguuguuuuaaaucuggccuuuucuuucuguuugucaaaaaaaaagaguauuuucaaacuaaauaggguugcauuaucaguauuacuuuguaacucuuuuugaaguauuuuaaccaucuucaugucauuaaauaacuuuugaaaaggccauuuuucuaaugcuugguaauaguuuaucuuauuauccauaauugagagagccuccuguuauuaguaacuuagcuuauugauaggguuuuuguuuauuuguuuguuuugguuuggguuuuuguuuuuuuguuuuuuuuuuuuuuugguuugguuuuuuuuuuggggggggggguuucaagacaagaguuucucuguuuagcccuggcuguccuagaacuuacucuguagaccaggcuggccucgaacucggaagucugccugccucugcuucccaaguggugugauuaaaggcgugcgcuaccacgcccagcgauaguuuuuuuaaacaauaaaaugguacuguuuauauuugcacaagauuugcacagcuuuauuuauuaucuauuuauuuaugugguauuacauauccugugcuugauugcuuucccacugggacaaccugcuucuuuacuuuauacugaauguuagcauaaucuuauuuuuuaucuguuuuaagacagguaauaaguucugucuuaauuugcauuucaauauuaauaaugccuguguucaccuuuuucauuauuuuguuuguuuguuuuugaaaugggcucauuacguaguccagacuaggcucaaacucaaaggcaguccuccuacagcaugaccuuaaauugcugggucacacaggcaggauuuagccauuguagccagcuagcuucuuacccacauuugugcauuugugguuuaacauggaugaauguuugccuguuauuuguccauguucuaguaauguucuuugucauagauguguacguuguauugucuuuaccuuucuauuaacuuggaaaagcuugauucuuuuuguuuguuuuuguguucauagaauuuuugcuuuuguuguuauuuuuguuuugagacagaauuucgguuuuccaggcuggugucaaaaucaugaugcgccugccucagucucccaagugcugacaucacuggucggccacugcgucugcgcacuucaugcucugugggucuuuucuuuuuuuccuuucuuucuuuguuuucuuucuuugucuuuuguguuggcugguugguugguugggguuuuuuguuguuguuuuguuucccaagacaagguuucaauguguagcccugaaugucccacaacucacuucguagaccaggcuggccuugaacucacaagauccaccugccucugccuccuaaauucugcuacuaaagguaugcaccaccacuuguagcuucaguggucuuuucuaagugucugacuauguuuuccuccaguuuuaauauggucuuuagggguuuguguuauagggguuuuggucuugguuuuccaagacaggguuucucuguguaucccuggcgguccuagaagucauucuguagaccaggcuggccuugaacucagaguucccccugccucugccaagaguugagauuaaagauauauguuaucacugucuuuuucugguaguuagaucguuuuuauuagguugguuugguuuuuauuuuuuauuuuuuauuuuuuuuuaaauagggucucauguagcccagccuagccuaauauagucaugauuuuuuuuaauauuauaaaauaccugaaauuuaucuuaguguacuguauuaaguagaaauaaguugguauuuucccucuguuucuauuacaguauuuggaauuuucagucaauuaaaagacccauuuuuaaauuuggaugaaagaaaauagucaaaauucuaaagagugagcuuuacaguaguuuugaaguucccguagagaaguggaccuugguuuuuacuugauugcugcagaccucuuagcagcacugccuguuguccucagucuuccgucuagaccugagaggagggaagugggcugaaggaaggcugcuccccuucaccucugggccacagccugcucugccugcuggcuccggcagcagcuuuccgccuccacaggccugcuauacuacagacaugagucuguuuacugccuguccugcugccgaaccagagcagagguuuccaaaccuguaggaaacagcucucccuguccuuuccucacucagcaugaccucgaauuuucugacaccgcccccccuuccuuuuuguuuguuucuucguauuguuuuguuuugagacaggguuuuucuacauagccugauuauccuggaacugacuauguagaucaggguagccucaaacucacuccgugcugauuaaggcaugcaccacugugguccuuuuaaaaaacucuugcuauuaaaauaccucucaaguuugaucuuaagggcuugagaaugugguucagggguagauugacuguguggcaugugcagaaccuagagcagaaagaaaaggacagaaaaggaaaaccgaccagucaucuuagcaagaagguuaacagaaaagaugagucagaacacgcagaaggcucugagaaaggagcagggcuguugggugacauccucacaggagaaggugggacaugcauuucaauucaagucauugaagagguucuaaggccugccucuaagccuccuucauguguauuauaagagcguuagaauaucuuuaauaugaggucuguaaucaaucaaucucucucucucugucucugucucucucucucucucucugucucucucucucucucucucucucucugucucugucucucuggcacaugcacauacagauugaaccucugcugcaaaagguggcaggggcuagggauacaguucaggaguagacauauaugugcauugcuuaugccaagcuguggugcaucagugaaugggaggagugauagcaacggucguuuaacucuuuaucucauaugguauuuagaguagccggguugaggaagauggacagaucugugagcuaaaugcucugauacuguuaucacuaacaauauggaagcagaagguuaaccucucuaguccuuaacuguacaguuaggauaaugguuggucuuuguucauauggugguaagcauggaacaaaaugguuccuguccagggcuuagcagaguccaggguacaucgauagauugucaguggaauggugucuccacacuuuacucacugggucaagaaguacggagcucacaguacuaguguaggccauguuuuucauccuuagaacagauccagagguggaaaccauacaauugagaagggucagaagcccucucugcauccuugguggaggacaauacaagguggcauugcuugaagcaccgccuccuuugggucguuccuaacauguuguucuuuuaugcacugauuacuuuuugacuugguguugagauuuaaauaaagacauugaacaagaauccauuuuggggccgaugagauggcucaguggguagaaauacuuccugugcaguccugccaaccuguguuccaucuccuggucacucagaagacaguaggcacccuaaacuuguccgcuggccuccuaugugcgcaugcacgcagacuaauaauaaagaaaaauuagaauuagccugaugugguaguacaucccuuuaaucccggcacucaggagccagaggcaggaugauccacaaguuggaagccagcuuggucuacauaaugaauucuaagacaguuaggacuaaacauagagacucuguaucaaaaaggugaaauuauauuuuauauaccauucauaccugauccaaaugugacaaaugcuguacaccagccuugaaucccagcauuugcaugcuacugccuuaucgucaaggccccacagaguaucauuguaguugcugugggcuuccuagaaggcaauggcccucuuuuccacuggccccauuggugaugucugagaguaaaggcccugggaugucauucagaccaagccaggucaccaucuuuucugcaagagaaagccacuacagaucuauuccuaaugcagcuggugcacuggagaucccagagcaccugcacacaccggcuaaggucuccuuuuaugaaacaagacaugagugcagcaggagagcacugccauuguggccuccauagcccgccaagaugucagcugguuuacacacagguuuuccccacuuaagucaacuaaagaggagacuuuuuuuuuuuuuacauuucaaaugcuauccccaaagcccccuauaccaccaccaccccgccucccugccaccgcccugcuccccaacccacccacucccgauuccuggcccuagcauuccccuguacuggggcagaugaucuucgcaaguccaagggccucuccucccagugauggccgacuaggucauccucugcuacauauacagcuagagacacagcucuggggguacugguuaguucauauuguuguuccaccuauaggguugcagaccccuucagcuccuuggguacuuucucuaaagaggagacucuuuaaacugaggagguuugccagguaagccuagucagagaaagagccacuuugauuuugccacaagaaucacaaaaacaacaaacaaaaaaccuuagcagagacaaauaaguccauaguaucaaaccuagcgucuagaauugacccagucaggagcagaagcagacucugaggugaagggccacauaaucccaaguaucagggucagguugaacaguguacugagugucucuucaaaacagaacaaaagauaauuaaaaauguacuguccaggggcugaagagauggcucagcaguuaagagcacugacugcucuuccagaggucccgaguucaauucccagcaaccacaugguggcucacaaccauccguaaggagaucugauguccucugcuggggugucugacgacagcuccgguguaguuacauauaauaaaaaaacaaaucuuuaaaaaaaaaaaaguacuauccagccaggugugguggugcacgccuuugaucccagcacuggagaggcagaggcaggagauuucuaaauucaaggccagccggggcuacacagagaaacccugucucgaaaaaaaauagcacacacacacaaaaauguucuauucaaugugauagcuguuuucuauagguagccauucaaaugaaaguagauuauaacuaaaauuuaagacauuuacucaguuacgguaaucauauuugaagugguaaauggucauuuguggucugauauccugaaucuuuaaucauaguuucuucaccauuaaauucaaauaagagcauauaccuagugaccacuagacuagccuguaagucuacaauaaauccaguaguacauugccaucacuggagaaguuucuuuaggacaauauauauagcaaaaauaccaaggccuucuccuagcagggaggccauccagaccuuaggggcuuugccuccuaccuccucagcucuuacacaucauggcuuugaugaagagccacccaugugacuacaugaagcuacaggcuguaaacagcaaggcaggagggcuuucaaggacaguggaguccugaguggagacccugagacaggaggcagugacggcaccuagaacccccuuccccucuguuuauucaccacacagaccacuagcauauuucugcauggacuccucacacaagugcagguucuuccuuguauguaucgaucccuguagccagguacccagaaccaaguauggaaagcccggaaggucaggaaucagaaaguagccauugcuccuagaugaauuccagauggcaccacaaacacagaugcugcuaagaaauaggaggaugaagcugugcuguggacucuguuaugucgcgcaaaaaaucccuucaguccuccaccucgugggugcuccucauucccugccuuucgauggccugagagaagaaagggacuauuaggagucuucaauccggaagccucuccuucaccauucugagugacucugaaauccacaguagccucuguaggaggcagcaguuuccccggcuucacuuucucccguaggggugggggugggggggauaacaaugacaucaagggcagcagaaacugccuugucaugcucuguuaguguuggggacacccagccaccauuuaccauuuugccaauuaacaacuguuaucuuuagacaaaaccucacaggaaaugagaaggaaacaagagucuacuugaggaaguucauauccuccagaggucccaggccuuccucucaguuacagccccacagcuggaagguuucuacaauacccuucccuaguuccuuacuuagguagugugugagacaccuucagaaguagcaguaccuuuugcaaggucuccugucccagcguaggggcuuagcauaucuuuuaggguggcaugguguccuacuuguaauuccagcaccguggaagcugggacaggggcucagaagugugaggccaguguaaccacauagcaaguuuuggaccugccugggauggaugcacagcaagacccuacuagaaaguguuagaacauaagggaauggggaaggaaagaaaggaggagaggaaggacauagaggaauggggaagggaaggggagagaaggagaaugagagagaaacugacucucaucuuugucuuaaagaugagaagcuacaaauggacacugagggcuuccuaauaaauguuagaccauugggccuuuugucuuuaagggcucaucagagcugugcuauggccuucaaauguaguacuuagcuguuguuacccauuaaaaagcuagauaccuaucauuugguccucgacaucacaaaaggaauuagcacgcaucagccagccagcuuggcgugccucuucugcucuuuaguggucaggaauucucugcuuguggggagucauucccuagaccagguccguccugagcagagacuucaagauaguccuuaucaucuggcaggugggugucacugaccacugcaccccagugcccuucaggccaacaugugcuucuguauauuauuguccucuucguugguucccaagucucucuguauaggaaaggcagacuacaguuucucaugauuccagcuccuuguaaccaaaucagaauccuggugccuaucauuaaagucaacacucuugcaaauagauuuuuuuuuaugccaaaucuagagacaguugaacaaauuuaacuggagucauuacuuacuguucaauuuaugcuuggaaaacacuuguugguguuucccacauucuugcaggcauaguuaggcauguuaaaggguccuuaacuucuguucacacagggacccacaucauaacagggcaagcuuugggagaagaaaguuuuuaaagucuugaguaaaagaggacuuuccucuuuuaguuuaugcuucuguuaggauuuugaaggaaugucagcauucuguuacuaacucuaauaacgugcacaucacagccuggaugcuuuggggccuucugacucucauguuaccuguguaaauacaggauucacuucccugcauccagcuauaccauuugcuuaauaaagagcaaaugugcagagcccagcagcagcagccuagaagaaguaaucugaacaggauaagcaugcuuccuuucugugcgaugcucuccgucuccugccaggaguaggguaucaaaugaaggggagguugugcuuggaguggguaaagugaaugucuaaguggcaccugcuccauucaguagaucugcuuuccugggccuccccccacacaucugcuccugacaaagcugcuuuuuuuucuuccuuuuuuuggucagguugagagcaaaggcccaguaacuagacauggcugguuuugcuuugucagcacaauugccugugacauuauaauuacaccaaaucuucauuaucagaagggcccuaauuuagagauuuucagagccuaaauaggguuuucaaagugaaauugauuuaaaaaaaaaucuuugcuguuguuaagcuagcaauuggauuugagaaucacuaaaggggucuaaguauuggaauugagccauuggcuccaagcaacgcaacaaaagcugugcuaucagauuggcucaccugagagccagcaagagcucuucugacugcuggucagucccagcuucuccacagugcucagcacuaccuguagguacaccuuacacuguauaaugcuuguaaugcuggcgcagcuuccuggaggccuaagggacuagggaguguuaaaauaauuugauagauugggguagaaaaagaaugaauugugacauaaaauaaggaaaugucaggaauuuuucuucagacuaacacaaagcacccauuuucagauugaguuuccauccaaacagaagcaacucuucugguaucugugugugucuaugugacugauguacaucucugauguaggauuggcauacuagaaauucuagauuuuguuuuuuuuuuuuaaaaagauuuauuccagggcuggagagauggcucagcgguuaagagaacugacugcucuuccagagguccugaguucaguucccagcaaccacaugguggcucacaaccaucugauggaaucugauaccugaugcccucuucuugggcaucuggagauagcuacaguguacuuacauauauaauaaauaaguaaaucuuuaaaaaaaauuacacaggaaaaagccgggcaaugguggcacacuccuuuaaucccagaauuugggaggcagaggcaggcaaauuucugaguuccaggacugucagggcuacacagagaaacccuaucuugaaauuaaaaaaaaaaaaaaguauacauaugaguauacuuuagcuguccucagacacaucagaagagagcaucagaucccauuacagaugguugugagcuaccauaugguugcugggaauugaacucuggaagagcaaucagugcucuuaaccacugagccaucucuccagccagaaacgcuaaauaaaguuaauccaaaugaaaugaaauuuaaaggguaguuccuuagccacccucaacaggcacugugucagcuagcacacagauugaccaugucuuguuauagaugaucccagagacagucugaacuugauauaucuugagaaucuuuuaaauaucuagugcagucuugauagaagaaaaaugucugaaugucuagaauaugcuccuagccacauuaccuagacuguauucucaagggguuuuuuguuuuguuuguuuugaggcgagguuucucuguauaagucuggauguccuagagcuuguucuguagaguucuccugcaucugcccucugaaugcuggaguuaaaggcaugugccaccacugccugguuuaguuuuuuaaaaagaaaaaaaaugccuccaaggauugccccacuauccucacaaaaagaaagaaaaaaaaauacugaaauauacugaggaagggauuugguuuuaggaaugccuacuuuuugguguuuugagauagggccucacugugcagucucggcuggcuuggcacucacuguguagaccaggcuguccucaaacucccagcuucacuugccucugccucccaagcgcugagauccaagguaugcaccaccacacccagugggauuuaaugucuguguucaguuuauccuuucccugcugccucuuuccuaagcuucuauggccuagcuaugagaacuaaagaguugugggguuuucccucaauaguuuuuaacaagaggccaugugaaacucuugggccagaugucagugaaguguuccuuguauagacagcuuaagguauggccggugccccuaggagucagagaguagguuguuggcagcuuccugucccagcaaggccaagguguaaguggcuuuaaucuugcuuccuccuucccucugcuuccacgugguugcuuugacaauugggcgaaagcucauaugaaguaaacgcuauugcuucacauuuagacaggaucuuuuuuuuucuuccuaacuuaacuaauaaauguaauguuacuuaagcacaaauuggcccucauagucaaaaguggccuguggauuuuauaaguauaaucaguucuugauugucacauacagauuaucucucauguagauuacuugugacacauuuuaaauccuugggcaguuucucuaagcaggccaguguaagccuagacccuccccaccacucccugcccagcugcugggugcuuaggaaauacaaauuaguuuucauauuagcuuaaggaagacauaauuaggaagggagaccugcugcaaaaaaacacaucauaacugcuacuuuaggacagacgccaucaggaggacccgacucacccucuggcucgacuaagggcuggcuguaaaguaugcauuuguaaaugcacacgccacauacacucagugaacugcuguguugaugagcugaauuugcuaaaaauuucacagaacacugcgccaagguguaugggaagcugcaaagcuuuggcagguucuagugucccguccagcccagcgccuuuuaacaguucuauguucuugucaggccucuuuauggcagacuguggagguuacaaguggauccuggcaagaaggcuacagguggguucgucuuuggggagagaaggaagcagcugagggcacagucacugcagcgcugccauuucaggcucugcuucuucuauggauggccugaguccuuuguaaagagcuugucccuggcggacaagauggcuaugcgaggauaguucagaugcgagagacagagaaagugacuggucacaaugacugguuuuggcgaauaaacggacucccaagauguugccaguccuaccagugaagaagaagaaaccuuuagcugucacaguaggggagcggcugcacuagacccugauaugggguuucggcccuacaggcaucguuggagcauuucaaagaggucacugcaauacgucagugagaagaaagaaaguaugcguugcuggguuggcuugguucuggcagcuuacaucuucucagauccugccuuucuuacaagaacucaaaccugaaugacaacccauauagcuaaccacugaagaggggacagugcccagggugcacucuggaccaugguugucuuccuaacuccuguguggggaacuccuuucauacccugagaauuaaaacccaauaaaaaagugacucguuuaaaaaaaaaaaaaaaaaaaaaaaaaaaagaugaggcuuuacugagguaguugucucuguguaauuaugucaaacucuggaagugucuucuucgcucuggguagcuucugugugagccuaccacuccucauucugcacuaaaacucagcuugguccuagcacucaggagacagagacaggcgaaucucugagucugagagcagccuggucuacacagugagucccgagcagccaggguuacauagagaaaccuguacugaaaaaacaaaacaaaacacccacagcuugguaacuuucuuuugagccacuaauguguagguagguggcccugaucuuaucucuggucuucucuguacaguugggucacauauccuaagcugaguacauguucuacucucuaaucaaagguuuguuucuauuuccacuuucagaaaagcauuaaugguuagaauagcaggccuagaauugaguuaagcccacacuggagguucaauggcuaggaugaugagccaugggguuccgaugccaaaucacagagccucauuucacagugcuccugaaccucuccaggcuguuccagaggaaaccaggaguucauguuuccaagauaccuuugaaauacauuuacuaaaaaguaaaauuaauuuaauuuuaacauuugauuuaugggcaacagugcaaaaggaguuucuuugaagucuuaaagccaaaggacagugacagugucccugcugaccagcuacugugaaccuuauuccuaaagcauuuuuuuccccugaauguaucuugagauuggccagaagaaaggaagcucugaguacugagaaggacccacugcugaggcugcuccuaggugcgagagucuguugagugccugccggguguaacacauuugauccauagauuccccaaauacuucagacucagcacacaagggaaagcuaaacagcccuugcugcccuguguccgagcgucagagcuaccuggcuuuuccacuugagguugguauucuuuucauggccuuccucuugcccucucucuccaauuucuuuccaucugguccuuccuuggacaucugccucuuccuccuaucuacaugcugaccuagcuucucuuccugacuuucucugcuucccagcaagguacccaguccuguuuuguuugagucacauaauagugcauuuccuuagcuaucagccacugguguguucuuccacgucuucaagugaaccaucagaagacgucccuccccuuaagucuugcugacccuuagggacuugacaaguucugugauaugggaguggugguuugauuccuuguuccuucccuuucccuccuccuccuuucucuucucagacuuacuuaauuuuguauauguaaauguuuugcccacaucaguaugugucugugugcauggugccugcagaggucagaagagggcaucaggucuccuggaacuggaguuaaggaggguugugagccaccaaguugcugagaaccaaacccagguccuccacaagggcaaccauugcuauuaacucugagcgauguuuucagagcuuucuccuucguuuuccucucuggucauggacuuaacaucucuacuuaggucaguguucucccacuaccucuuuuagcccucauguuaauaaacuccagaaaacauuacaauaucauuuccuuuuaguuuaaagaaucauuucucagucaguugugguggcucaugacuguaauugcagcacuuaggaggccaaggcaggaggauugcugaaugugaggcaaacuugugccauacaguaaguuccagccaaggcuauagugcagaacaugucucaaaccaacuguuguguuuauauuguuuagcuacuuuuuuuuccuguggugaccaucaauauucaccaacuaaaaauauuuccacagccaacucacaaggccuuuggacugaaagauuaaguuacagcaaacaacaauucccaaagguuucccagcuuggaaggcaaaugaaaggcccauucuucccaaaguugucuauccugcccuaucuugucuugaggugggggagggcaagccacuguagugcuggauaaccagccaguccugaggcccuauguuugguucaugucuauccuguucacuucuaagaaguguuugauaauauuauacugucagugaucacucauauauaugacacauuuccuucagugcugggaaugaacccauagccuucauaugugaggcaagcauuuuaccccugagcuacacccccagccccaacacugguccuguuuuucacuuucguaauuggguuaguggcuugccccggauugcaugcucaccugcgcgcucaguuagcgggucugugugcucgguuagcagcugcuucaucucccucguguggucccauugcuguggugugcauggggagcugccugccaauccucugcaugaucccauggcuuucaucuggagacucucagcaaaggcucugcccaccauaggagcaaauuccuguugcaagaugugugcugcuuccugggaguguuaaucuaccacuugcaacccaaacuacacuucucgaucaaagucaucuugaaaagcagcugacaagugcuguagaccuacugugugcuagacacuguaccaaggguccccugugagauuacuagugaccauuuuacaugcgaggaaacuaagggccacagguauucaaugacagaauucacaugggucguuguggcuaagaacacguuaaugggaguaagauaaccuauauaguaaaauaacccuccuguggaaagccauagaguuccacagccccuuaaggaugcuucuggggaaggcugcuuugcucuagagcaaaggaaagggcuucaagguccuucagugcaaagagggcaaggcuggaaggaauguagcucaguuucuuuaaaagucaugaagaccauacaguaacugaacacuuuucuacccagggugcucaguauucagugacagucuuauuaucaacagcugaaagugcacagacuucuugagagcuuguuuggagguucuagcaggggagcacagcuacucauauacccuugaccaaagaccaguccuccucuauucggggaaggucguccucuucaaccgagcucacagcuucgggagggacgcacauggagcggugagggaggaagggaacaccggccuagccagccugaucagccgaaucaacccuggcagucaaugggguaacagauguugcagccagaucacccuuacauccguaugcagacaucuuaagggaacuacuuggaagcagggcaggucugugcauauuugguaucgugugaguggcagaguccaugacaucacaggaggcagaaaacacaccuggaaaaaaguggggacugucagaagagcccugcucagagcugcagggcagaucuaggcagggagauacgcuuuggggagaguugagggaccaugguugugauggaacaauaauguagggaacuugugggaaaagucuguaugcuugcucaagagucagcuggucuaggcaguuauacucucagcuccugggacgccgagacagcaggauugagaguuugaggccauccuggguuaaagugcggaggagacggagaaguaucuggaacugagcaggacaaugcuugaccaaagaucucuaaggcuggguuugcagcacuccaacuagaguacuuucucacugcaggcccagauggaguucaugcauggaccaucagcaaagccgugacggcuccucaggcugcaggaaagauucauacagauuuuggaaagggauucauuauggcggaaguaaugaaagacgaagaucuuaaagaggaaaguucugagaacgcagcuaaggcugcugggaaguacaaacaacaaggcagagcuuacguuguugaagacggagauauaaucuucuucaaauuuaauucaccucagcaauugaaaaagaaauaaaaauuagcuuuuaacuuuagcauauguaugguuugggcuuuggucuugacugugggguaggugguuugguuugguucuuaacuacauuucugaaaucugaagguacaauguuggaacgggacuccuaaguuauuacugacauugaaguaguagaaaccaaguucugguuuacuuuugaaagaguuugggguugcagagcugguuggcaguguggaaugcucgcccucuuucagaaaacccaugugaggccggucccaacugccuguaaguccagcuccaaggggucuacauacaucucauuccccuacacaggcacacgcaugcauaugaauaaaguuaauaaaaccaaguuuuuacaagaaggaaggagaguugacaagauuugaugauguauugaauguauaguggaggcgcagaggaugaugucagaggcuugacccugagcuucaggaaggauguaauugcccaguauugagguaaggaagagagaauagacuagcuaugcuuuaccacuuaugcucagcagugaagacaacagggucaggccucacuuaagcggaaacgugggcguagggcugacaguuccucuagggaguuugcugacccugaagaucugagcuuucugggguccuuuucaccucucuucucccuuuggcaaugcggccaugauguaccgugaagccuagagaggcaucagggaguucugaugggccaguccucuaccugcuggccagggugcuggguacuguggugcauggaaaggcuuccagauccaaauccaaagcccagacauguagcuugggggagaggugugcaaugaacaugacagccaaucuguuuaccuguuuguuuuguuguguuuuugagagagucuuccuauguugacaaggcuggccucggaggcuaggacaggcuuuggggugguuuugacuuugagacagggucucacucaccauguagccugggcuggucucagaccaaagauccuccugccugucuugccucccaaguguucuuuuuuauuauuauuuuuaaauauuuauuuuauuauuauauguaaguacacuguaacugucuucagacacuccagaagagggcaucagauuucguuauggaugguugugagccaccaugugguugcugggauuugaacucaggaccuuuggaagagcagucggcgcucuuaaccgcugagccaucucaccagccccuuuuauuauuauuauuauuauuauuauuauuauuauuauauuaucuucauuuacacuucaaaugcuauccccaaagcccccuauacccuccccccauccuucuccccaacccaccuacucccacuuccuggcccuggcauuccccuguaccggggcauagagucuuugcaagaccaaggaccucuccucccauugaugaccgacuaggccauccucugcuacauaugcaacuagagacacagcucuggggguucauauuuuuguuucuccuauagaguugcagacccccucccccaaguguucauuuuauagguaucuaccaccacacccaguagcugcuggugcuagguauuguugcuauuacauuugcuugugcguguguguguguguguguguguauguguucuuacacauagguagacauuuaaaaacugcuuauugaagccaggaagucaguucucuccauccaucauuuggguccugagaauugaacucagguuguuaguuuuggaggugagcaccuuucuuuaccugcugaaccaucuugccuguccuugaauuuuguuuuugcuaaacuuuaggaggcagaucucauuuuguggcccugauuggccuagaacuggcucugcugaccagacuggccucaaacacaaaaaguuuuuaccuguuucugucucccuggauaagcauuugggaugugggcgucauagcgguaaucagaaggcccggaagccucaguaaggcaggaagagugccacgaguuugaugcuaaccugggcuacacaaugagauccuaucgcaaaacaaaacaaaugguaguaaacuuuaaauuuaaagcaguuucgauucacuagacucuuaggauuugugugacuuugaccuuuuggaauacuagagucuuuagaacauggugagugccucccugagaauccuggcucccgcugggggaaugcucauuuauggagacacuauccugcgucgaucuccagggcccuacacaaggcaaggggacaugcagccacacacauaccauggaguccagucacugagacuguacugggguuuccuaaaccuucaggcccuuaaaguagaccaggaagggcuuccuguugcuuaaucaauugaaaugacccagaauacaagcauggauuagcgugugccucuagauuagggcuaaucaggggcaggcugagcagauggaggggcagccacggccugauuacugagcgucagcauuuaaucaucucucuuccaagggcagccgcccgacuuagugcauccuggguuucaaagccuucagucccucccccgugccauggacauaaaggcugcuaggucagacaggcacaggagauuuaaucuaaucccacgucaaaaugccugcauggguguuuuugugagagagaucuuaaaaugcccacaugaagauggugaugcguuuauuuaaggugggugucugcuaaaagcacauauagaagaggcauuccaaggcaucggagguugucagugaccccgcugauggaguuucucucuuugaaaagccuuuaugauauauaauaauugucacagucacucacacugagacagcuuugugaggaagucauuuuguaacucagugcaacugaggccaaauuugcuucuuccaugaguuaugugaaauacacaaaaugcaaucugcaaaaaauaggucuugggugugauauuuuuacuuuguuuuuauuuuaggagaaagugucucccuguuuagcccaggcuggccugggaguuacgacagaucuccugacugccacccuuaacagugacuagacauuggaguuuucauuuaugaugaguguagagaguuugcugagcagcugcucagugauaggcucugucccuuugcaauggaaguggagauaagacaaacggugacacuggguaaggaccauuccucuggagaggucugggcaaagugccaugaggcuaccagggaacaggacccgaaucauuggaggacagagacuuggagaaccaaagaacaagccaaagaguugcugcaaaaggcgcggagcagauaagcauggagaugcuuauguggagcaguucaaguacacgccagcccuugcaggcagagcacagugggugcacaccuguauuccuagcacuuggcaggacggucacagacucaaagccagccugugcuccauguugagacccugacucaaaaggagaaaacagacaagaacaaaccaugagagccuugaacaccaugccaaaguaucuuaacauuauuaacauaacggugccucagugugagaccaaaggacuaaguaagcaauguaguaaaaauaaaacuauuuucuguggugaggcagggugaacggagaguauugcuucagcacuugcuuugcaaugguuuagaagaaagcagaccaccuucacccugaagccucagcccucguccuguugcuucccagcccucugccagcuuucccuaucacacaagaauacucuccucagccgcagccucucaaggaagcuguacugacugcccagccuguuauguuaacaugcccuuguaagugggguuucaaaaugacugucaucaaaacaagccuguuucauguugcaccaucaaaugcuuaucccuaaauugacaaaacuaacucuuggaaaaugcuaucagacagucaagacuaugaaaucauauuuucuuuugcauuaauuuccuuuggauucacacacgcacgcacgcacgcacgcacgccaccaccaagugugugugauggucaggaggcaacuuuugggagucacugcucuccauucaccauguggguccuggccauugaaccuaaguuauuaggauugcuuaaaaggcucccaccugccaggccuucucucucucugucuuucuuuuggagacaaggucucacuauuugccguggcugggcugaaagucuccucacuguguagaucagguuuaccuucaacacccagagauccugccugccuccucuuccagacgcucccucaacauucaaccaguuguuuccggcuuuaguccuucugauggcuccuggugcucaagcccagcccuggcccuggucuugcucccauugucucugucuuagagccugugcuugagauuucugugcuaauauggagcaagugugcgugggcagcuaaaguuugagccguggcugaaguggugucauaugugauuccugcugaccaucuuagcuggguguagaagucuaggcugaaagcaauuugggaugccugaaggcaugguuccaucguuuuagcuucuaggguugccaugacaucuaguauucuucgcauguccaguauuuuacaugugcucccaaccucugcuuuguucuucuggauucuuucggcucuucccugucucccuuguacucugagaugugucuggaucucuugcuguccauuucaccuagagcaucaaguggccuuuuccaugccaaacuugcuuuucaguaauagaaguuugcuccugugucuuauuucuaaucucaugcgacaaauuucccuacuuucuaagcuuuucuagucucugugauuuuuuuucuuguuauauuauaaccuuugcaauguguuucauuuauuguacuuuuuuauuuucaaauuacucucauauuuuuucuuuucuaguugguuguaggauuuugggguuccccaggguauuguugcugccacugcuguuuuuaugggacggggucucacucugugguucacauuaguuucaaacucacaguuguccugucuuagccuuccugggugcuaggauuagagacauacccuauggcaaguuugggaguuugaagucugauugagugggugggugguuugggggcugcuguuguuugugguguuaggaaucuaacuuagaaccucauacaugccagacaagacuucuuccacugagcuagacuuccagcucuuuauuuuguauuucugaaaugaagccccuuauguuauagccuacauuagccuggaacuccuaagcucagggaauccugucucaaauucccacuacagguguguauggguuuuuuguuuguuuguuuugugucuguauguguguguuggguuuuauaugagauauauauggauuuaauaugauguauaccauauaaaaucccauuuuaagaaaauacucgggggcuaucagacuuugccagcauuuguuuuguuuguuuuguuuucucccuaaguugucuauguuguccuuguaugguucugugccccuuuaagaguggcacacuagaaugcuacuuguucagggacagagcuaggcgacuuauggacauuagagcuaguuaguauuagaacaggccauuccacucaccucauuucacuauuagugugggggguuuuuuugggguggggugggggugaaucucagaucuucuaucacaauggucuagguguuaagguuugggacuucuaccuacuaacccagucagcuaaauacuaguuuuccacuauuauuggcugccucuuucuuaccugaaggauccaggcccccgcgcccuugagucccuuugggcaggaguuacugcuuucacuucacugacagacuaguuuugguugguggcuugcgaagcacagccuuucccugucuauuguaauucuacuuccggcaagaaaacaaggcggguggaugcacaugagucuuuggcccgagugaacuggaaauggaucgcucuccccaguguccacguacuguacaguggugcugggcugcauuugcuuugucauugcucuuagcugauccuaaacuguguuuuuuaaauuauaccagucugugaaauccuaaaauuuggagacaaaugagcguauuugauucaauucuuuuucauguuuaacucuagaggaaaaaaaacaaaaaacaaaaagcauaggugaccaguagccagacaacagagcagaagacagagauuugggguuuuuuguuguuccuuuuccagcugauagaagcuugaacuugggcaguuagcgggcucaaagagaccacagcauagcccaggaacagugggugaugugcugcuggcagcagggcuggcagccagggugggaagacucacguuggugggcugcgcuuccuaaagauggaggcugcaaggucucaguguucccacacuccuuucccgagagucuaggaacuaaaaugaagugagaagagagauucacugcccagcgccaggcacacacccagagucugagcucuugggcggcugaggccaagggaacaaaagcugagggccagccuggcugcauugcaagaccuugucucuaaaaagaaaggaaaaaaaguugagacuucucugucugggaagcagguaagucaguggcccggggcuggcaggcagugaugcccugaaggaccagagccaguugcccgagccagcaccuggguccugagcuugggccccaccaacggucuugcuuugucucuccaggccugguccagaucccugugagcauguaccagacugugguaaccagccucgcccagggcaacgggccggugcagguggccauggccccagugaccaccaggauaucggacagcgcagucaccauggauggccaggcuguggagguggugaccuuggaacaguagcauggagcucuaucauggcagcguuuucuagucuacugcagaauuuuuuacauguuugcagaggugcaaucaaauggaauuaagucucucgacuuggaaagaaaguuuugguaaccuuuuuuuaagaaggaagaaaggcagcagauuuuggaaucacacuuuuuuaaagcaccacucugggaucugguggaaugaacgccaccgauuucacugucccaaaaagccaaauuguggccagacuucuuugugcagaaauguguguauacuuacguguguguacgugugagugugaauauauguauauguguacauauggacauacacauuuacauauauguauaaaguauauauguacauacauacauauguaugaaaccugcauggaauuaccuguaugaaaucaaggugaacugugggaacaagaacccacccagauucgugggugguaggguacaugaccaaacacagucaccugguuuucguucauaccagggucaugcauugagcuacugacagacucaggcggaggugaccacguccuucaccaaagcugccucccaguggccgccuagaccucugcuagauucaccgaaggaaggaagauccaggacacagcgugguccagagagugcuugugaaguccagggacagagagugcgugcgcacaugugcgcuuugccagcagagacacacggcagcuggcccaggugcugaccuugccacaggcagguaaacgcccugcaggcuccuggcaggggcaagaaaucguuccucagccuccaucuucucccuucccaggaacccucagucucacgacuauucaagaguugcuugguuguaaggucaguccuguuacaaacugaaggugacagaaguguuaagggucugaggaguguucauggagcaggcggguguaagugcaggguguguguguguguguguguguguguguaugaguaauggagaaaaugggaagauuauaggagagcaaaauaggaaggagggagaaaacucuucauaaaucagggugcgccgugggaaccguguucuccagcugucugcagcuguauuucagcagaggagacugccucacacaggaccucugcgcaaaggcuggccgucacagaugugucagaagacucugugaggacuuuucccaggcacauccuggcggcacaggccugggacagcuuuccugcucacaguguggcuugcacugagcagucauugucacugugagcuucugugcuuuccagccacaagcccugagucucccguggcucauucaucugaugucuugacaagccaaaucuccacuccuggcgugcagggacucuuccuccuuccugccagcccucucccgugcgugauaguguauuuaaugugguguuuuugguuuuuuguuuuuuaaugagacauuaaaagauucuucaugucuugcucagccuuugagaaaaguuuccaauucuuauauuugcuuguuuuauauaaaacuauucaauguucuuuguauguucuuuucuguaugugauaagggaggggugggaaauuugcauaucaauguccugguucuacaauugguuacuuuuuuuuuuuuuuuaaacugugaagcuguccaggggcuuuaaggcccguguuccuuuguggugaaauaagccucccgauaguuugagaaauugccaagaagauaaaagcaagaucccagcagcagagcauggaaucuguguuguucuccauucugucuaaacugccucauucaauaaauaguuuaauguggcgaca

SEQ ID NO: 2880 - RNA, 145446 nt, Mus musculus
cauggcggcacggaacacaaagaggucauuacugccccuugauccaccggggaaacugaggaauggaguggggaagcagcuuuggcccgugagucagugguacaggucaugaguucauuaccaccccgucaggucagucaggugccuaugaagccacacuucccaaccagaaguaaacauggcuguccagggccagggaagggagggccuuccacccagugcccuuuccauaccuguccagcgguagaaccagacacaaaguugcaaagacuauggccugacucccugcauucagccaaggucagaguggggagugacagccaagacggcacacagguuguggccaagccagcucagagucagucgggaucuggccaucuggacucaaauacuggaugcccuuguuaucagucugucuucugagccagcuccuggggccucugcuucuugauauguaaaaggggcaggaguagucagugucuaugucaaagggcugcuuaagagcuaagggaccugauguuuguuacgugguugcuaagcaauccuuagcugcacaccuggccacccgugucuccaggcuguagggacuuuugggucugaggaaaagaaaugggcacugggcucaggcaaaaacaucccagaaugucucgcuagcucauccuugcuaugggaaggauucuucucgcccaguggcucucccccaucagcagaggugcugguacuucagcucgaugcccaguuuuagaagcaucgggaagcagcaucuugggcaaccaaacaccaagugagauaaccacauucuugccagccuccuccagccuuggcucagggcccagcagggccacccuuaggagauggugcuaagaagacaacaggcaagcuaauuauaggcccggccugcugggcuguggacacugccuguuuggccugcacggcuuaccugagucaucuauccugcggccacuugagccuggaucuggacuagcaggccacagggagucaggagcgccuucccugugcucagucuggucagcugcaccacuuccugccucuuuuccccucagaaagccaguugaggcaggugagcaccccagaucagaggccagaaggccuaaugccuacugcgaggugagcacaaugcugggaucccagagucucuggaaaaaucacuucacaggucaaaguaaaaggcauagaaugaacagggcaguggccuccuccuuccaccacacgguccacaccuccauccucucccugaaccuuacuggucugcaggggccccagcucucuugcuccucaguggucagcugugaucugggcucaguucccauaaacuuagcccaggaauuuuucaaaguaaaaggagggcaaauaugggugccgugguucaaaaaaucagucuuaaaaucacaacagaguuagaaaacauucuuugaggcguuaaaaaugaggauaaaugacaagaaaguccccagcucuuuggauuuagugcauuagggaggcaaggguguggcaggagaaaaacuggggguacccucugugaggggaauguuugcacccauagcagggcucaucugugcacuagaaggccaacauggaaagcugugaacccagacucgggaggcagaggcagaggggucaggaguucaaggucagcuuuggauaaguggugaguucaaggccagcaugggcuacaugagguccuauuaaaaaaaaaaaaaaaaagccaaaggggccgugagugaggucgggcaagaaacaggaagugaugugggugggugcuguuuuguuuugcuucuguuuuugagagggagaaggagagggagagugugugugugugccaaaagccauaggucuccuagagcaggagucacaggaagugaguugucugacauagacguaugggauugaacucacguccuuuggaagagcaacacuuguucuuaacucuuaagucaccuuuucagccccuaauuuuuuuuuuuaauuuaaaaaaaaaagaugugugugugauuggaggggucuaucauggcacaagaguggaggucagaggacaacuuuggaguugauucugucugucuaccuuuagguggguccuugucauaacagcagccaucucaccaaccuguucucuugguuguuuuuguuuuuguuuuuguuuuuuccccucccuguuuuauuuuaguuaucuaucuauuuauuuugagacaggguuuuucuguguagcccugguuguccuggaacucacuccauagaccaggcuggccucgaacucagagugcugggacuuaaggcauacaacccggccuuccuuccuuuuuuuuuuuuuuuuccugacagggucuguaucucccucuguaagccuggcugacaugccucuugcuauguagugacuguaaggcuggacucaaacucagagauucugccugccaagccgcccacgagcugggguucaaggcuugugccccuucacccugccuuguguuuugauauuugagacagguucucuuguagucagcuuuaaacucuccauccuccugccucuaccuugcaggugcugggaucacagguauguaccaugaugcuugucuguuuuaagggagccauccuuuugggguaggaaugaaguucucugcuccccaggagaguagaccaccaagcgccugcccgagagcuuugccuggccucucuccgcaacucccacagcacuagaggguuggugacacccucugccaucugagccucagcgcuccuguugccgcccacagccccucaugcuuucuacccuucuugaagugagccugauuacagacugccccccugggggagggagcggagggaggguggagggagaccuaguucuggccuugcugacuaaaagaaugaccucagugucauaaugacuggcuuucugguuaagcugccaaccugggugccuccccacucuggccuuuaagauagcuccacacaggaugauugugucugucggcagagagcaguugggcuccuguagcaggaguccgucaggagaugguccggccucacccucaguaccaccccauuagacggggcucauaauggaacuccccaggacagaacccuucauuuuuuuguucuuauuuuuugguuugauuugucuagacaggguuucucuguguagcccuggcuguccugggucucuucucuguagaccaggcuggccucaaacuccgagaucugccugucucucuugagugcugggauugauuaaagguaugcuggccuggcuccaggacagaaccugggaaccaagaagucucuuaccacucuauaaucugaggggaaaaucagggcaccgagucuacguaugacuuuguacaugaaaacacucugccaguuuaaaagugagauuggcaguagaugccguccauaccuguaaucuccaugucagggccagcaugaugcuccacgcaagccuggagaccugaggucagcauucagaccccaguauggguugcagggcacccugcucagucuuugguuuugggguuuuuuuguuuuguuuuguuuuguuuuuucugugauaagccauucugacuggaagccuccuggggaggaaaggguuuauucaucuuacaucuccaucucugagggaggucaggcaggaaaaugagacagaaacgaagcagaggugaagcagaggucggaaggagcccugguaacugacuugcucucccuggcuugcucagcuguuuuuauaauacaacccgggccuauccgcccccggauggcaccauccuccgagggcugggccauccuccgucaguuagcaaucaagaaaauauccccacagacaugcccacaggcaagcccaaugcagucacuuccucgguugagaguucucccaggugugucaaguugacaaucaagauuagccaccacacugucacaacaaaaucaaaagcugaaggaaagacugggucaagaggagaagacagguagccuggaaaacagagacugcaggaaaaucgccccgaggaaucugaaugagaagcaggccaugggccaggaaguggcucaggacaucugaagccauacauagaaugugacaggcagaugaccuuuucauugggaucaggacugugccccaccuuuggaccacugaaccagcaagccacccagagagauggcagcuugucacagaugccaaaacugccaugaaugcuacuguaacggguuauccauuccuggcaagaaucuagacagccuuugggagaucugaucugugccccuccaacuacccaagcaggaauuuagugccauggaggugaucguggggacauccuccaguuguuucaaacuccugacucuccucagccuuggaaaugcugagauuacaguaagacccaccaugccucacuagccccagcccuuugcuguucugaggaaucccaaaugcaacguucccuguguucuuggcuaacccagugauagccagucaccaugaggcagcuuacauccaccucccuggcucuaacuucagcuccuacuggcugaccuugcaaacccccaagcuacuggggagucaaagccaccacaucuccacaggcuccaagaagcagugcucccugucuguauggugaugaccccuccccaguuuagugccaagcuugucaguugccucaaaauuguaggagcaguugaucuagcuuaugaucccuacccaacaagguauguccaacccauagccaaggguuucauguaccucaguauagcuaggaaugagacccaacacagaaucauaaaauuacuuaaaauauuaaaagauuuuuaaaauuauuuuuauuuuaugugcauugguguuuuaccugcauguauaucuguguaaggauguccaaucuuggaauuauagacaguugugagcugccaugugggugcugggauaugaacccugguccuuuggaagagcagccaauguucuuagaggcugagccaucucuccagcccugagauguuuuuauuucuuuuaauguugcaacucaguuuucugauucaugaacuuuauaggcaacaucaugucauaaugucaaaacauugggacaccuggcugacauugaacugagaccaagaaccuagagagaaccgggucuccuacccacucagcccuccccagcccauucagcccucccucuuuucacagacaccugcccacgcagcccucccuccuuccgcccagauccuuccgcccauuuccuuuggcaccugaaagcaguuuuuguuccguggagccagggcaggcacaugugcugccucuagcucaagaagcugcugcucaucgguguucuacuaucagcaacaucaaucuuagugcuuuucccucgaaacaaaguuacuggguguccuagagguaaaugcaguuuguaccggaacaggauucugaugagaaguucguuuugaucuucuucagggcacauggagaaucugacgacugaguuucuucagagcauagugucacaucagggcucaaggaauaagugagacaaauugaauguggaaagaggugacugcaugagcagagcaugaugaccuuugaccucagaacucaacugccaggucggcuauguccucugcaucccuacacauaaccaagcauucagcacaugccuggcccagaagggccucagaaacugugugcuaauuaugugaacaaauaauauguuuacaguuaccugcaagaguuuggggguguggcaaaguucguggugcaaccgucacauugaaggaacuacuuugagggacuggagguguaguugaguggaacacugaauguugaccguaucuacgguaccaggucugaucccccaacacacacaccuacacacacacaaacacacacacacacacacacauaccccacaaccaaaacagcaacaguaaaauccuacuuugagacccagugguacuguuguacaucuuugauccuaguacucagaaggcagaggcagguggaucucugugaguuuaagaccagccugguuuacagaacgaauuccaggauagccagagcuauacacugaaaccuugucuaaagaaaaaaaaaaaaggaaaaaaauguccuauuuugaaagugcccuggagcccuggauccugacaguguguggcuuucaccugcaaccucaguacuugugagccuugaggcaggaggaucaugaauuugaauucagccugagacuacuacauaacagaaacucuggaucauauucuggugggagaaaaacagaaagaaaaaaagagaugagagaggagggaaggggaggggaucuggaaggcugcccccugcagauaggaaguauccaagccaaguaggaaguagaaggcaagaccagcucagggcugggaaggagaaauuuggaguaaguuuaggcaaagaaaugaugaaagcuaugugcccagcaaguguauggccuagcuuucuuuuugugugugugugauuuuuuucgagacaggguuucucuguauagcccuggcuguccuggaacucacuuuguagaccaggcuggccucaaacucagaaauccuccugccucugccuuccgagugcugggauuaaagucguaugccaccaugccuggcugguggcccagcuuucuuaacaggacuuuuuuuuuuuuuaagacuuauuaauuaauuaauguguguguguguguguguguguguguguguguguguguguaugugugugugugugugugugugugugugugugugugugugugugugucuguccugcauaaauaccugccugcugccugcagagaccagaagaaggcauuguauacucuggaacauuugaaucauguggauacuggggauugaacccaggaccucugcaaaaccaacaaguauucuguuuguuuguuuguuuguuuguuuuuuauuuuucgagacaggguuucucugugcaguccuggcuguccuggaacucacucuguagaccaggcuggcuucgaacucagaaauccgccugucucugccucccaagugcugggauuagaggcaugugccacaacugcccggcccaacaaguacucuuaaccacugagccaccucugaagcccauuaacaauacuuuuuuuuauaagauuuuuuuuuuuuugagacaggguuucucuguggcuguccuggaacucauucuguagaccaggcuggccucaaacucagaaaucugccugccucugccucccaagugcugggauuaaaggcaugagccaccacugccuggcaauaagauuuuuuuuaaauauucauuuauuuuauuuauaugaguacacuguauuugucuucagacacagcagaagaggucaucagaucccauuacagaugguugugagccaccaugugguugcugggauuugaacucaagaccucuagaagagcaggcagugcucuuaaccacucagccaucucuccagcccagcuuguuuguuuuuaacaagauuccauauauauguauguuucaugucugguaaggccagaaaaugaucaucuggaaccagacuuaugaaugguucugauccaccacaugagugcugggaacagaacccagguccucugcuacagcagcagguucucuuaaccacuaagaugucucucuggccccaguuuacacucuuauuuaauguacagcccauauccuaauccuguuaguaguagcaaugguguccuucaaagcauuuccccuggcacaggguuuaguccagguugacaugccacauuuaguuguaacuaguuaagccuagguugacaugccacauuuaguuguaacuaguuauuuagucuccccugagccuguuucucauucacuuuucuuguuauucuagacaugugaucuuauaaaaguuuauuuuuguuuaguuuuguuuuuguuuuuuccgagacaggguuucucuguauagcccuggcuguccugaaacucacucuguagaccaggcuggccucgaacucagaaauccgucugucucugccucccgagugcuggaauuaaaggcguacaccaccacgcccagcaauuuuuuuauuuuuacuuguauauguauggguguuuugucugcaugugucuguggacuacaugugugccuggcaccuuaggaucccagaguuacagauugugccacguggguccugggaacugacucuaggucaucuagaagagcugccagaacucuuagcacuaaaccauugucccaucucucauauggccuuuuauaaacgccaguugaaagcauguucccagauuggauauguauguaugguauuuccuggugauuagacccuaaguauauuuuuucuuauuuuguuuucacacacacacacacacacacauauauauauauauauacauauacauauacauauacauacacacacagaaacacacacauauauauauacauguguauuugugcucaccuguauucagguaccugaagagaccugaagaaggaaugggauccccuggagccagaguuacaggaaguugugagucacccagccuggugcugggaacagaauucagguucucuggaaaggcagcagcuguuuuucacaucugaaccaucucucuagcccuucaacaggguuucucugugaccccuggcuguccugggacucacucuauagaccaggguggccuggaacuccgagagauccaugugugucaucacugcuggacaaacaagcacuuuuguuguuuuuuugagacaaggugucagggagucaaagucaacauguaacaaaggcugacccugagccuccuuccugcugcuccucacuucccaaaugcugagauuacagacaaguauguaauccuggcucaccacugauguuguagucaauuaaaaaaauuauuuauuugugugugugcagguauaagaucagaggauuauuuauaagaguuaguccucucguagcuugugaguuccaggaauuaaaagcaggccaucaggcagggcagcaagcaccuuuuacuggcugagccagcucauugguccuuuugguuuucuuuguucuguuuuugagacagaaucuugcuaucuagcucuguguggucuggcaccuacagugguuccgccugccucugccuuucucuugcugcgaucacgugaaggugugaaccuccaugcccagcuagauuacauuguugacugaaauauucaauaaguaacaacauagccugcaugagauuccacacacagagacacauaguaucuuuuaaugagacagucuuuguucugucaccaucuugcccugaucacaccuacucugcucugaucuuagaagcuaagcaggguccacacuggauaguacucaaaugggagacauagauuuuguucucuugguuaagaugucuaaucucuuuucccuguuauuaucugcccuuuugugauuaugaguaauuuguggcaaauuaguuugagucuacaugagugucccauuucucacgugggcccccucccugauucugcauccaaugaccuggaucaauuuuuccuaagaugugucuuuguugcuacuauuaccuguggcccaaagcuuucauaccaacauaucuuauaaaauguuuguuaugaaaaauaugcagccugguccuuuuaaaacagagcucagacgauguuuuugggaucucaacuauggcuagggaggggcuuggccuccacgugaaugguagcauuagcuguggcuuucuugcuggcugcaggcccgggaccuugugacagacaggacuagaacacaccgaggcuucccagugaaaaccuuggcacccucucacgagcucuguucuuuguguucucacauguucuagcccaggcuuguauggcucaccacccuuucucacagauuccuggauguuuccaccuggacauccuguugucaccucaaacuuagcagaagccacaucccauuuucugucuagguugucauaguuacaaugguuacaaagacuggaagccucagcgauaacuuuuauauacccacugagucaucucuccagccuucuuuucuuuucuuuuucuuucuuuuuuuuuuuuuuuuuuuuuuuuuucagcaggaucucacuggauccuggugugguuagccaggaacucucaauccuccugccucagcauccccaguacugggauugucuguuuuguuuuaacagcuuuuaggagauggcugaucuucccaaacacacucagcagagcuuugaucuagugacuuuuuuuuuuuuuuuuuuuuugagacaggguuucucuguagacucacucuggaacucacucuguagaccaggcuggccucgaacucagaaaucugccugccucugccucccaagugcugggauuaaagacaugcgccaccacacccagcugaucuagugacuuuuaaacgucccuuugugucccacucccuauuucauuggugaccaucccuucgggacucagcaccacucccaacuucaaagcagcucacaguucugaaaucuauaggauuuccuuucaaugaugaaggcacaauuauuuucugcucacaugucagcugacaaugcuagucuacgacaauggucaaaaaaaaaaaaaaauguggacucuggggcugggcauuaugucugugaucccagcucagaaggcugagucaggaggauugucauaaguucagggccagcuugagcuacauaguaaguaucgggccagccaagacaucuucuuuaaaaaauaaauaaauaaaaauaaagagagugagacuaugccggggccuagcaaacacagaaguggaugcucacagucagcuaauggauggaucacagggcucccaauggaggagcuagagaaaguacccaaggagcuaaagggaucugcaacccuauagguggaacaacaauaugaacuaaccaguaccccggagcucuugacucuagcugcauauguaucaaaagauggccuagucggccaucacuggaaagagaggcccauuggacacacaaacuuuauaugccccaguacaggggaucgccagggccaaaaagggggaguggguggguaggggaguggggguggguggguaugggggacuuuugguauagcauuggaaauguaaaugagcuaaauaccuaauaaaaaauggaaaaaaaaaagagauugaaaaaaaaauggaaugccacucccaacuggguguguguuggaggccuuccuuaaaaaaaaaaauaaaaaauaaaaaauaaagagaguggucucugguaucaacaucucugacaucaauucugguuuugcucuucguuacucugugacuuucagugaaugacuaaacucuccguaccucauccauaaaaugaggauuaauauuauucaucugaucaaguuugaugugauaacuaagugauuuaaaacagaagguacuuaagcacaugaccuagaaauucuguuuucaaguauguacccaaaagaaucgaaucccuaguucuugggagacccaggcagggugauugugaguucgaggcuagccugaacugcagagugagaccuugucucuuaggaacacucaaacauggugagacaccucuacaagucucagaauucaggagguagaggaaggaggaucuguuuaagaucauccuugccauacaguaaauuggagaccauucuguguuaaugaaagaaaugaaacaaauuucgagccugaugcagacuagguaggaaaaccugccaaucaaaagaagccagacaugauuuuuuuuuuuuuuuucugagacagggucucacucugacuaacccuggcuggccuggaauuaagagaggucugccuaccuuugccuccugagcgcuagcauuaaaggugugagugaauacagguagccccacaaaugucaauguguaugacugugauuccauuuauuugaaggaaggaggaaggaagggagagggagagagagacagagagggagggaagaagaguaggauagaaagagagagggagauggaggaagggagggaaggauggguggguggagagagagagagagagagagagagagagagagaacuccugaauguguaggagguaagugaagaauaaguuucugugagaagcagugaaacuuguugcaaugggagucaaagccacugcugcugcugcugcugcugcugcugcuggacagaaaugaacaacacuguauaugugcaaacauuacuuaauuuuacauguaaaaugguuacauuggcaacauuucuuuaggucuauucuagcacaauuuaacaguuccuucugcaagaaaggagucacucggcaagugugggagacaguuagugcggaccacgcaccaucucucacacugcagggcuguccaggcccacacuuaaucgaugacccauggacucaccuugauccaaagccuggaccucuagauccagaggcaugauccugugucagcagcuucaggggaccagccccagaggaagugacucauagaagucaaauucccucacgguggccagccaguucuccagaugugcauucuuggaaaacuuuauggaaaaacaauugugcucuaaagauugcuuaaagagcagcagaaggcaggaguaagggaacguuggccacugauagcacugggcuguaacucugggcucccuugcccucuguaagaaugacucaucccggggcuggagagauggcucagugguuaagagcacugacugcucuuccggagguccugaguucaaaucccagcaaccacauggugcucacgaccaucuguaacgaaaucggaugcccucuucuggugugucugaagacagcuacaguguacuuacauauaauaaguaaauaauuaaaaaaaaagaaugacccacccccuggggaaucaaacccuggaacccacacugacuaacagcuuucuuuuccauguugcagguagaaccucuggaacauuuguccauuuauuuaaaauuuuccaguccuaggaaucaaacccaggggcuuauaugcuuauagucauguguucuacacugagcgaauagucacaguccccaaccuccauaugucuuuaucuugguaagacauucaucuauucauuuuggauuuuuguuuuguuuuguuuuguuuuugaggcagggccucauuuuguagcccaggcugcccuagaacucggaaucuuccugccucagcuucccaagugcucauacugcaggcaguaccaccaugcuuugcuaaaggugaaugaugguguacauucacacaugcaaaacgucacuugagguuaaaccucuccagccucacuaacaaggcucccucuacucagaagguuuuauuugucuuguaguucuccccaacaucaagaacauucuggcacagucuuuugaauacccccagaggugacaaagcugacugguugacuuuggcucugauuugcaggcaaagguguuccugguuaaagucuggcagaucaccucugugauaaagcugggcaguaacacuguuguaguggguuggccuaaugcugcuuguauucuaaugcuaauuuggggcccccaagacugguuaccccaaagaugaaagagucugcaugguuaagacacugagugacccugcccccaguucauuguaauugguaaauaaagaugccaacagccaaagcugggcagaagaaggugggguugagguuucuugggcuuggggagagaggaccacaaggaggggaggaggaaggaaaagcugccuccauggaauaaaagaaaaauguucaggaaaaaggagaagcggccauaggcuggcugagccauaaaaaugugguccugaggacugcccaauaggaguuaugagccagauagaacauagaaauuaguaaguaauaauucuagauugauucuaacagcauggaggauaggcagcugcccagcuauugugcugguaagacauauuguaaauauaaaggcugcguguguguguguguguguguguguguguguguguguggucuuucuuucggacuuaauaaccaaaggguuauuaccucauuauuauuauuauuauuauuauuauuauuauuauuauuauuauuguguguguauauguauaagaugggcacaugugucagguuugcacaacaagcaccuuuacccauugaagcucuaggcucaggaauuuuuaauauuuacuauuacauauugugggcaaacaaauacuaaagaagccgcccucucugggggcuaaugaucgucuuguaugaaaacugcuucuggagucaacugcggcccuggagagcccagagcccuuggugggacaccaguucacaagaguggugcugaggguguggggcauggcaggcucaacucgguccauagccaggggcuucccacgguccugcuuuucaucuauaaaacacucuggcugaguguuccuggcaguauccgucaaaucacauuuaaggaugguguagugccagggugaucagcccagcugugggugcccacaucuggauucagauccaagcucugucccucaacaguuaaccaaauacaacugacuuaagcgucugugugugcaguauacagaagcgccuaugucuggaagccagagagcaacuuggguguuguuccucagguacuaguuaccucauuauuauuauuauuauuauuauuauuauuauuauuauuauguguguguguguauaaggugggcacaugugucagguuugcacgacaagcaccuuuacccauugagccauaucucuggcccuaccauagguuuuguuguuauuuuugcuguuucuuuauuuugacagggucuuaccauguaacucuagcuguccuggaaaucacuauguagaccaggcuggccuggaacucacagagaucuuccugcuucugccuccuggaugcggggacuagcuugacuaauauauacauauacauauacauauacauauacauauacauauacauauacauauacauauacauauacauauacauauacauauacauauacacaggguuucucaguggucugggguucacugauuccauuaggauagccaguggaucccagggaccuaccugcuucugccugccaguguugggauuacaaguguacaccaccaugccagcuugagaccucaugcuuacuuggcaagcauauccccaggcuguucugaacauggacaaucucaggugugacuuccuugaggccauucagccagguggggggugguggugcacgccuuuaguccuagcacucaggaggcagaggcagaugaaucucugaggccagccaggaacucacauuacagagguggguucugggacagccagggauaccuagagaaacucuugucuugaaaaaacgggggacaggggaaagggguaaauucagugugugagagaggagccauaacguauggcucacaggguugcuccagaagggaacgagcaguucuucaaucauggcuuugcuucuuuagcagggauccuagaugcacuucuguuuguuauggugccugccaugagaagcauggcacacgcccaaaacaaguuguucuagaaccuaguacggugguacaugccuguaaucccagcacuugggaacgcgagguagaggacuacauagagugaauucaaggccacucugagcuagauagcacacaaaaagauccauucaugaauaaagcacacaugccgggcggugguggcgcaugccuuuaaucccagcacuugggagguagagacaggcagauuucugaguucgaggccagccuggucuacaaagugaguuccaggacagccaagacuacacagagaaacccugucucaaaaaaccaaaaaaaaaaaaaaaagaauaaagcacacauguaugcauacacacacacacacacacaccaguccuuccuuguggaucacucccuguaauaaugucugcccuucugccuuguuccccacagcuaagacacucagaagcucucugcucccuggcaggcagacagcagugggcaucagggugggugagggcugggugagggcaggaacagcgggcccucuauuuuaagcacuugccucagcuguuccuugagaacuguacacuagggauuuaaaauagacggggcccuucuggugaccagugcaagguagcaaaccagcuggugccaggaccacccaauccugagaggucuuaggccagcaguggccuuguucugggguccuaagugggggcugccuuaaguguaggagcucuggggauggugcucagaaggacugugguuccuuccgggagggcagagguaccucagaggccuaucaucagagagaaucucaacagccugugcagcuagcuucuugcaggcuugggccuauuuuuaggcccugugguaaguuggguugucucuguucucaacaugcuaccaaguugccagcaagacuuucagcaaaacagccaugucggucucccuggcaaaacuguugaaaggacagaaggacuguugagaggcccaggcucaggugccucucgaagggaaggauuuggccugagccgcgagcucauuggguaaugcacccugagaaagcaugggaaccugaguucugcucucuaagcagggaaagccagggagcuggagagaugccuuggccauuaaaagcaccagccacucuuccagaggacccagauuugacccuuagcacccauaugguggcucacaaccaccuuuaacuccaguacaagaugauccaacacucucuucuggccuggugcacagacauacacucaugcaaagcaaccguugacauaaaauaaaaaaagcagacaugacugcacagacugcaaucccagagacaggggaagaacagagucagguggaucccuggagcuugcuggccagccaacuuagcagaacagauggguuaagguucagugggucacccugucucaaaaaaugagauggcaggcaacugaggaagauauaacaucuucuucuggcuucuacguguguguacuuauaugaacacaaacccacuggaacuggcacauauacuacacacacuauacacuuacuacacauaguacauacacaccacacacuacacauauacuacauacacacacacacugcacauaugugcauacaugcugcauacacauacuauacacauguauacacugcacacacugaauacacucacauacauugaauacacacacacacacaacacacacacacauugaguacacacacacacacacacacugaauacucacacacugaauacacacacacugaauacacacacacacugaauacucacacacacugaauacucacacacacacacugaauacacacacacugaauacacacacacacacagcagcuuuuaccccauccuauuaugccuacccaugcaugaucuggugaucugauucaaacaagcccacaugagguucugagguucugcccacacagaagggaucucuguccuccccacacaggcucagaacaacuaacucuguccuuccuuccucagccuuccuggggucagacucuugagagucaccugguggcuuguuaaaaacuuuaaacccauuacaucagagucuaugagguggauccaggcgucugaaaacuuuaaacaagguuccagaugauucugauucacuccaaacucuugaguccugacuggagcccugagcagcggugcccucuuugaucauuuucuuguuugauugaaacuggaaacuccagaggcucagacuggaaccaacauaauguguuaaugugugccucucuauaaaacagacucuagaacauagucacacacacacacacacacacacacacacacacacacacacacacacagagagagagagagacucuagaucuucaaaauaaagaccuggcuucucauuuacccagggacuaggauuucuuguauuaucagauucugcuuuuuaaauauaaauucuaaucaagaucagcgagggaaggugcucaggagaggcggcccccuggcacugcuguuuauguaagugucuauucuuaggcacuggggcaaggaauaggcuagacauugcugcccucauggaguugaugucuugaugagagagacaguuaauaggugaguauagaacuaagucaaugauuucucucucucucucucucucucucucucucucucucucucuuucuugguuuuucgagacaagguuucucuguacuguauagcccuggcuguccuggaacucacucuguagaccagguuggccucgaacucagaaaucugccugccucugcuucccaagugcugggauuaaaggcaugcaccaccauuacccagccuaauugauguucuuaaaccuaaguaacagacagucacaaugcacuaaauggcuaaaguuacaaggguauuuuuuuucuuacccuauuuguggagugauugugucucuucaauguucauacaucacaauccuagcuccuaggaccuaagguguggcuguccuuggaguagagugcucaugaagcacacauggagcucuggacucaaccugggcacagcauaaaccaaaggugguagcacaccuaugaucccagcacacaggagucagaggcagaagaauuagaaguucaaggucauugacaauccucagcuauauauuaaauuaaacuucauuguggacuacaugagcccagaaagggggaggggaggaaggaaggaagggaagagauaagagggaagggaagaggaggagagaggagaagggagagcagggguggagggaaggagaacagaagggaauggaaggggaagagagggcaggcuggggagauggcucaucacauaaaaaugcuggacacauugccuacaaccugaguuuggauucccagaacccauuuaaaagccagaaguggcuugugucuguagaccgaaccgcccugggcaagauggaggcaguaccaggagaaucacaagaagguucaggcagcuagccugggauuagaggugaagcaucacagagcaagaaagacccaacgacugucgccugaugcugucucugcugcauacacaugccacacaaguaaauaagaaauauuuuaagggcgccgggcgugguggcgcaugccuuuaaucccagcccuugggaggcagaggcaggcgaauuucugaguucgaggccagccuggucuacagagugaguuccaggacagccagggcuacacagagaaacccugucucgaaaaaaccaaaaaaaaaaaaaaaaaauuuuaaaagacaagaaagguuucuugcucuguaucaccuuucuagaaaauuuaaaaaucuauagaaaguaaugcccucgaggagggggugaggugagcuaggugggagggcuaggggauuggaaggguuggagacagacagacagacagacacacacacacacacacaucccagcacucaggagacagaggcaggugcaucucugaguuugaggucagccuggucuacagggggaguuccaggacagcaagggcuacacagagaaacccugucucaggaaggaagagaggagagagagagucaaccacuagugaagaggcugccaaacaccaaucagaauuuauucccaugaugagugggacuaggaagagaaacccaaacaaacucugaguuguacgggcaggaggaaggggaaauggcugcugggaaggcagccagcagagucugcuagaguguccugccgagaaccaaaacaggcggaugugacaacaugagggguggugacuggaaggggccaguguucucgaggugaggcgagggaaggcucugggaaacugauguuuuggcugcugcccaacugaaguugaagagucggcaggcaaaauggggagcaaagcauuccagacaacaaagacccugaaguaggagcaaacauaaggauccuagucucagaagggaguggcucugagcucucaccuuccuucccuccuucuacccauucucugccucagucugcccaccugaaaaauggggccaaagagaauuaucucucacuccgguguaacugagucaccagcaggguagaugcgaaucuggccccugucauagcaugucaacaaguuuaggaaaguguggacugauggcacaggcuuucucuccccugaacaauggggggcccccauaugaagccugaccaggaauccuggugaacauccacagagacagagcaucgagcuuuccaaugaaagacaaccuacaacaccugaaggagaauguuagcucucaaaccagagacagagugacugaguugccuguuaacauauaagugaaugcuggcugccuagcaucccuuggugacaagguccuccugguuagcauacccuguccucuacccugaacucuccagcccagaggcugggcugcccuucccuauauaauccagccauuuuggcuaugcuggcuuuuuuguggguucuuugccugccacucuaggucaccucuccacacauggcccuacucaaggucaugucgcucuggacucucccagaugucucugccucuaccuguuuucucccuuauaauaaaaacccugagcugggcggugguggcgcacaccuuuaaucccagcacuugggaggcagaggcaggcauauuucugaguucgaggccagccuggucuacaaagugagauucaggacagccagggcuauacagagaaacccugucucgaaaaacaaaacaacaacaacaaaaaaaaaacccugagcccuuacgagcagucagucuuccucauuuauuuauuuauuuauuuauuuauuuuuauuuugaaauuuccacucauucaccugguccugaaacagcuacagagacccuuaucucaggaacauggagaagcacaugccaggcccucuuggaagggacauugugcgugugcguccacaucugcuuccccccacaucacuuccaccugggcaaggagcgggggagaugguggaagcugacacuggucuaucggcacaaccgaggggcuagagagagggauguggccugcucggguggcaugcugaacgagcugguggcagucaucugucuacugcucuucuuucucccccuccuuccuccccuccuugcucacucuuucuuugagugcuggguaaugcugcuuaggagggcuucaugcuaagcaaccgucaucgcuaagccacaccagcaguccugguuuucuuucuuacuggauaauagaucuuuaagccuugcguggugaugugugccuaugaucccagcacccaggaaacaaggcaagaucccggggcauggggaggucgcaaacucagaagucuacuaugugcugaucuauccucauuucgcaggcugagacaggaggcucauugccagcgcuggcuuacagaagugaguuguaggacauccagggcguguagugaaaccccagcucaagucuacuaacuaaauggaugaaaauguaaagguagcuugggaugcagcucagugguagagcacuuuagcuggcuggcacagguccuggguccaauccccaacaacacaccuaggcacacacccaauacaugcauauguaaaaaguauaagaaagaugggggcgcuggagagauggcucgaugguuaagagcacuggcugcuccucuagagguccugaguucaauuucugguaaccaucuguaaugggaucugaugcccucuucuggugugucugaagacagugacaguguacucauacauagaauaaauaaaucuuuuuuuaaagacacauuuaaguuaaaggaaggaaggaaggaaggaaggaagggagggaggaaggaaagaagaaaggaaggaaggaaggaaggaaggaaggaaggaaggaaggaagaaaggaagaagacggauagauggagccagguguggcagugcauacuugcagccccagcacuugggaaggaugaagucugcugaaaauuagaucuaggcugcacagugaggcccuuucucacaaaaaaaagaaaagaggaaagaagaaaggagggaaggaagaaacuggaggggagugguucucacagggucacaagguugaggaaaaaaaaauacaccugauuaaagagugcccaaaacugucaaaagcacagggguccaugcauugaaugcagaggcaggcagaucucugugaguucaaggucagccuucuucauaaugaauuccaggcccugcuucaaaaauaaaaaggcuugcuauuuugcucucucucaagacagugcguacacagauauuuguuuugguuuauucugcugcuuaaacaaaacauggaacacugggugggcauuucuuucucgugauucuggaaacuggggaguuccaaggugcuagaucugauguccgcugagagccuuugucugucucuucacauagcagaaugcaucagggcaagaagggacaaacauuucacucuguaccagaugagcaaagacagcuaacucauaucuaccugcaagcccugccauggagauguuaauccauugauaagggcagagccuguaccacccagccauuccucaacaggacccuacaaaccccaccuaguggaaacaauuucagaaggaagaaaaacauuuaaacuaugcaaauuucucuguguauuccugguuauagacaaggcuggccuuuaacucagaaaucuaucuggcucugacucccuccugccccccucccccugccccagccuacuuaaauuuuuaaaagauuaucuguguauuuauuuuuuaauuuuuuaaaagauuuguuauuuauuauauguaaguacacuguagcugucuucagacacaccagaagagagcaucagaucuccuuacagaugguuuguaagccacuaugugguuucugggauuugaacucaggaccucuggaagagcagucagugcccuugacugcugagccaucucuccagcccccuguguauuuauucaaugugucugagaguuucaucugaacucuuugcagcacuuacauacuuacauccaaugccuguguaggccuuggagggggaacuucagagccuuugaaacgggagucacgggugguugucaaccaccagaucgguaccaggaacugaacccagguccucuagaagagcucuuacccacugagccaucucuccagcccauauauuuuuaaauuauugcgaauuuaucuaugucugcugagagccuuugucagucuuauguauucugaggcaggguccuugaacucaacauguaguuaaggaugaccucaaacucccaguccuccugcuuccaccccaucuauggggcucaguccucuuuauuuauugaccuuuuugauagagggucucagacuauagaacucaaucauuccgucuuagccucucaaaucugugacugaagucuuggacaaccaggucuggaucaaauggcagcucuuuuuauuuuuauuuuuauuuuuauuuuuauuuuuauuuuuuugagacaggguuaauuguagugacaauuuuggaauuuugguuucuuuagagaaugcagaacuauuaugaagaguauguuuuguuuuaauuucagauguggggguguggggaugcuucauauccacagcagcugacugugauuugccucaugcucgcuccagcaggggcauggcuuugccagcugcagauaguuucugcgacugugugacauuuggaaaccugggaauuuuucggaggauauauaaacgcuaaggcucugaacggcaggguggguuguugguugguugucucgguuuguuaaguauuguauguaaagaagaaauaaggauaagaaaaaauuagauauccugauggccaagauuaaaaaugccccaagggaccuggcaccccuaaucagcaggaaguagucugacgacaaugucacccccuuucugaacuccuaaccucacucagggaucucuuuccuuuccucucccuuuguucucucuuauauaguguuagggagauugaaaggguagaaaaggggugaaaaguagaagaaaaaagagcccacaaaguagcuaaagacaagcuacagccaaugaaggucaaacuagucucagauucaaugugcagcugagacuaguguugaacaccuaccugcucgcagccucaguuuucugugugcuggaauuacaacugugcccuaucauaggauuacaggugugccguaucaaucauaggguuacaggugauggauuacaggugugcccuaucaugccuagcuguucuaacuccugagucaaucuuucaguuuccgccuccagggcuaauuggcucagucucuucagucugccaguuucacauucccagcagagaaaucugacuggcucauuguccuggcuugauuucuguuacugugauaaaacaaggaacaaaaccaacuuggggggguggggaggguguucuucaucuuagagguuacaguucaaaggaacucgggcagaagcuugaagcagagagcaaacauggggggacacugcucacugguuugcucucagacuuauguuuaacuaacuuccucccucccucucccuccccuucccccucuucucccucuuucuuuuuuuuuuuuuucuuucauuugagacaggguuucuuuguauagcuuuggcuguccuagaacucauucuguagaccaggcuggacucaaacucacagagaucugccuaccucugccucucaagugcugugauugaaguaugggcuaccacacggcucgaaacuaccuuucuuuucuuucuuucuuuuuuuuuuucuuuuguuuuuuucaagacaggguuucucuguauaccccuggcuguccuggaacucacuuuguagaccaggcuggccucaaacucagaaauccgccugccucugccucccaagugcugggauuaaaggcgugcgccaccacagcccggcucuuucuuuuuuuaaaaugauuuauuuauuuuuuuuuuuuguauaugaguacacuguagcuguacagaugguugugagccaucaugugguuuguacagauaguugugagccaucaugugguuguugggaauugaauuuaggaccucugcucgcucuaaucaaccccaccggcucugguggagcccugcuugcuccggcccaaagauuuauuuauuauuauaaauaaguacacuguagcugucuucugacacaccagaagaggacaucagaucucauuagggaugguugugagcugccaugugguugcugggauuugaacccaggaccuucagaagagcagucaguguucuuaacugcugagccaucucaccagccuucaaacuaccuuuuuuacacagcccaggcccacaguggacuggacucuccuauaucaaucagcaaucaaaaaaauaccccaguagaagugcccacaggccagccugauaguggccaggcuucaauggaggcucccucuugggugugucaagcuaacaaccaggauuagccaucacauucaguuuaucuuggugugaaacagcuauccuggcaguugucuguggauggcugaauuaguucucuguccagcucuggcccagucacuugugaauagagguaauagggucuuguucuccaaugcaggaaaaauaaguguuuuccucagaagagacagggaaggggcugaccccugaaauacacaaaauagaaagaggagaaaggcaaauauauaaaugauacagacuauaguuaacaccagacaauaaaucuaagccuggaggacuucggaauguccaggggaaggcggccuuaaggaugcuugcugggaacugugggagggaggacuguccgggaggagaaaugguaggggcugguggcagcaacugcagcaggucacggucaguucagaauggaggaguucaaagauccuggaggcagagaacaggguggaaauuggaagauaaggugagcucagauugcaaaugacagcaucuacuaaggagugaggcaaggaggaaccacauuacaauuuuuuguuguuuuuuuguuuuuuuguuuuucgagacaggguuucucuguauaacccuggcuguccuggaacucacuuuguagaucaggccggccucgaacucagaaaucuaccugccucugccucccgaguguugggauuaaaggcgugcgccaccaugcccagcccccacauuacaauucuuaagcugggaaacuacaugacccaagguuuucuggaaucaggugguucuguauacauucaaccaccacuuccaugguagaggucugauaccgugucacagcuauuguacugggcuuuguuauguuuucauuuuauuuuauguauaugaauauaugucuguacaccaugugcaugaaauguccaaggagaccagaagcaggcaggcauccaguccccuugguacuggaauuacagguaauagugaaccacccugugggugcugggaaucaaaccuggguccucuagaggagcagguagugauccuaacuguugagcugcuaacuucugggcuuugugagacaccagggucuuucguuuuggguggggacuuuuaauuucaacccuaaaccuaccauaaauaucuacaugucuccagcuacagaugggacauacacggggguuuugaucugagagauggugccccaggucuaugaagguaggaacacaggagcuauacaaacauuaaggcagaaguggcccuggaagcagaggggccaacuaggcaguuccuaugacagacgagagcugagucagaaguaaagagggccagacuaauaagagugagauguaagagacuuucuucaguggagcccaugguacuggagagcugauuuggaugagggcaggacagaaagccuguaaccccaaugagucaaacauaugcagggaccccaggacaaggagcaagccugggaggaggauguaggcuggagaguuuguguuguuuucauugucaugugugugugugugugugugugugugugugguguguuauguaugcuugcauguguguggguuggcacaugugcccauggacaccugaggugggugucuggggucaucuuccacacucauccaguuucuucacugagguauugucaaacccagagcucccucacacagcgacuccuaccagccagcuugcucuggggacccugugucugccuuccaaggcuggaauuauaccuacugggcaucuaugugggaggauuccaaugccauccucaugcuugcuuagcaagcgcuguucugauccaccucucuaagcccugggcuggcauuuucaggguacugaauuuggaaauuuccaaaggggaaacuugcucugccucugccgugccucaaccuuucaguuucuuccucuaggucaucaggacugcuaaaaugcagucguccuuuccccagaguaccgggaccgcagguauucacaacuaagucuguaugcuuccuuuaacacccaccucuguuuuucacguuugucccauccaaucuacccacaauaaucauaucaccccaaauuacccauggggcuuuuauuucugagucccuuugcuucaaaaagauccguguaggucuaaaaugaaaacaggagaagaagcaggcauagagagaggguagacaugggcagggauggggcauuaccuaggaaccccucuuccuggcgggccuugaaaccuguaaugggcucuccuuugcccccugaauauccagauuucgggguggaauauaggagcuugagcaggguaaguuuuacuccgucaccucucugucuucaggacuucuuucucucucucacaucuacuugggacauggaaggggguuccagcagcccuuaaaucacauucuccagaaagcuaggagagacagcaaugggcauuaucuccacugcugcccaggcuaguuacugagucucugagugcauuaugccacccuuaguaucuccucaugacagaggcaucucuggcuaccccaugacuucucuugaguuucuuaucuacaaaacugauucuaaggagacucugacacuggguugugagccagggaggauugugagguuacaaguauagauguauagaugguauagauguaucugguauagauauaucuauauaugguauagauguaucuuugcuaauucuaucucagaauuuaauguuagcucucuauguguuucuucucuucucuucucuucucuucucuucucuucucuucucuucucuucuuuuccuuaauuugcuuuuccuuccuuccuuccuuccuuccuuuuuuuuugagacaaaguuuuucugagacacaguuuaccuggaacuagcucuguaggccaugcuggucucaaacucagagaucggcccaagucugccuccugagggcugggauuaaaggcacgugccacccugucuguguuucugaaagcauuuaauuugugguggcuuaucuauguaauuuuugccuguaauugaggcaggaagaccaucaugaguuugaggcaauccugggcuacagagugagaccuugucacucagagccugaauaagacagaccauuuauugaccugauuuuguuuuccucuuacuauguuaaaagcuuuucaagcacaguaauaugucuacauuaaauacauuaaaaaaaaaagucuuauagccagcuaugguggccauagcuauuaaucccagcacuugagaggcaacagaaucaggaguucagcgucuuccucagcuacauagcaaguucaaagucagccuagguccuacaacccucuuucaaaauaagcaagaaucuccauucuucauuggcuaaugaucuggagaauacuaguuugauaugugugugugcacgugugcaugugugugugcaugugcauuuuguggcugagggagagaggcagagggaauugaagucuuauaaaguuauugaggaauuucuuaacaguuaccagguagacaucaaagaauucuauaaucccaacacuuaggaggcugaggcaggaggauuguuaugaauucagugccagucugggauauaagcuagcaagcaggucugucugaguuacauagcaaaaccacauucccgucuuccacccuucgaaacgaauguagcaugcuagagagaugacucugcaguuaagagcacuuguccguguuacagaggucccagguuguucccagcacccaaauggcugcuuauaacacccauaacucuaguuccaggagauucaagccccuguucugacccuuugagcaccaagcauguguguggcacaaauacauacauggggcaaaacagucaugcacauaaaauaaauuaaucuaaaaaaaagaagaugcuauauaaucuaggcauuacguauauauuuccaaaaacacgacccauaagaaagcgugagugaagagauucugugcugacacucugggggacaguucugccuuugagucacccuagcccaggcacagguaugcccaagaugauucugccuggcccuucccagcucgcuucagucucucugccgaguccccagacauuguguugcagaaacaagccauucccacaaggauccguggguaaauuuugacccacaguaucuaugcucacaguauaaugcuagaaggaaggaaauuccuucaauagaugagucuggagacuggggaaagaggucuguuagcgauguaaaacuguuugaauagccaggcuuacaauccaagcacugagcugcucaaauagaaggcgacugggcuagacggcaaaucucugacugaaagaauggaaggaaggaaggaaggaaggaaggaaggaaggaagagagggaggagggguggggugggggugggggcuagaaagcacagugaguaaaaacgguugguggcuuugggguuaguuaagcagcagugguguccaagauagagaagagagggaucuggggagacagcagaacagauauuccaucuggacagcagaagugacccacuaagucaauaguuagugcugcucaauguuauaugcagaaucuguucugaaaucagcaagcaacaaagccucuggauacacugugagggacuacugaacaucugggauguggaugagggaugcuguugauugguuaacugcaggcuggagaccccacacuaggguccugagcuguauaaaaggagaaagcuagcugggcuccagaauucgugcccuuugcuuccuguuugugggugccaagugaccagcugccuuaagcuccugcugcccugauguucccaccucagugaacaauaaaugcccuugaauuaggagcccaaauaaagcccuucuccuguaaauugcuuuugucagaaugguuugucacagcaacaggaaaauucacuuaagagacuaggacucugcauuuuccuucuucagccacaaaacagcugaaagauguuuccuguggcugcuguaaucaacuugcacaaaacggggcggcuuaaagugacaggauggacggccucuuucucagcuucuguggucaccccacugccaccucuguuucuguugucacaaaguguuuuucccagcaugagugucucaauuuccuuuuuuuuuuuuuuuuuuuuuuuuuuuugguguauauguguacaugggccagauugauaucagguguuccucaacugugccacgccuuuuuuuuuuuuuuuuuuuuuuuugagugagaguuucucauaaacuccagggauccuacuguaucugcuccacuagcucugggauuacauucacugcccugccaauuguuuguuucucugguccucagguugacacagcaagcacuuuacugccugagccacccccagucauuuuccugcucacagugcagcccuagcuggccuggaacuuguagacaaugcacagaaaucccucugcuucugucucccaagugcuaggauugaagacaugcgccaccacauucagguccgacagcccaggucuuguaaggggaccagccacaagauucagagucaucuuggucugguauggccuaaacuugaggaccucugcaaacacucuucuuccaaauaaggcuacauucacuucaaugucuuauuuuaaaacauauauaauauaauauauaauauauauuauauauauauauauauauauauaauauauauauauauauauauauaccuguagucuguauguguauguguacuugcgcuguuagugcuccuugugccuaucagagucagaagaagguguucaauccccaggaacuggaguuagagaugguugcaagccaacauguagauucuggaaauuggacccaggucuucuacaagagcaaugaguucucuaaacugcugagugaucucuuuagcuccuauuaucaauauuauucaggguauugaacccagggcuucauguaugcuagcuaaguucuccaccccugaccuauauauauccccagcccuuuucuuccuuuuauuuugagacaagcucucauguagcuacucaggcuacccuugaacucacucuguaucucugaguagcauacuuucaaauuuugaucauccuguuucaggcuccugagaggaugggauuacaggccugagauaagucgccaggcucagcuuaacauaacuuucaguggugcacaacucaacccauguaaggaggauaugagccagagcuggauuuuauugaugaacuccauagugaggagcuacaaaggaguuuccauuggagaguaacuauagcaguguagugaguggaccuaugcuccaccuccacaccaaccauauguggucuuacuugaagauacuuuguuguuguuccuguugcuugauacagaguuucucuacguagcccuggcuguccuguaaguuguucuguagucuaggcuggccucaaacucagagaucuaaccgccugucucugccuccuaagugcugguaucaaaggcauauaccacuucagcucagcagaauugaaauucuuguuuuguuuuguuuuuucgauacaggguuucucuguacagcccuggcuguccuggaacuugcucuguaaaccaggcuggccucgaauucagagaucuuccugccucugccuccuaccaggaugaaaggcgugugcuaucuacccaguuaggaaggugccuuucauucuucuucuucuuuuaaaaaauauuuauuuauuauacguaaguacacuguagcugucuucagacaccccagaagagggcaucagaucucauuacagaugguugugguuuccaggauuugaacucaggaccuucagaagagcagucaguguucuuauccacugagccaacucuccagcccccuuucauucuucuuaaaggguccacaguagccacaacaaauggaguggcuucucagccaaugacucugcuccuuaaccagagaagagaaacaaaggcagagggaagguucugcuuguauuguuaucauggauguugcagucucccugaucgauguacagacaguuuaaggacagacaccuaagauuaaaagcccugugguccaaaacagguaggugcucaguagauucuggcugaaugaaugaauugcucaaggcacucaauacucucccuaaauauugcacuuccgggcaguauuaggagauucaaacgccaggaccucuagcccucauuuuugcugacagcgcuccugguuguugaagcauggaagaggcacagccucacagacuuagucuaugggagaagcgucuccaaggugggauguuugcuacuggacauuuuucuuuuucuuuuuuugguuuucgagacaggguuucucuguauaucuuggcuguccuggaacucacucuguagaccaggcuggccucgaacucagaaauccgccugccucugccucccaagugcugggauuaaaggcgugcgccaccacgcccggcucucucucucucucuuuuuuuuucuucuucuuuuuuuuuuuuuaagauuuauuuauuuauuauauguaaguacacuguaguugucuucagacacaccagaagagggcgucagaucuuguuacggauaguugugagccaccaugugguugcuggcauuugaacuccggaccuuuggaagagcagucggguacuuuuacccacugagccaucucaccagcccuuggacauuuuucuuaugugcagccaaggcuuggcuaccugagaagaucaguucccuagucaaacuaggcaauugggucuuucugauucugggcaguuagaaguuaaaccgucaacaaucuuaggauagacauuuuuguggagugcuugccuagcccuggaucugacucuggugcugccaaagcuggguguugugagucaugcuuagagccucagcacuaaaguagaagcaagaaaauugcaauuucaaggucauccucaaauauggaacgaguuugaggcuagccugggcuacuuaagacccugauucaaaaaauaaaguuagccgggcguugguggcggacgccuuuaaucccagcacucggggaggcagaggcagguggauuucugaguuugaagucagccuggucuacagagugagugccagggcuacacagagaaacccugucucaaaaaaaaaaaaaaaaaaaaaaaaaaaaaaaaaaaaccaaaaaacaacaacaacaacaacaaaaaaaaaaaacagaaaaacaaaaacaaaacaaaaaaaacccaaaaaaaacaaaaaauaauaaaguuaauaauuucacgaauacagaaaaagcauuggaaggcaugugguuagacagguuauugauuguugguuccuuugcuuguggauauggguuuuuuuuuggcggaucugggagaagggacagucuuuugguuuuguuuagccuuauuuuguguuugccccgucaaacccuggcuuuaacguguuaauaaaacugacuaaauaugaccagcugaucuccacagccucugacuuucagcugccuuuccaugcagugccuggacuaaaaagagccuguuuugccuaggugacaacagggagaguugcucccagcaggacacagccugaggagggccccucagccagaucucccuuaggacuggggaccaaguaaguucaucaucccauuccugggacacagacuacugcuucacaagguacucagcgaucucauaacagacaguugggcuugcucuugagagagaggaauuuaaugccugccaucugugugggcaagcucaagggcucccaaaucaaaccagcaggguuugagagaaagcuaccuaauaaccaacaugcacauuucugaaaaccaaggccuaccaaucaggauauuaauucuccacacccccacuugccuuauaucauuugagaaagcaucucauguagcccaggcuagccucaaaaucaugacauagcugaagauaaccuugagcuuuggcucucuggagugcugggaugucaagaauuugcuaccauaccugacuuuauaucuuucuggcaauaaaaacccagagcuuuaagcaugcucaaaugcuccaccaacugagccacauccccagcccuccuugacuuacuuauugaucaucauugggaagcaaauccuugaacgcuaauuggaaagagucccuaucaaugauaaacaaagacacagcuauguacgacuuagacauaaaauugucccaccugggugaauuucgggcaaggggagagcucuaucauacagucaggggcagacuucucagagaagggaacuaucaaggaaaugcauuuaccugucaaaggcagagucagucccacagugagggaagagagcgggagugggaacaaaugcuacugaguugaauuccucaagcacuggaaacuccagcacugcauaggagacgagggaaggcgggggaaacuauauauauuuagccgagugugguaguguaaucuuacacuugggaugcagaggcaggcagauaucugugaguuuggggccagccuggucuacagagugacuucuaggacaaccaaggcuacacagagaaacccugucuugaaaaaaacaaaauaaauaaauaaauaaauagaaauuuaaaauaagaaagaaaagaaaaaauuaaaagcaguuguaguuggguuuguuguuguuguuugucugucugucuguuuuuuuguauugucugucugucuguguuuuuguauuguguugcuuuugagacuggauuucacucuguaguccagacaagcccagaauucacuuuguagcccaggguagcccauggugauccuccuaccucagcucaagugcugggcuuacagggaaaguaucacacucagcuguuuuucuuucagagucuggcuuucccccagcagugauuuuuuucucugucucaggguuaggaaggaaggacaaaggcucuguaaaguagggccaugcaugcccuuggucugguaaguuuggagggccaucuuggagucccucugaaauaguuuuuaaaacacuuccuccaguuuguuggccuuguaaggguguggcagacaugcagaugaaugucacacaaugcucccaaggcuaagcgaggagcauggccacuccaggaccucaggaggaagcgagucacuccaagagcaguaaaagaagucaaaggggaggugggacugggguaaacugugcccuggagaccuugccuugccccuccugcccuggagacaggaauucacagcaaccacugcagcccucgcuccucccuacgaggauuugcaguagaaaucagaaguguaacagaaaaccacagacacaaggggauauggggcaggcaggaguuuuaacuggcugauaauuauggggaaccaauaccagcuuugccugggguccugagcaccccucucccucgaguguuucagaagcuuuuggguaagaaguuugggagguuaucccucaccaaaggcacugggcaaugcccccggccaaaugaagcccaggccacccagauguguuggaaucccuccucacuguaaaauccuuccaucccagaagacuucccucucaggaaaucaaaauccaagccacgccuuuggggaacagagccuccaaggaaggcagagaaucacuccccugaaaaccagucucccaggggaggaggcaggccuggggcccaggugucuuuccagaaaacaaggaccaucuagagggucugagguggcaggggagcaggcccgagggaauguuagcagguaauuuagggaagggcuucgcagucuccaugcuacuucugaggcaaggagacaucaacaaugaagguauaaacgaaacggcuugggauuuauuuuucucgggcacauaauacuuguacauauuuauggucacacugggaagaucucucuuaggacuaguguaccauuuccauuuccucaaaccuugcuuuucauuuguuuacuuauuuauuuuucuuuuggggcuuuguuuguuuuuguuugucugucuuagcuuguguugagacagggucucauguagcucaggcuggccucaaacgaguuaaauggcagaggaugaucuuggacuccugcuccccugcucccccaccuccuaacugcugggauuacaggccaccagucuacuuccaguuuguuuuacuuauguaucuauguguuugccuaucgggaaguucucaacaacugagaaaaguccccagcccauuuuuuacuuuuuauuuugaaauagggcaucauuaacuggcccaagcuugccuugaacugucucuguaucuguaucccaggcagcccuugaauuugaaucuuccugaauagcuuggagugucaugccuggcucuuuugauuuuuauuuguuuuauuugucuuugacacaaagaagcauguaacacaggcugauuuugaacuagguugcagagacuaguuuuuaauuccuuaagccucaggccuuugaaccucagccuccuccaugaugggauuacacaugcgcaucaccagccaccagaucugguuuuucuuuucuuuucuuuucuuuucuuuucuuuucuuuucuuuucgcuucgcuucucuucucuuucucuuucucucucuuucucucucucucucucucucucucuguuuguuuuuucaagacaagguuucucuguguaguccuggcuguccuggaacucacucuguagaccaggcuggccucaaacucagaaauccgccugccucugccucccaagggcugggauuaaaggcaugcgccaccacugccuggcuguucuucuucuucuuuuuuuuaaaaucgagguucuaauucacuguaaaggauuacauauuaaacuguucugucucgguagucuacucagaggaagugagcaaguagguccucuacauguucugggauagagcugggauuggaaauucaggucaacgaccuccuuaauuccucuucuuagaguucagccagacuggaguguggaagcccggauuccacacauucugccuuuuaagcacagacugcuacuuuugacacagaacacauggggaggaguguagcagucugcucaagguguagaagggaccuggagccaauucucugcccaguaccaguaagacagggaugcuaaguucacucacaagcuggcaaugccuuggccgcaacugguggucucagaugcuuacaggggaccuugaccugcaauagcuacagccugggaggaaagggcaggguauacauuugaugagagauaccggcagaaagggcacagcaguaugcucccccaaaggaggcuuugggucuucuuagaaaaugaagagaggccucaguccccgucaaccuuugucaaccuuugucccugauggagcaaggaagauggcuuaguuagaguuucuauugaugcaacaaaacaccaugaccaaagcaacuuggggaggaaaggguuuauuucugcuuacacuuccauauaaauguucaucaucaaaggaagucaggacaccaacagggaaggaaccuggaagcaggagcugacucagaggcuauggagaggugcugcuuacugcuuucuccuuauggcuugcucagcgugcuuucuuauaaaacccaggaucaccagcccagggaugacaccaccuaugggcugggcccucccuuacugaucacuaauugagaaaacgccuugcagcuggaucucauggaggcauuuccuuaacugaggcuccuucuccgaugacucuagcuugugucaaauugacacaaaguagacaguacagaagaggaagcugcuuuauuguuuauuuauuuaauuaguuuguuuguugcaacaagggcucacucuguaaccaucuagucuggaacucacuauguacuuaaugacaucacacuuuugauaaucuuccugcaguaguugauauuauaagcauaaacuaccuguuuuauuuucuuucuucuuccuuccuuccuuccuuccuuccuuccuuccuuccuuccuuccuuccuuccuuccuuccuuccuuccuuccuuccuuccugagacaggguuucucuguguagcccuggaacucacucuguagaccagcuguccucaaacucacagagaucugccugccucugccuccugagugcuggaauuuaaaggagugggacaucacugccuagggcccuuuucuguuuuguuuuguuucuuuauuauuauuacuuuuuguaaggagggcaaugucucacuaugaaguucugacuggucuagaacuggccuugaggcaauccuccugccuuugccuccugagugccaagaauguucuauuaugucugacuccugaccugaacuucuagccucgugcaugccaggcaaacacuauaccaugaagaagcauuucuuuucuuucuuuucuuuuucuuuuuuaaaaguaacaucucuaagcuaagcaagcugaugggugccugcaguucugucuacuucagagacucaaguaaagcuaucauuugagcccaggaguugaaggccagccugggcaacauagugagacuuuguuucaaagaaaacuaaaccguguguguguguguguguguguguguguguguguguguguguguguaggaguaugugcacuugugaguucagguacccaaagaguccaggaggaauuggaucccauggaguuggaguuacaagcaauugagaaauaaccaugcgggugcugagaacuaaacucagguccacugcaagugcaagaaguauuuguuuguuuguuuguuuguuuguuuguuuauuuauuuauuuauuuauuuauguuuuuccacacaggguuucucuguguagcccuggcuguccuggaacuuacucuguagaccaggcuggccuugaacucagaaauccaccugccucuaccucccaagugcuggaauuaaagguaugcggcaccacaccuggcuaggaaguacucuuaagugcuuaaccaucuuccugguaccuagaggacaacuuuccagaguagguucuugccuuucaccaugagcccuauggauuaaacucagguugauaacuuccuuguaaggcaagugcugaacaacuucaucaguccagaaauaacuuuuuaaggaggguggugugacucaguaguuaaaggcacugcauuugaccccagagaggucgaucagauggcucaguggguaaggugcuucuucuaauccugauggaugacuugaguucuaucccuaggacccacuuaguagaaggagagaacuaacuccuacaagcuguccucugaucuccacaugugugcuguggcacucauauacccuuuacacacaaaacaaauacauaaaaauguaaugauuagagcuggguggugguggccacaucuuuaaaucccagcacuugggaggcagagacagguggaucucuaugaauucaaggccagaguaaguuccaggauagccagggauacauaaagaaacccugcuuucaaaaagaaaaaauaaaaaagauguaauaauuaaaaagcaacaucaaacauaacaaaccucuuguacccauuagguguuuguuaccccaggccuuagacaucuuuuuggacguuucauggaaaugcagucacauacugugccggcuguuugugacugacuucuuucacuuuacacaaaguuuccaguggucgccuaugcuguagcauguguuugugcuuuuuauugcucaauaauauuccaguguauggacauaccacguuuauuucauucauucagcaauuuggacacuuaaguuuuucuacuuuauggcuauucugaauagccugaauauucugaauaguugcuuuaucagcaagauaaagaugugugcaaguuuuugugugucagggugggauuucuuaguuaacuacuaacaaacauuuauuaacugccuguugugcacauagcaugggauuaaagggaaguugaauauacucaguauuaaaguaaacacaaauacauuuuuaaacuaaauaucuagaggacuggcaagaugaggcagugggugaacgcuuguggcacuaacaggagggccuaacuuuggauucuaguaccuguguuagcuuacaggugauuccgggaggauccucccagggaccuugcaaugguuuaugucaucauuggaugccuuuaccugaggccuagugaggguggccuauaaaaggacugcuuacaauuccagucuccccucccccuucucuuucuguucccauguguuccuggcuggucucucucuccccauuucuguccucuguccccaaggcucugcucccaucuguccaccucuaccccuucuccagccccucacauccuccuuucuucaguaaacccccuuuauaccagaucuguugcaugagugggccagauaacccacccucaaccucaccucucucauauucuauuuuauaacaacuuauguaaagguaggcacggccuccuguuaccccagugcuguucugggcagagaauaaggauuccugaccuaugcugguuagucuagcccccaaaacagcaagcucuaggcucagugacagaccuugucugaaaauaaugggcaaaguuguaguauuguauguauuauaugcaaguaaacaugccaugcaauuggcuuccuuguaucuguggguucugaaucuaugauucaggaaccauggauugaaaaugauuuuuuaauaaauaaauaaauaaauuaauuaauuaauuugguuugucgagacaggguuucucuguauaacacuggcuguccuggaacucacuuuguagaccaggcuggccucaaacucagaaauccaccugccucugccucccgagugcugggauuaaaggcgcgugccaccaugcccggcuuaauuuuauuuuauauucauugguguuuugcuugcauguauggcacgucuaugugagcaugucagauucccuggaacaggaguuacagacaguugugggugcuaggauuugaacccagguccucuggaagagcagccaguacucuuaaccacugagucaucucuccagcccugauugaaaauacuuuuaccuuuuuucuuuuuggagacaaaugucagccuuaucauguccuucucccuggcuggccuugaaauuauaguguccuucuucuaucucuugagcacugagauaucauguuuucccaugaccaguuugaacuuuaaauuuuuuucuuaacuuuguauguguuugcugccaugccugaaugugaagguuagagaacaacuucuccuuccaccauauauauauauaucugucucccaucccuucauagacauuuugggguuagagaugcaugucaccacaucuggcuuuccaacuggguucuggagagacagacccagauuguuaggcuauacccaugggggcaucuugaaaaaucuaucgaucuauugaucuaucuaucuaucuaucuaucuaucuaucaaaucaugucuugaggguuaguaagaugacuccuaagguaaagguauucauuacuaagccugauagcuuuauuucaaacccaggguugguaugauagaaggaauaaucuacugcacacaugcaugugugcacacacgagcaugcacacacacauacacacacaaaugcacagagcuauuuacuuacuuuuauuuauuuguucauuuauuauuuugagccagggucuugcuauguagcccugguuguccugaaacuauguagcaccaccuggccuuaaauucacagauauucuccugccucugcuguucugggauugaagauuugugccaccacucuggguuuagaaguaauuugaaauaaucaugucucuacccuggagguggcuugccagguacugcauaugccugacaaccugaguuaucagccccagaucccacaguagaaugagagaauagauucucaaaaguuguccucugacacugaugcucaaguuguggcaacacagagagagagagagagaggggggggggggagagagagagcagagagcacacauacagagaauaaaaauuuaaugcauagcucuauugaacauguaggguuuccuuuguugccauuauucccuaacaauacucuggugagcacuuauauaauacuacauggaaugaguuaguaaaacaaaucuagagaugacugaagguuugggaaggugagggccuauugagcucauggucuuagcaacucaggacauugaagcagacuggcauagcaagcccaggucuuaaaaaauaaaacaguagauaaaauuuggggguggcuaugcaaguuacaugucauuuuauaucagugugcauucuguaucuuuaagggucuuggaaccacuuaauagaugggugaagaauggacaauuuuauuagaauuuuuagggugagggugggggucuuggugggcaaaaauaggaccagaaaggcgagaugggguuacuguagagaugggaggcucaggguagguggaagauguuaauguaacuuuauuugccugauauaauuguugucuuggaagcuuacugccuccaucugcuaaccuaggccuagccauggacgcuucuucccucuguacauucuaauucuaggccuacaguguuuucagccucugagauuugcugcuguauaaggucacuccuuccuagcucuuucuguucuguuuuuucagucuuucgagacaggguuucucuguguagcccuggcuguccuggaacucacuuuguagaccaggcuggccuugaacucagaaaucugccugccucugccuaccaagugcugggauuaaaggcgugcacuaccaugccuggcuccuaguucuuucugaucucuggcuuggcuguucaacucagcuguucuggcucaaacuccucuccaagcugacugauucaaucuggcuucucucagcuucugacugaauugcucuguuugaccucauacuaacuuugacaauauguucuaaucuuugggaucuuucucauuuucugguuccuucugccuucaccugugucuagcuuguucucucucugcaaccugucucuguaucacagucccaguaaaacugccuccucuguuaguacugcuccucagacagcuccccuuucccaucucuucuugugagaauuaggcauauccuauucuauaaaauguuucucucucuuuugggggccugggggugggguuugguuuuuuguuuuguuuugucacuuucucuaccacuuagucuauuacuuucaaacauggguguuucuuucuauaacuaauuguaccuccauuauuuggcauuaaagguguguacuaaggcuaagccacaccacaacuagaaacaguuuuuuuucccccccaguaaacaacacagucucaggguucacagagugaucaaauauccugcaacagaaagauguuggggauaacuugggauugaugaauauauagguaaggguaucggcuugcugguggucuauaggugugaauaaaaauagucaggggccgggcagugguggugcacaauuuuaaucccaguccuugguggaggcagaggcaggcagauuucugaguuugaggccagccuggucuauagagugaauuccaggucagccaggguuauacagagaaacccugucuggaaaaaucaacaaaacaaaacacccaaaaaaccaaaaaacuaaaacaaaauagucagagcuuuuagagcaaccgguagaauugucauguuguuauaugggaacaucagaggaggcauuucuucuucugaauacauuaauuugguuuacaauggucuagaaaucuuuuuucuuuuuucuuuauuuguguauguguguauguccacagaggucagaaguggacaccagauccucuugaacuggagugcuuaacauggauacugggaacagaacucugguccuuuggaagagcagugcgugcucuuggccacuggccuccucuccagucccagcugagguuaggaggagugucuucagugucaugaagaaaguggaauuugcauggaguaugaaagagaaugaguucuucaacaucuacaaaugagauuuucuuuauuggaguuagcagugugguaacucuagaaccaaugacuugauauccucugauguuuccacuuccuuccuguguggcccugggcaagcuguuuaacuucugggaacacucauccauccugcaggcuguuagguuguaaauaccacaccuuggccccgugccugauucaggggagacacucaguacauauaaaacuuccugcuacuuugaagagaacuuugggaagaaccauuaagcaaaaauuuccuuacauuuuaaucaguuuauuggggggaauugcugcauaggucaccauacuuauaugcaggucaggggacaaccaugguaguugcuguucucuuaacaccacugggggcccaaaacuagaacucaggucuccaaguuuaguugcaaaugcuuuuacucacugaggcaacuccuuuuaaauguuauuuauuguguuuuuguuuuguuauucuagccaggguugccauauauagccuuggcaguccuaaaacucucucuguagaccagucuggccuuaaauucagagaucugccugcuucugccucucaaguguugggguuaaaggccugugucaccacugccuggccugguuuauguguguguguggguguguguguauguaugauauaggggggagaauuuaugagugcaggaacauaugugccuggugcacauguuagaguagaaaaaaaaauguauggccaagagaauagaggggcuggaaagauggcucaguaguuaagagcacuugcugcucuuccagaggaccuggguuugaugcucagcaugcacgugguggcucacaacuaucuguaacuccaguuccagagaugcagugccuucuucuggcauuugaugguccuaaacaugcaugugguauaaucacagacacccaagcaaaaaacucacacacaaaaugaaauaaguauuaaaauauugagagagaaagauaauggaaacucuggccuuggcagaugauauggauauggauauagauauggauguggauauggauguggauauggacauggaugguauagauauagauauagauacucaagaugggcuggaauuacuuggcccagggccuuccucuaagaggcaggcucacuuuaagccuggcuaaggagagagggggaguaacugguacuuuuuuuuuuuuuuuuuuuuuuuugguuuuuugagacaggguuucucuguguagcccuggcuguccuggaacucacuuuguagaccaggcuggccucgaacucaaaaaucugccugccucugccucccaaaguacucggauuaaagguguucgccaccaccacccagcuaacugguacuguacugguccuacccauagucucacuccuagugcaguagccuccugggcuauggguccauagcauuucagccauuuugcuuauauaucuaucucucuguucuuuuucaauuauucagaaaaucauaccuuuucuuuuucuucuuuucaucucuuuugcuagccugcuuuccuaacacuuuggacuacacccccccccccauccuuccuacccuauccucccauucaguuaugccuuuuguguaagucuuccuccccaugguguggcugcuugucagucugcccugugucugaccuccaugcuagcuuaaauagcguggcuuucccccuucuuucuuccauugcccugacguuuaaaguuagccugcacuggggcuuaaaaaaagaaaaaaaucuaauaaaaucauccuugcauuucucuuugaguccauucuuaaauucuuuuuuuuuuuuuuuuuuuuuuuugagacaggguuucucuguguagcccuggcuguccuggaacucacucuguagaccaggcuggccucgaacucagaaauccgccugccucugccucccaagugcuggaauuaaaggcaugcgccaccacgccuggcuuuaaauucuuuuauuagugagacuaacaacuccaagcgguaucaauaugacagccaggauaaaacuugcaaguagucaaguagucucugcuuccacuauggguucuuggguuggaaucaggucaccagguuuguguggcuuuuuucccuggagucaccucagcaacccagcacugacugaaagaagugacuggugggagcuguuaguuguuuguugccaguucguccucuucucucucucucucucucucucucucucucucucucucucucucucucucugugugaguuuguguguagaggcauauguauguacacucuuauggagauacaggacaaccuuaaguguuauucuucuuaggugccaucuaccuuauuuuugagauggaucucugacugggacccagaguccacugauuauccucagggccagccucugucucucuaacacugggauuacaaacuugagcuacuuuaccuggcucuucucuguggcuucugagggccacgcucauguucuugagcugaugcagugagcauucuaccaaauacguuaccuccccaaccccuguuuugagauagggcucauguagcugaggauggcuuuugagcuaccaccccuccugccgaucucagaacucugugucucccauuuccuucuuccacaggacuuaacagcaucccuugcucuuuguccucucccaccaccagagcccaugcucuauggacagagaaguuucaucugcaucacuuauuccuauauaucaaguaccuagaucaauauguggaacacaaauuggucauauuaaccaggccuggugugacucauaccuauagucccaucccagcagucaugagguugacacaggaagauugucaagaguucaaaauuaguuugggcuacaggguaaugaucugucucaaaauaaauaaauaaauaaauaaauaaauaaaauuuaaaaaaaaaucacaaaccaauucaguaggaugguguacuccugugacuugggaaagcagaggcaggaggaguagcugccauuuaccuagaugaagaaaccaaggaaagccgggggugguggcgcacaccuuuaaucccagcacuugggaggcagaggcagguggauuucugaguucgagacccgccuggucuacaaagcgaguuccaggacagccagggcuacacagagaaacccugucucaaaacaaaaacaaaaacaaaaacaaaaacaaacaaacaaacaaacaaagaaaccaaagaaaaagaggaaagaauguugcaucugaacuguauucugggucugugugccugucugaaguugagggggaagggccugcaucacaggagucuucucaggcaucagcagggauagcaaagaaagcccagaggcuggaugaggucacguggggauuagagcucucaggcauccacagcuccagaacagggaggugacaccgugagaaagaaaagacagggcaccagcaguggacugcacaaggccucuagccaggacacccugcccaggagagcacuccguagauauaggauaauucccaggcuucuuucucucgguuuggugcugggcaguaugugugagguugcugguggcccuguguguagacaaaacaugucacacaugacuggugcuaaagagguugcaacaucucucugaaccagacggaagcugcuacugaguugugcugcacgguccuuagugaggacacaacgaccagguuacauagagaucaugugaagugagcucggaggaucauuguuguuguuguuuguguaugugugugagugcgcaaacauucauggugucaguucaggcauacagccauggacaccaguccuugccuuucaccucguuuguggcacugucucuucuuuacuucccaccuggaaugccaggccaccuggcccuugagcuucugcagauucucuugcuuucuggcuccccuuucuuucgcuggaagagcagggaucugcacuccggcccacauggcaagcacucuaccuacaggcccaugucuccagggcagggcuuuacaguuuuagguccagguauuaagagacugcagauaugaugaccuccugaagggauccagaccugcgaugugucauuagagugagcuagcucagagugaacuguuuucucugagaaacaaucccgugggaacaggagacuguugggggcauggggguggggcuauuuuaacacuggguagggacaaccauaaauucaccuuaaggauuaauaggccaugucagaaaugguuuuaguuucuuguuggccucuuccacucacucugccaaaaaccuggcuucaucuuagugucucguuggaagcacuauauucucucaagcuuauuucuugccuuguagaagcugcauaugagaucagaggccccucuggucaagccuggcccugccccggggcagagauaaacaggcccagaauccauuucucagauugcaacacuggugagucaggcagggucggacagcugcucccucccaggcgccccuuggcuguaccugauaaggaagcucaucgcucauuccagaacuccgucuugcgagugcacaaguauaaacagacacucccaggcccugguguugucuuaggguaaauuauugacauucugaacggcugaaacaugggagaaaggggaaagcaaaccaacagacucgauaguaacuucaguuuucuuuagcaaagcuguggaaaaaaauuugaacuuauucagccaagggcaggcucaggaguuccuugaagcuauggaagcaggaaggaagaagguuagacuuggggaggcgcauucaggaaagaacaaauggcaaaaauacccagagggaaaugugugccugccuaccuuugccacagagacaauggauguuguagcauccucaaaagcaaguaaacaaaaccaauuuccccaaagcgaaugaccuccuccuauaacugguguauaaggagugggggaaauggggugcuaagagcauaguaacaguuacauaagaccaguacuagugccagacuacaccuggucaucaguauuucccauagugcaccuggucaucaguauuucccauucccccuguggaaagcaguucauaacaucuaaggcuuucacauugaucuuuuccauugaacuccaucaagccacucaaucuggguagggcaucagagcccauacuuuacagaugaggaaauuugagguucaggaaggauauaaguaacuuacugaggcauaaugaagagcagggagagguagaucaguccuaaguagccaagaguuaaaguacuuccuaggacuggagagauggcucugcagcuaagauguagugcggcuucuguagaggauuuaaguuugguccccaguaccuacaaaggggcucaaaacugucuguaaccuguaacaacaguuccagggaaaaugacucuuucucuucuagccucuaagggcaccaggcacauaauacacauggauucaugcaagcagacagucauauguauuaaacagaaauaaauccaccccccccaaaaaaaaaacagugggcgugguggcacacgccuucaaucccagcacuugggaggcagaggcaggaggauuucugaguucgaggccagccuggucuacaaagugaguuccaggacagccagggguauacagagaaacccugucucgaaaaaccaaaccaaacuaaaccaaaaacccaccaccaccaacaaccuccaaaggacaucaugguucuccuuugcuaagacugcuuccagggcucacccuccguuaccuguggagggagcaggcuugccaccaucagcguggucugcaaguuuccguuaugaaacacuucucugguuagucucccaaguuuuuuugcucacagcaguuguaucagugaggaggaaaagaccauguagaauuuuuaagcccuaacuccaggccuuucuuccucuaguguccuuuccuugacugucuguucuauauauaugcugugguuuuagagacaaugaccacagguccucuaggugccacugugugugugguggaggagcagagagcacacagcuccugccuuuugggcauaggacuuuauaaaugcacuuaacagucagauaggugucucgaaauugagacaucuuuuggaaucuugacggcagagcuuuucugacuuuggccagcaucggaaacauccgggguacuuguuaaagacaaggcuauuuaggccucaccccagaccuucugaauucccagcagcaguuccuggacucugugugagcuuaacaagcuccccaggugauucugagguguugggccaagcuugaaaaccacugucuuagcacaggggagggagguaaucaggcaaaggaggcugggggagccacucuaggaaagcugguaggggcaauaacacccuagggagucuggugcagacagugagaaagacaaaucuuguuuuguuuuguuuucuuccuucaaugaagugaucagauaaagguggcuagaagucuuuucauacccgucugcugacagauuucuccuaggagaaagcaauggauagucuuuuuuucuccccagaacauagaguggaaguuaccaggggcuggugggauggggaggagggguuauucuuuuaagggcacaugauuucugucuggauugaugaaaagguucaggaaaugagcacuagucauacuugcacaauauuuaaugguuuuuugcuguugcauugaauauuuaaauaugguuaacauuguauauuuuauauguauguuacaacuaaaaaaaaaaaaauagcuggcauuuugaaggguagaaagauaggagcaaaugaucuucaauuuagcccucaguaccugaccugacaaaguccaagugugugucauagagaaaagacaauagauaaagcuuuugaggauacuuggcacuauucugccucuuuuaccuuguugcuccuuagguuuacaguacuuuugagcccuguagagcaguauaucucagacuucacuguucagggaacugucugagaacuuaguucaacugcauauguuaauugaguaggccuaaggcccuucuagaggcauuccuuccuaguucucaaaugaugcugacacucugguccauucugggagagcuguguaaauuucaucuucaucuacacuguauccucagagucaugaacugauauaggaguucagagggcagaacugugucuuuguucugcauuauaacuuauuuagggugcuucuaucagucaccuuugugauuuuaaaaaggaccucaacuuaccucaaauucuguagaaugaggauguuaguaucaaauuauuucuguucuuugcugcuucuacugcaguuccggaguuguugaccuuguuugcauagaggguaaaugaacccuguuugcaagcucuggggaagccuuacuguagucuaaaucccugcaaaccaauucccucugaagagggagcagaguggagagaacaugcuggugugggaauuuccagauuuggacgccagucugaguaauugccacuuuggccuccuccauauccaaacagccuuugcagcacuguugagagggugguacauaaaguaugaauguaaucauacugccauuauuuacuaccgucguuuauguugaugguaacgacacuggcaguugaucgaugaagugugugaggagguugggggagggggcggagggaaugcacgauggcaggagaaagaggaacuacaucucccagaacuccccugacaagcuuacaccgcgacgacgaugcuccuccccucccaccggcgccccgccccucagaugacgucacagaggugacaucacggcgccuagagcgaggcuaggguagagaggccgaccgagcuggagucgucggcuuguggaggaagcagcugggagcuggcgagagcgugagcgagcgggcgggcaggcgaacgagcuagcgcaggcgggagggagcggcgcacggcgcggagcagcggcagcccgggccgcggcggagccucagucggagggcagcccgagcgggcgccucgguccccgcccccacucggcggggcagugcccgguguucccccgugcggggggcggcggcugagcggaccccacgggaccgcgcggguguugccaccucggccgaggagccggcgaggccgcggggcccugcgagcugggcccggagcccgugacagacgggccaaggaggggagagaggcggcggcggcgcaggcgacggggaggcagcggcagcggcgacaccaugucaucccccagucccggcaagaggcggauggacacggacguagucaagcuguauccuucauggaggggaauucggacugcguguggggcgggugggggugcccacucgagggcuccggggcacuccaggccacuggccgcgccuccccucccucccccagugccuacggcggccccuuggcaccuccccggagccgagggcuuuuucagucccccuuuaucugcagccccccgagaugugcguuguucuucgccuuccuugcacuccccccccacccccagccccugacuuucccucuacgacguuuggauuccuaagacggcccuuucuuagggguguguguggggguauaacuagacgccuccuucgucaccgggagcucaucuucagggucuuugcuuccuguuugcuagcuuuggguuuauggguucauuauagaaauuccugagagggaagccuuucucucucucucucuuucucucucucucgggugucccuguuccuuccagucacagugcugcuuaaacugggguaacucaagcaaccuucuuuaucccuaauuccuuucuauauuaggaagagaguagccugcccagggcccccucuuguaauaaagagcuccguguguuuuaaaucagacacuccuguuaagccuucuggucuggagaaccuuccuguuuuucuuucuacucacaaagccuaucccacucauagugcaugcagugaggacccccaggcccucuuagcaggcaggccacccuccauauuguggaacugacagcugggacgaaggagagaaaggagcuccccgaacaaaauagccacuugagcaaaacucccucugaggauaugguucuuggggacugcuugcccugaucugggccaagugacaccuuuuauuuucuaccccuucccccagcuuuauauacacccgagguugcagugggagagcuguaacugauaagaguccuccaggcagugguuuugguuggaauccaggcugauuuuuuuuugcaugaccaguagagaaauucgcgaagguuccuaaggcaaaucgagcauuuaaaaaaauguuuuuauuuuuugagggugggggugagagcccaguguuguaaauagcugauccccagggagagggugagggggggcgguagugugugaaaggcuguuaacaagucuugucuccuguuucucuuuucugccucgcccccaucccccaaccauuucccccguugcaggauuuuguuuauauaacucaaguuguuugucuagauucuucagguaauuccuucucuuacuuguugcuguuuuuuauuuuuuuauuuuuccuaaacaucaguggugguugucaaaaacucaguuauggaauuugcugaaguuuuuaaaaguaguuuuugcuuaggauuuuaacuugggggaugggaggaaaguugccuaggcaagaguuuucuuuuucauuuucuuucuuuuuuuuuuuuuuuuugugacaucuuuucaagaauaagaagguauuuuuucucuuugcccaggggagagcuggcuagaaauuaagaauagugguuagacucgcaaguuuuaggguuugaaaucuagaauuugggggaagggcaguaguaggaaggacuagagugaagccaguaagaaagaguauuacgcuagauacacaccuaggcaaaugugacaucuacucuuuuaugggcuguuuguggcugugauuguuuuguaaaugcaugaaugauaccggaaugcuggcuuuucauaccgcaggaaaacuuguaaccauggcucuguacauucuacacaaagcaguuggggggguauuuuuguuuagaaacuaggaaaugacauggugcuagacuuaggaguuuuuuuugucuugaauugagaguuugagaguuaccaucacaccuaaugcaaauuucacccuaauguauaauugggauggagugggggagagaauuccagcuguuuuugaucgaugucagauccucaaauuacguucauauauagauuucugaaagauugaggauaaagagugaggccuaacuugaccugaugccuuuuccauacagugccuuuuguucacguaguaguuguggcaucuagaaugauuaccgcauuuaggaguccgggugugugggggggugacuagugggggggggcagcgagggagagggaaacaaagaacagcggggugucucucuucccccucucccuaaguggcuuauuucauagcuuauuuuuaguagaagaugaagaaaggcaaagaugcacuggcuucuguucuuuccccaccucccuugcugacaaagaaagcagggcucuuuaaaacuguagauuucugagauaagaggauaacaguuuugauuugaaagcuagaggcuaucucuacuucaaguuuauuuucugguuuaauguaguuugggagugaaaauuuuucggauuuccuuuugugugugcauguuuguguguauuguggaggugagagauuuuauggucuccuuucucaguugaauucacaucaguaggcccaaguggaguuuacaauuuuggggaaagguauacuuagugaaaaauuuaagagugaauucuucagucugcugguaagauggguacaaucaccugucagugcugaggauuaaaaaugaaagauggugguaaggaaguagaaagaaaaggucugaaggaaugucugguacuugucgucgucccuccgugguuucuuugguagaggcugauagccaguuucaucaaugucuccuguuucagcccauuuuuggcugucuucugggcauaauuacacuacaaggauuuauagcuuggcagcaaccuauaugguaggaaaguagcgguguggggguagggagagaagaggguguguuacuaauuggucacugcuuuccugcaccuugccagacacggucucuuucagagccagugguauuucuuuugugacggguugguaggauagccgacucccaaguuaugcagggagugaguguuuugcaccaaugcacuuaaucugcugggcgauuauacucugaaacucugacucauucauuguuucucuucugauccucagcugaggguugugcaaaccuccacaggagccuagaaacugauuuacaugacuuucgggugcugcgggauaaaaaccacuugucuuuagccuagguucuguaaaaugaucuuggauagugcagccauuugcuugccagagccagguagauugcuagccuugagagccacacaggacuagccaccuuugagguuuccaucggcaaccacugauuauuuagauugucugagaacugggacucuggugaccuuaagcgugauuugcccuaaaggaauauugguugaaguugucccugguggaggaacaaacagcucagguuacauggguuuccuuguuggugggggugacugucucgcccuguugcacagcucuggugagccuuuuaucugugaaccagugccccugcugaaggcuagagcugcuuguuuuggaaaagcguaugcaggcaaaaggccgcaggcacagcuccuugcagcucauuggcugcucuguuacuacccggaaaaggaggagggguggagcuaccaaacagcugaugggagugugugacaagaguguguuuacauacaaaggaggugggggcuggggaugccuugagcugcugacagaaccaaggguauuuucaagggguaaaaaaaggaaaaccuguacucagacucaagaaauguucaaaaaauuaaacuagaaaacugaaucuuaucauaauggggacuuggcacaccucucguugcuguaauacuuggaaauuucgaauacuaugacuuuucaaagacugucuuuuccaggagaucucaguaacaaaacaggauaugacguuuuaaauguccuuaagugacuuauaguuaauagugacuuaaaccuguagugggaauggacccccagagcucuaagcuugcuagaauuuaaagaaaagcugguguuugcuguaagggcuucagaaauuuucuggaacaaguucaaaccucuaaauauuugugcacccucuuugugucaggcacagugugucaauguggagggguuagugagaaguucaaagugguggacguaguacuuguggaauuaguuuuuguuuguuuguuuaucgagacaggguuucucuguguugcccuggcuguccuggaacucacuuuguagaccaggcugggcucgaacucagaaauccaucugcuucugccucugccucccaagugcugggauuaaaggugugcaccaccaccgcccggaguggaauuaguuuuugaauuguuucuuuaaaucagaaugugggaucagcauuguguguuacaccuugcuuuuuugaauacuuaguauuuucaagauugaauccccccccacacacacaccuuuuugccagcuguggugucucacaccuuuaguaucauuaauuggaaggcaaaggcagauggaucucauggccugggcuacauagagacccugucucaaacaacaaaaccugauuuuuuuuuuuuuaaugaaaguuaaaaaguaauuuuaugugaugaggauauauaugggcauccaaaugccuuuauuuuuuauuuuuuuuuuuaaaacauuaaaacaaaagcauugaaaugugaaaccauuuaucucagacuuuagcuuuggcguguuugcuguuaaucagcaguuaucccuaaguuauucauuguuuaauuuguguucaaaguguaggcagucuuuuaaccagccccuguccauuggcaaccugugguugaccccuuauuuccuguggcuucucucuugaguuggugaggugaaagaauaaguuuauggucucaaagcuaaaacuugaaaacuuggcaacucccaguguuuugaguuugucuucccugcauagauuuuggugacacagggaugauuauagcacuuauuuugguaaaccaagaaccucugugaguuuugcagugaaguuguaaaauauaaacaagcuuacaaauucagcuuauaugaaggaaaaaucuuguguagguguaagagacccuuucucucuggguaugcaguaaggcgaccugguuuguuaguuuggguaguguugugacuuucccagcacucugacugguauuuacacacacaugcaguugggaucucauuuuaugcuuccaagaaccauugaauuucuuuagacauguaauucagauccuauaaugcuuacaguguaguagcuuuuuaccuggagaccuagagaaucuguguuuuaaugaaacacuuuaaugaaagacauaguaggguuuugaaaguauuauaauaaaguaauuggggaaaauauagguuacaaaaagggaaagaaaacagccacucauaaucuuauccuuuaaauaauaguuuucaaacuugagugugaucuuacuugcuuggaggguuugugaaaacugguucuggaucccaccguggacuuccuguuucaggaggucuagaguggggucugggagugagagacuguggaagacgucauccucaaacccuagccuguggcugucucuccgaggcauguauucuugccaggaguucuuguuuccgacgucaugaccauguucuauguaccugcucuguaacugcuuuucccuguuaaaaauacuggaaauaagcugggcagugguggcacacgccuuuaauuccagcacucgggaggcagaggcagaggcaggcagauuucugaggccagccuggacuacagagucaguucuaggacagccagggcuacacagagaaacccuuucucgaaaaaacaaacaaacaaaucauggaaauagggcuggagagaugacucaguggguaagcauugacaggaguucaauucccagcaaccacaugguggcacauaaccaucugucaugggaucugaugcccucuucuggugugucugaaggcagcaacaguuuauauauauuuauauccauccauccaccauccacccagggacagaaaucagaccaaaggcugagaagaaggaagaacuauaaauugauaaaagaaauuuuugccaccuaggcaauggaagcaggaagaugaggaguucaagacuaaacugaacugugugagauagaggcagcagaagcucuacuaggaguccauccuaagcuauacagcaagauuaugugugaaaagaccaaaggcuauagagauggcuuagugauuaaaagcacuugaagcuuuuguggaggucugggaucuauucuaaguaccuacaugguguuucacagucacccauaacucccauuccaggagaucuuaaagucuuguugauuucaguguguguuggggcggggauggagugggguaguagcauguauguagcacgcgcgcgcacacacacacacacacacacacacacacacgcacagcacacgcacacacacgcacacacauacacacgcagauuuguacauauaaaaaguguuuuuuguuuuccaaaugguggaaagagagaacucaaaaaagcuaucuuuugaccuacacacacauauacacagaaauaaauuugggagugggggguugugucucacuguuuagcccuagcuaccuuagaacaggcuggccucaaauucacccuaacccuaauccuaauccuaagugcugagauaaaagguaugcaccccacaccccaauacagggucuccuuauguagcccuggcuguucuggaacacaaucuguagaccaggcuggccuugagaccugaaggccucugccuuucguugcuaggauuaaagguuugugucaccaagcccagcugaaaaguagguuuuaaaaaucaguggcauugcugggcgugguggggcacaccuuuaaucccagcacucgggaggcagaggcagguggauuucugaguucaagcccagccuggucuacaaagugaguuccaggauagacagggcuauacagagaaacccugucucaaaaaaccucaauggcacaaaucacuucacagcaucugaguugaggcuagcuuggucugcauaagaaguuuuggcuacccagagguacauugugacaaaccaacaaaaaaggacaacuaugggugagauaauacagucacuacucauuaucuucuacuacuuccuuuuagauucuuuuuggaacuuuuuuguuuguuguuuuguuuuuuugagacaggguuucuuuguguagcccuggcuauccuggaacucacuuuguagaccaggcugggcuugaacucagaaauccaccugccucugccucccgagugcugggauuaaaggugugugccaccagugcccagcuuuccuuuuagauucuuauggugcuuguagaucgugggagcgugugugggcgagugugcacuugcccuggucagucuauccaccacucuacagccucagacauugcucuugucucuauuuuuaagggaagguugagcuuaaaacaagaucuuacuauuauuauacagcccaggcuggccucaaauuucuaagauccaccugucuuggugccuggaauucugguauuacagguuuguauuauuauaccagcucuuucuuucuuucuuucuuuuuuuuuucuuucuuucuuucuuucuuucuuucuuucuuucauucauucauucauucauucauguguuuguguauauauguguguguaguauguuagcuuccauacuacauggaaucauauaguauguguugggguauaggagucauccacaaaccacaugagcacucaucucaguuagauagggaugguuuauugaaugcacacacuaagacugaucaaucagggccguagcucaguauucaggggcugaggcugugaccucgaacauuuuucuaugucagcuuauaaaggcaaaccccacaaaaaucauaaugagcucauacaaaaacucaaggugugugugugggggggggggcguagggcagccaguccuuuuuucauguuuaacaguuuaagcugaccacuauuuugcuugauccugagggaaggcugcagcuggguucguuuccaaggugagcuuuucucaaaauacaauaauaaaucuuagcaugauauauggucauugaccuuuaauuugauggguccuaugugaagcuuauaguugcagaauuuaagauuaacaaaaauaacauacagaacauaacauaguaugugaccagcacgaaccugcucugaguuaaguuacuuuucugugucaaugacuggcaggccgauuacagcaacaguaugaaauagcuggugggcagaaacaaaaugguuacagcuaugcuacaggggacauguauguccuuuuuacaugaauuuuacacuggucuuaauuuugaaguucauuguauguuguaggucucugagugauacucuacuguuuggauguacuguaccuuagaaguuugugucuucacauguguguacaaaacuaggcccugggcuuagggucuugugcaugccaggcaaggucugaagcacuacauuguccccagaccuuuuuguuuuuuaaauguuuagauggauacuuuuuugguuuuuugaaacaggguuucucugugcaguccuggcuauccuggaacucacucuguagacaggcaggccucaaacucagaaauucgccugccucugccucccaagugcugggauuacaggcaugcaccaccacugcccggccuagauggauacuuuuuuugaaaauuguguuuacuuguauguguguaaaucacauuuacaauuaccaaaucuuccacacauacagagaccauuugugggaaucagcucuuuauuuuucuacugugugguaggauuugaucucagguggucagucuugguagcaagugccuuuaccuaucaagccaucuugaaggccuauuuguuuuauuuuaaaauuugagacagucucacuaaguuagccagucugguuuugaaccuucucuguagccuaagcaggccuugaccuuaaaagaucuuucugccucagcuuacugagauggucuuguagguacaucccucuaagccugguaaaaacguccaucuugauguguaguaugcuugaguugguuacaguggcugugaacauuuguaugguuguugggcuaagaaauaaccugcaccaugugcugggugugugguuaagcuuuugcuugaggcauguucagcauauaucccaggcugggcuugacguccucaucccccgccuuaaccuuucuagugcugggauuaaaaaccuugcaaggguuuauguuuuacuuuuuagaagauaauucaaauauaacauaggucaaacucugauguuaaacuuuuguuucaguuggguauuuuaaaugacucacauuaaauaucaccccccacccccaccccaaguccugauuacuagcccuccugugucagagccaguguuccagcagcucucucccaguugaaaugagugcuaagcagauggcugggguaaagcaugugugagaaucggcauucugauccuuagaaccaauucaaagcugaggccguagccugaguguguaauccccgugccaugugacaagaugggaagucaggacagaagaaucuuggagaccugugguuuagguagccugguauggaugcgcacacacacacacacacacacacacacacacacacacgagcacuuacauaaaguugaaaaauuugugauuauaauuuuuaugaaguauuuuguuuuguggcucauuaggaaguacaguagaccaguaacuuuugcugacaguaucuuuacaaaggucagccacugucugcugggauuaaaggcccaugccaccacuaaaccaccagcuaaaggaggcuuguuugcuuucuuccuuucuuccuuccuuccuuucuuucucucucucucucucucucucucucucucucucucucucucuuucuuucuuucuuucuuucuuauauguaaauacacuguugucuucagacacuccagaagagggagucagaucucguuacagaugguugugagccaccaugugguugcugggauuugaacuccggaccuuuggaagagcagucgggugcucuuacccacugagccaucucaccagccuggagguuugguuuuuauguuuguuuuuugagaucuuaauauuuuacuuuuauaauaauguaaaugccaucacuuuggagggauauaaugaaaccuauuacuaacuuaaaaauauuaauaaaauacuuuuuuugcuuuuuuuuuuuuugguauugugguguacuuuguaauuccagcacuuaagccuaaggcaggggggaugggaguuugaggcuauccugggcuguucauaggaagaucuugucuacaaagaaaugaaagugguuuuggacucuguaugaguagacacugacuuacaaaagauacuacuuugugcugggcagugguggcccaugccuuuaaucccagcacuugggaggcagaggcagguggauuucugaguuugaggccagccuggucugcagagugaguuccaggacagccagggcuacacagagaaacccugucucgaaaaauaaaaaaauaaaaaaauaaaggaaauaaaaagauacuacuuugugauauugcuauuuuuucuuguaagucacaaacaguuguguuuauauguguuucuuacauguguguugcuuaacaaauuaacagcuuauuaacaugagcugaacucuuagacuggauaacaagaaaagggcaaccugguuuuaaggcuguuuuuuguuuuuuuguuuuuuuguuuuuuuaggagacaagguuuuucuuuagagcccuggaggauguucugaaacuugcucuguagaccagaggucaaacucagagagauccaccugccucugccucccaaaugcuggggggggggguguuuuaaggcauguuccaccccuccacccccacccccagcaggauuuuagguuggagucagugauggaaccauugaguagacuuggucuccuuguucuggguccuggagcauuaaguuagcaaguguuuucucaggaagauuuaccucaagugugcugugaaaaccuuugcagacacaggccucuucaugcuuuugugaguucugagugaauagcagacuugaagaauugccugguuuuugagacagggucucaauauauagcacuggcaccugccuuuacuucccaagugcuucacugucuuguguucaugggagaguuauuguaucaaaccauauacuugagaaacauggcuauuuuguuuguaagcugguucuuaugcuuaucuuuaagcccagcagagcccagaaucucaggagccacauggggaaagcuucacagagugauaugauccauuugcucccgcuagguuuagggugcuaggugggcaguuugaguaaaugguucucuuuagaguguccuugcugagaagccuggaaguagucccaaaucugcauaaggcagggcaguuaccgggcacucugaggaaaacaggcugcugggugggugccacuggaaggugcaccauggcagcauagaacugguuuggaagugggauaguuggcuuuugucccaccuccugguuucuaaauuguaaauaauuuuuagaaugguauacaugaaauagguacccccaacauacugauauacguuucuucguucaguaucaaaaugccuuuaaaaaaaaacaacugugugcacacauaaggucagaggacagcuuugugaaguugauucuuuccauucaccuuuaugggcucuagggaucaaacucagguugucaggcuugcaaggcagguguguuuuagcugcucagcuaucuugcuggcccagaaaauuucucgucugugucauguuuuuaguauguaugcuuuuuaaguucuuggaguguucuuaguugugguacuuuuaauagaaacuggaccuagaguggacuuacuccugcuuccuuagaagcagcugggcugacgcugagcuccugaaaaugcaguuuagcuagacaaggcauugcaugucuuuaaucccgggaucugggagcugggcagauggaucuccgaguuccaggccugccagugcuacauagugaggucuugccucaaaaucaaccaacccaccaaacacacaaaaaagcugggcuuggugguuugcuccuuucuguccagcucucaggaggcagaggcaggaucucagugaguucaaggccagccuggucuacauaaguucuaggacggccagggcugcacagagagaccccgccucaauaguaaauaaguuuugucuaaauggugccaguauaauuuugaauuuaugauguuuguuaguauguugacuuuaguauagacauuuuauaaaagauugguuaauuuuaaaaacuaaagauuuagguaaacgauaagucuuuaacaaauauuguuagguuuguguccauaagagaacaauaguugugguauggguaagggauauuguauauggccuuacacugcuaaauguuuaggauccuuuggccaaucuuuuacaaauuauuuuaugcguguaaguguuuuugccugcauggaugcacguacagcagguugugcauagcuugugaccaaggaggucagaagagggcauuggaucucuggaacugaaguuacagaugguugugagccuauaugugugggugcugggaacugagcccucuguaggagccaucuuuucagggucccuauucccccuuccccccuugccagucuuuuauucuagaucuacaaauaaauuacuaaguuuucuugguaacagagcuuggaaaaucaaauuuugcaaaggaagaaauuaaauuuggguuuuauuuuuuucauuaauaaguggucuuuuuuuucuuuuucuuuuuuugcaugcccuuagguuuaaguagccuuagguucuuacaacuguaaauugauaacuagucagaucacuaauccaaaguaggggaauuuacucagaaaucauuccauagugcagacuuuggacacucuauauuaugaauuaaauuuauauuaaaguggaugaacauaggaaaaugugucauuuuaugacaagaguuuuagcuuuaaauuggugguaauacuguguugugccccccaguuucccuguguagccuuggcugucuuggaacucacuuuguagaacaggcuagccucaaguuccaccauccacaugucucugccucccuagugcaggaguuaaaugugugugcugccaccacccagcaguguaguguugcuuuauguguacuuaguguaguuuauuuauuuaucuauuuauuuagguuuuacgagagaggguuucucuguguagcccuggcuguccuggaacucacucuguagaccaggcuggccucaaacuuagagauccgccugccugccucugccucccaagugcugguauuaaaggcgugcagcaccacgcccggcuguaucuucugaaggagagaaacugcagguguaaaccuuccuucaccuuagcuauaucaaaguccguggaauggagcuuaacaccuuaauuuugguguguauuguugagacuguguugaaaguugaggcuguugucuguccuggcuuggaacucugugguucacacgaauuuauaguucucaggaaucuuccugccucggcugucugagugcuuggauuacaaaugugagcuaugcaggcugcugcugguuaugucuuuuuuuuuuuuuuuuaaagauuuauuuauuuuauguaugugaguacacugucacuaucuucagacacaccagaagagggcaucagauccuaucagacaguugugagccaccaugugauugcugggaauugaacucaggaccucuggaagagcagacggugcucuuacccacugagccaucucuccagcccaguuaugucuauucuuccucuugucauuuugggguaguauuucaccuuagcccagacugaccuggaacuugcucuguaugcuggcugaccuugacuuuauagccauucucucucuggccuuucaaaguacuagaauuuacagguucaaguucaacuguauuguuauuccuuagaggguuuauuuuuguaguuugauugauguauuugagauucagaaacugaaaaccuguuucuucuucauguugaggucucuaaugugccaggcggagcagggcugagagugauuuagugauagaauacuugccuggcguccuuaggauccucaguuugaaucuuagcacuguagacagaaacggguaucuacuuauuuauucuccuuauuuccuuauucccugugcuggggauugaacccaggccuuggugguaagcaaguguuccuccacaagcgguaccugguucuuccuccgugguuuuagaggccuggugggauaugcugacuuuuuugaaccaguuuauauuaauuuaaaggcaugagugcuguucuguucuucuuaaugggaaguagaauuacaaauucuccuuuuuugaaagggaaacuagugugugacuuauaugguuugaauaggggacuauuucaugccugauggaauuggacaaaaugcagucaguguuuuuacucugccaguuuggcgauuuauuuuuucaguguuuaaguguuugucagcgcugauggcgucugauuauaguuagugucaguuaauuaugcucaugugcuuaagcauguuuguauacuuggacuauaagagcacuauaaagcacacugauccuucuacaaggaagaguuuuugagugggaauuaauaauuacauccucaaggugaugcuguuugggccucggaacaggcuaaggcagugccagugcuuggguacauggcuuccgauuagugacgucagcucugguuguuuguuguugcuguuauuuuuccuccuuuuuugaaacggaauauuuuaugugaguauauacugucacucucuugaggcacaccagauaaaggcaucggaucccauuacagaugguugugagccaccaugugguugcuggaaaucuaacuugggaccucuggaagagcagucagugcucuuaacugcugagccaugucuccugccccucaaggaauuuuguuuuuguuuuuuuuuuuuguuugugugugugugcacgcgugcgugcgugcaugcuuaguauuuuucacaguauaauuuuucuuaaagauuuguuuauguauuugagcacacuguagcugccuucagacacaccagaagagggcaucagaucccauuacagaugguugcgagccaccacgugguugcugggaauugaacucgggaccauugaacagaggagccggugcuuuuaacuccugagccaucucucuagccccaagagguuuuuaaucagaguuuuaaaccaggaacagaauauaaguauauucuguauacuuuuuuuuuuuuuacuuauugauuuguguguauguguguguaaauuuuccaucauguacuccaaucucauucauucccaucccuccacagcugcccuauaaccuugcaacuucccuucccuaaauaaauaaauaaacaaauaaauaaauaaauaaauggaaaaccaucucacuauggaaggaagcugcugugugucccacaguacaccguucuguccagacagcuuuacuugcagauguuaacugcagugagucaaggccucuggcuucugcugcaccaucaauuuugcauccucacugggauucuucucagauauccucuuacccugucauggacacccugcaacuuugguuuuauaggaccugccccuucauguacuccuguaguugauaaaugaacuagauguuggggugggcgaacucagcgcuggaucugggccuggguaguaacugagucgggucagucccccagcucuccugugccauugccaccaaggccagcucacagcccacaacgggagggacuggcucuccuguaccagcaccccuccccaugagaagugaggccaauucacaggcacccauucccccggccagcuccucagcacugcccugccaacucacccaagugucacagcugccaggagacaggcaucgugcacuuccugccugggugaagggugggaccagcucucccuugcccacacuaccagggucauucuggagauauuuuuuguuaacuaguuuuaauucacuugcuaauuuuaguggugcuucaucuucauagaaaaucuuaaagugauuuuguuuuuuauuucgauucuuuuuuuuccccccuuaaacgauuacacuuguaguuuuagucaaaauucugauuuaaaauguagcugggaguuuuagucagaaauuauuaugaaauagcuagguagacccucaccuuuuuuguuguucagaugggguuucauuguuuuacccaggcuggccuugcacagcucauugccguuaauuuuccucagccuaaugagaaucuaagccuugauuuguauguaccauagcaucuagaucucuuuuucuuuuuuuuuuuuuuuguuuguuuguuuguuucuugguuuuuuuuuuucucuguaaagcccuggcuguccuggaacucacuuuguagaccaggcuggccucgaacucagaaauccuccugccucugccucccgagugcugggauuaaaggcgugcgccaccacgcccggcuuuagaucucuuuuucuugauuucagauuuuuuaauuggaauuauuccuuugagaaaacuuauuuaauaacuuugggcaucuuccuaucuaucuaucuaucuaucuaucuaucuaucuaucuaucuaucuaucuaugacagugucucccuauguaguuuuuccagcuaucuuggaacucguuauguagaccacacuggccuuagacuuggagaugucuaccugccugugccucuugugcaccagcaucaaaggcgcgccacuaugcccaaugcuugacaauguuuuuugcuauuuugggaauguuuuguuguuguuguuuuccuuccuaggaagcaagugguuuuauugcaugauugaauucuucauauaugcauuauugagcagauuauuuauuauugaauacaugaaacuguuggaauaguagcaggacauuaaagugugcucagcucuguuuguuuuuuuccuaaaaaguuguauucagcaucuugcagaguagaaaaggaacauuguagcaacaccuuacuaguuaugaacagcaugucagauucucuaauuugagacuaaaaacagcuuagaacucacucuuaaggacaccuguguuuuugugccuucugugggucagaaguguaaccaguggcuuauuggcucaguaacucugcugguguauuuuuagaccuuuguauuuaaaaauacaagcaccuggcugucacauaggugccuagugucaacugugugacauuuaggcucucuugcuggcuuuuugacccugugcuucaguuugcuguugugugcugugagcugugggccaccuuugaugaacagacauggcauuuuucuuuuuuuuucuuuuuuuuucuuuccuuucuguagccuaggaugucuugggaaguuuacuguguggacaccugucuuuguuuagaguagacugacuucaagcuaucugucugcaguaaccuccugagugcuggaauauaggcaccaccgugccuggcaaaguacuaacuucuaaaagaaaagcauaaaacgugaaagcacgauugauugguugguuuuucaagacgggcucccucuguaacccuguccauccuggaacacccucucuaaaccacagccuugaaaucagagagacccacuugccucugccucuagagugcugggauuagcaauauaugccccuacuccuaguuugaaaguacgauuucuuaaaacauuuuuuacauguuguuuuaaguuuugaaauucuccuuuguugcuguuauuuugagacugggucucuuguagccuaggcuggccuggaauuccuuauuguuacaguuagcuuugaauauuagauuuucuugcuucugucucccaagcacugagauaacuauggcugccaagccugcccuagaauucaaauuucuacugccugagugcuaggauuauagguguguaccagcauaccggguauaaacuacagcuuuuccagaucuguuuuuguacuucaaagaauucuuaguaaaacaaguaacuaaauucuauacuguugacucauucugucuucuuuuuuucuucuccuucuuuuuaaaagauuuuuccagagacacucuguguagcucuagcuguccugaaacucccaucuguagaccagggugaccuggaauucagagaucuaccuccagaguguugugauuaaaggugugcaccauugucaccuggcugcccuuucucucauuuuggccuuuauauaauaauaucucucucuguuuuguuuuauccucaguuuuaaagguguauggguguuuucccagcgugugugucugugcacgcagugccuacagagucgagaagaguguguuggagcuucuggaacuguugauaacaaguaguugugagcuagcuaccauuggguggcuggaaguuggaccccugguccaugucucugccccacccaguauuccugcagcagcauuguuuucagauguuauacuuuuuguacaccaaaaacuggaccacuuggguuuaagagcuaauaucaucccuguuauugccagauuuacgacaggaguuuguuuuuccuuuuugagacagguuucucacuauguagcugggcugauaugaaacucauuauguacacuaggcugccuuugaacacaaaagaugugucugucugccauccaggugcugggaucaaagguaugcgccucuauacccagcccaacugcuagccuuucuuacacuuuugucuguuagagcacacagugagcuaggaauucaggaagcaucuguuaaaucaauuaguauaaauaauauacuucugggauuccccaagucaaaucauuauuauucugaauuuuuggcauguauaagagaaauaguauggaagugggcaaauuuucaaaaaguaggacuucuuuuugccgggugugguggagcauguagaucucggccuggucuacagagcaaguuccaggacagccagggcuacagagaaacugucuccaaaaaacacaacaaaacagaaaccuaaaccaaaccaaaccaaaccaaaccaaaccaaaaaugaacaaaaccaaaaauauaggacuguuuuuaucuuagguuuuucuuugcaaauucacuuguuuuuuguuuuuuuuuuuuuccugguuuuucgagacaggguuucucuguguagcccuggcuguccuggaacucacucuguagaccaggcuggccucgaacucagaaauccgccugccucugccucccaagugcugggauuaaaggcgugcgucaccacgcccagcaucacuuguugguuuuuguuuuguuuguuuuuugaaacagggccucucuguaguccuggcuguccuggaacuuuuuauauuuaucaggcuaacuuugaacucagacaucuaccuucuucuguucuugggugcugggauuaaaggcaugagcuacauauguacaccacuccaucccauugcuguuuuaugcauagcauuugugacuuuacacaugugauaaguguguuugcauaugagcucccuugagucugacacuuuagccaaugguuucuguuuuaggauuuaauugcuagguauuuguuuugguauuggcaguuaaccugugguugaaugcaugcuaacugauaacauucucuccuccugagcuaugucccagccuguagguacagugcccuuccccaucucuguaugugugcaugugugcucaguuagagaaacacaguugugugccuaaggucauggauaauucccuucuguuuugaguuuuucuguguguuuuugucuggccaaaaacuagccuucaacuucugauccuccugucuuccaccuugcaagagcugggguuauauugguagaugucucaucaguuacucuucugggguuccauuacacacgucaccugaaauuaauaggaauggucauucauuauuugucuuuugugcuuuacuaacauuuauacugaggguacaaaaccgauggcaggggaaucuguauaccuuagugugcccagauuaccuuaguaguucucucugccagcaugugccgcagcggguuuagaagggcaguucugcugggccugguguacagauucgaggucacagcuucucaccaggggagacaggagggucucuguguguuccauuuggccuucagccugucucucccaucuaccacccacucagggugaagauagcccaaugcuagaacacuugguuaacaugcacaguaucuuagguuuaacuuugcuauugcuaaaaagaaaaaggcaggcacaacaaauucaaagagcucugugagguuuuucuuaaagacaaggcauccaguaucccaggcugccucaaacacaucuucugccuucacuucccuaaugcugugugauuaacagacagcaucaccggggcugguuuaugugguguugggaucuagacaaggaugguaccaacugagccacaucucaauuccuccgcaguguguguuguguuuaugugcaguguguguaugaauaugggcacguguuucacagcacauguauggaugcagaggacaacuuuugggaguccucugcuucugucauggguucgagagauuuagccagguugucaggcuugauggcaagcucuuucaucugcugagccaucucuccaaccauauaucucauuuuuauuuuuuuuuaagacaagguuccucacugagucuggaguucauuuaauuuaucaagucucugggaucuuccuguuucugccuccccagagcuaggauuacaacaagugugugcugcaaucuugcccauucuuaggugggucuucagggggaucuagcuaaagacucauucaugguuauuugguaauugcuuuuccaaugggacagucucugcaguccucccaagcguaaagagacgagacugguaguaaagggcauugguugcuuuuggagagggccuagauucuguucucagcacccacgugguggcucacaaccauccaaacucauaaacacguuccguuccggcaagaugcucaugcacauaaaauuaauaagucuauaaaaaauuuuaagugugaggaguccugagaacacaaaguuugagaacuaauacucuuacaaauaucuguugaaagagaaguugucaguuugugaggauguguugggcguacuuaauuguauccagcacagugccaggcagauuaguagguucuuuauaagauguaugaaucauaucgaacuuaauuauacagcaagucauaaaauacacauugagcccagaaggaaaauuggugugugaagauggcaagcgauuuuauguuaguaaacaaugucagguuuacaucauauuuucuaaauucuaagacauuuuuuuuccacaucucaacaucauugaaauugagaugucuuaaaauggguggugagucacuugaaugcagcucuuuucuuucuuggugugucauaacauaacgauguguuguacauguggugaaauaugguaguaacuugguguggggagagccauagaguugcaguuugguuccuaagacacagcuuaugcugcauuagauguucuugccaggcauugaguugacucugggcaguugguaauguuucuguuguuggagugguccacaaagacuagauaucagugcuagaauggaaauuuuaaaaauaaaucacaagagccaggcauccugacccacaccucuaaucugaguuaguacucugaagacuaaagaaggcaggggagggucaaaagucugaggguggccugggccaccagccaguucgaucuggauuauggagugagaugcugucuugaaacacuugaggccaugucuguaguucagugacagucaugcaagaaguccugagcuugauccuugaccuccacaaauaagcauagaagguaaaacuuguguaaaucuuguuuuuuauaugcaaagccauuugccuuuuguuuaguauuuauuuuccuacuugauaauggcuuugugucaucucuuccuuuuccugcugcuuucuuuuuuccuucuguuuuuugauagagaguuucacuguagccucugcugaccuugagcucucagaggucugccugucugccucaugcgugcuuggauuaaagguacauacuaaaugcuuauuuauaucauggguuugcucuguggcccaguuuggccuugaacuccugguccuccugcuucccuugagaaugcugggguuauaggugcgccuugaguaguguauuaguaacuuucucauuucuauaaguagaccuuaauuuacuuauggguugagggggacuguggccuauggggcagggaaggccuuguguguagguagagggcuccugucaaggcaggaguaugaguacgacaguugcuugcaguuaaggaaccaggaagcagagaaagaggcgccaauacagucccagcuguaacccucagguccuucucuccagggaccuccuuucucuagcuaggcuuuaccuaaaaguuuugcagcuuccccaaacugugcuacuaguuagggaucaaacaugagcuugugugcaccuuucuuucccuucuucaccuggucuuaguuauguaucuauuuaaagaugacuuugaucgggaggcugaaggagaaggaugagggaguaaaaggucaagccugggcuauagcaagacuucauuucagaacaaaugaaaccgggaagauaaaacaggcaccgugaccgcugccuguacacccugcuccucgggaggguugggacuggggugcguggguuucacuuugaacuuagagguuccacuuugggauacaguguauaguaacuucuuguccagucugggcuguacagugagucuguuucuuaaggggacgggugguaguggagagaugacuccauucgcuguacuugccgaguacccacauuccauucccagcacccauacgagacaguuuacaauggccuguaacuuaaccucaggggggucgggugcccuuuuuuggcuucugcaggcaccugcacacaugaguacaagacacaaauauuuuuuuuaaaagcaaaguuaaugcauuguuacuaauauuguuccugcuuuaugaucauaacaucugaauaaguagcauauguaguuugccauuuuauuuuuuacuuuguuucauuacuaaguagcucuugccgacauggaacuugcuguguagaucaggcuaccuugaacuugagauuugccugucugugucuucuaguauuggaauuagaagugugugccaccauugcccaguucuucaaugcacuuuaaccauaagcacagagcagggaccaagcuuuggaaauguucacaguugauucuuuguuguuucuuguaauagagucuuauacuguaaucuagugaaauuuauuuuguagcccaggcuggccuuaaacuuuggcacuccuagucucaauucccccaagugcuaggauuacagacaugagaccacaccagagaaugcuucccuaaagaagcugagugucauagugaaaagagucaaacaagaaagcauggaaggugguugguggauggauauaagucuguacguacuugagugcaggugcgucugaucaacuguggguuucuguugguagacaggcugaucugcugaucugggacuacuacucuggaaucuauagaauucacuucauacuucucuggugucucccaccagucaacgaaaggaggacccuuggaaaaaaauaaguaucuauggagguuugaaacuucaccauggguugucagggggcauccuuccacuuaaggaauaaaccuaaggcuuuggacaugacaggcaagcacuguaccacuggaaagauuaagccagugaugagaugcugugucccuuucguuucuagaaauggauccuggaauuagcuaaaguguugugaagggcuguuccugcaaugcuagccugagucagugcaucaccugcuuacccaagcauuuccacaguuuccuguuuaaggcaagcuuuuguccacuguaggacuaguauuacagguguaagauuaaggcaggacaguagucgcccuugucugaugggaugcaggcaaggcuaaaacaucuuuucccuguguccugggcagcaggcaaaucuguuacuguauauguuaggagugggaaacuugugguccuuaccuuguuucaguuuuguuuuucagggccaucugaaaaagcaggauggaugauucaguagaugagacaaagaccuggccaagauuuuuucaaauaauauauaaauacaagcaguaaauuucucuuuugucuuuguucuguagucuuguuuuuuuguuuuguuuuuaaagaacaacaggcauuaauuuggugugguggugcauaccuguaguuguagcacuugggaucuauagguuaaguaggauccaggguucaguugugaccagcccugucacugggaauccgagucuucugguagaacagccaggcucguaaccauugagccaucucuccaggaccaaauacuguauguauuauagaucuuuuaacuuuaauuuggcucauuauagaccaaguguuuguaaucuggaauucucaggauugcaaguguuuuggguucuggacauuucaaauguuuacguauucuagauaagguauuugggggaagaggcucaaguuuaaacacauuuuuguuuuauacacacuuuguacaaaguuugaagguaauuuuacauguguauuuuaguaguuuuuuuacaugaaacuuuuucuuucguucauucuuuuguuuguuugagagaggguuucucuacguagcccucagugucuuggaacucaccucuguagaccggccugccuuugaacucagagcgaucugucugccucugucucugggauuagugacguuuuccaccaucaugucauacuccuuuguaaucagauacuguuuagugcuucucuuucaggcucuuugcaaaguggucaugccaagaggagcagaaacauggcuccucuccauccuggauucuaggaagcuugaaucaggagggugaguuagauauuuuccugaagauuauuuauauauauggguguuugguuugcuucuacaucugcacaccagaugaacgcaucaggucccauggagcacaguuagagaugguugugagcugccacgggaugcugggaauuaacucaggaccucugaaagaacauucggugcucuuacccacuaagccaucucuccagucugacugugucagguacacagaggagagagacauaucucagcucacuuaggcaaaggaagcuguugggagauagcacucaaucuuggucauggaaggguuucuugaaggagcacuggaguugaaaagagagggcugaucagaagcauagacuguagacaucacaaaggacuaggacuuuaagugacuacuugggauuuguaauaccccgggaugagcacaaggggacagccuguagacauggagcuggaaaaugagugucaucuugcaagcacucagaggcaggauguaaaacaguaguguuuuguuuuauuuuugccuaaaauuguaguguuuaaaaauaagagccaugcucagugugguugggcaugcucauaggcucagcaccaagaaggcugaaguuaaaggugagugcagccugggccaacuagcauuagacucucuucaaacuaacuaauguuacggacagcccacuuuguuuuaagacagggucuuggucuguugcacacagugaccuggaacuggugauuacccuacuucagacucuguaaagguggaaauuauugauuggcauguguccuacaucuugcugaguuuuacauuuuaguuucaaacuuguaaguuucuccaucugcuuuuuaccuuuugaagcaguagggaugguuuuucuuuuaagcugaucucagguugguaauuggcuauccuagugugaaaauauuuauagccugguacaugguguguugagucucauccaggcuuuucuguuuuaaguggcucaacagcugaacgucacagguguucuuuguugucaaauaggauagguauaguuuuguguuagguugguaauucuuaagaauuuguauuuuuggaaagugccuuucaugaggcgauuuuaacuuuaaguaaucacuaugguucuuuuucuaaaauuuguauuauuuuauaguauggauguucugccugcacguaugucuguguaccacuugcaugccugcaaaagcccgaggagagcauuagauccacuggaacugaaguugcagccgguugugaaccacuguguggaugcugggagucaaacuucaucauccccuguagagcguucggugcuauuaaccacucagccaucucuccagcuucaacuguguuuuuaaauuugaucuuugucuuuuggcgacagggucugcagaccaggcugccuugaacucauuccacucccgcccuugccucuugagagcugggcugcaggugugcacuaccacacugggcuugguuugcuauguuuaauugaggagaauccuaugcauauagagucauuuuccuggaucuuaguuaguuuaaauuuuaacuauauuucuuaaauuagauacuuuccuucaugcuauuucuaaaauaaagcccuuuuauuaguguauauuuaaucugugaagaguuuucugagggaaccaugcuugaaauggaaagugcugaacaggaggaguguguaccacaccauaucccugccugggcuggcuucucaggaccauuagggacaugcagagccugucagccuuacucugucaccuucuccaacucagcuuguauacccuuaaagcacaaacguguaugcguacaguuugacaguuccuggcuagggcuggugcucucugauuuacuucugcauuuagcagauguuaauucguguuuacagguuggcacagaguggagcagcuggauagaaggugaccauucuaaaauaaacagaacagaacaauguaaucuugaguuuguagguagcgugugagaccgaacaaaugggaauccuguauaggugguuuggccaugaguugagguguuaagcaagugaacaggauggucuguguacuguguaaccgugaagccgcuuaccuacauugucagaaauggagucuauaguagaagagcgauuuucuuuuucuuaguuuuugaaaugaaguauggcuuguacaucugaagucaguguugcagccuggauagaguggcuccucuugguccuggauuuguugccuaguuuaaggguuuuugguuuuuuucuuuuucuuucuuuguuuuguuauuuuuguauauguuuguguuuucuucuuuuuuuuuuuucauuuuuuaaaauuucaguuagaagucagacauaggaaaauguuuuuaaagugagagacuguggcuggcagggugcccagugggugagggcuggcugcugugucugguucccugcauuugacucucaugacccacgugguaggggagaagaccuacucuacacacugcccacuggccucuggcgugugcucccacacaugggcccuuccaucagaguaaaugugacgaaaaguaagagaaaagagaacacaaaauuaccaaccacuuguacauagucuguuucaaauaacugaaaaauuuaggacaaaaauuggucaaacuguggaaacccaagugugucggcuucugugguggagaaagcuaaggucaagauuauucuccuguuucuucuugacuucuccuuacauugaguaucugcauggagaacugaaauguuuuugagcuacauaacccagccuggcuuuuaaacccauggcgguuuuccuaucucggcuucugaggugcuaggauuauaggaauaagucacucuauccagaugaauuucauaccuuuauuggaagauuaugccaguuauaaugcccauuaaaauuuuguuucuagaguccugaaacagauguaauuaucugcuuagggaaaccaacaauuacugucuugcuacuguuguggucaugggcguaagcaagcagcucuugaggguucauguccacuguugccucagucuucuuccuccugcuccugucugcgcgcucugagaccuuagagagggcuuuccaggguaaggguauugucugccugccugccugcaggcacuagcaguggaaugcauagauuaaagacuggagcacaucaagaacucuuccuuuaaccgaagggaggcaagccagugguuuuaguuuuaugaaauguguuucucucauuccuguaaagcuauaaaaguuacuuucacaaccucagggaaagacgcagcuuccccuaaagaccaugccuuguggugguggaggagguugguugucauuauccugaggcuuacaccaguggcaaaggcucugaaugccuccucuaagccaagccaugcucucaguagcauuacccacugacguggcuguguguccuaugccaagcaugcacuuguuuuuuuaguacucugcauggcuuccuugguccucaaaaugacuguaggagauaacuaaugcugucuuacagaggagaaacucaggcuuagguuaaguaaaauugcagacgcuggcagucagcuuaggcuuccuucgucuggagcuuugacucugaacuacuaaauucuguaucaucauacugguaacucugaccagguggcaggguguggccuacuaccaggggggcccagagauaaagguacuuucuuuuuuuuuuuuuuuuuuuuuuuuuugguuuuuugguuuuuugagacaggguuucucuguauagcucuggcuguccuggaacucuguagaccagguuagucuugaacucagaaguccucuugucucugccuuccaagugcugggauuaaaggcaugagccaccacugcccgccuuaaaguuacuuucauaaggcuccuguuaaaaccugggucagugagagcuugugcuuuuccacacuguaucaugugauaugaccucagaguauauugaugcaauaucugauugacaaggaucuuuucauuucuguaugggcuguccuguucucagaccugcuguuuaaaaguugaucugugagcuaguauuugcauuauaaacucauuuucuccuggcaguaggugucauaccuaguggaugcuuaauugauaacuucuuaagccagugacucaccuggguucuaagaucucaacugaguuccaaggaaaaaggaaagcaaguguguguuccuacuaguuugcaugguacacucuugcauguccuucuuucagauguuaucucaguguaaguauaaagucugggagugugugcaaaaacaggaccagccaagucagacuugauucuccgaccacucuccaggggucuggagguaaggcuuuuaauuuuaacuuaauuuguaaaauguauugguguccuuaugagacagcauuggggcuuagaugagacaaacaggccacagguguuuagaaugguagcugaauuauuggaaauaagggcaguggugggguagcuguggaugcuucauggaccaacacugauuuguaacaauaaaaaaauaaacaauaaaaaauuuauaaacaauaaacacuuaggcuuuuuuuauuuuauaaugaugcugauugacuuaaauacuguguuuuccaaucaguuauagggggugggcuguugaggcgugaucucucugaauagccuuggauguccuggaacucacuguguagacccagauggccuuaaacucagagauaugccugccucugccucucaagugcugagauuaaauauguguaccacugugcuuggccuuguguuucccaacuuugaaaguuugcacucuaaaacuucaauuuuauauggaaguauacuugguuuauauugaguaauuuuaaaaaauuauuuguggggucgguggugcgcgugccccuauagcaaaaggacagagaacaacauugugaaguugggucuuucucuccacccuuauggaauccagggcuugaaugaaugcagguagccacaggcaagcauuuauuccacagucuguacucuucuucaugcuccuguuguagcagccucacaguggaggacucucugugccuuguuugcuuccuuccagucuucugcuuuuugcuaccagggcaauacuguuuugggucugugucugugucugucugucugucucucuccucccucccucucucccucccugccucuuccugcuuuuaaagcuuugaauuuaugggcauugcaaagauuaaauauauaugccaccacacugggguucguuuucucucucuuguucucucucucucucucucucucucucucuucuccuuccuuccuuccuuucuuccuuccuuccuucccuccccucccuccucuccuuccccucccuuccccuuccccuuccccccucccuuucuuuccuugacaauucugcuauguaggccagauuaaccuagaaccuggugugauuccaggcuggugucaaacucacugaaacauucuugugucuugucuccucagagcugggguuagaggcuugcaccagcacaccuagcuuggagcuacucuuuauacaaggcuuaucuaucagcuucuccccagaauucauuuuccucccaaacaaagauaagcuugucuuccucuguacuggaaucagaggugagucagaugcuuuucugagggugccuagggaucuggucuucuuguuuccagacugagcaucuucccagcccuguauacccuacccuccuuuuugagacagggucucguguagcccagacugcucuugaagaugaccuugaacuccugcugccuucacuucccacauauugggauccaaggcaugccacuaccaagucaugcaagugccacaguuauuuuuguacgcagaucggucuuccccuuuucaagucauuugcccccugaccuuuucucccugugccauguauuacauagcucugaucuuucuuccuuugucuucccaucugaaagagaagggcuucauuugcauagagguuccagugauagagggaggcauuagugucucaguucagaacucugaguacauugguuuucuagcagagagagugaugugggugaggauuaauaucucagauugagaaagugcaugccagauacaugccagcgucaguuuacauugaccuuuguuacggggaauuauauucugaguucuaaagaagggacuucacuuuugaaauaaacuuguuggggaaggacugggggacucugaccucuguagcccacaccucaggagugcucuaauggagacuuugccugacugugggcuggaaagagggcaugcccugcccuccucaggaggcagcugagccagaggcaguccaguaguucuuuuguauuuggaaauacuccuugguuuggagacugggcuugugcagauacuuaagcgggugccuccaacaaacaaacgugauuauucuucagcgauuacgccguaaucugcauaacaagagaacuauuuuacuuuagaaauguugaagcuguuaaggcagaguugaucuuuucagagcaggguuccuacagaaaaccuucugacucuacuguggugcagcuggcgugaaaggcgaacgaacauuccuguaauaggcucuuguaauuuccuuuuaguuuuuguuuucgagacagguucuauguaguccuggcuauucuggaaccccauggguaaaccaggcuggcuuugaacuuagaaccaccugccgcugucuccccuaguauuggaauuaaagguaugugccaccaugcccagccuugcaauuuacuuuuaaugcagagaaaguaggaauuuuuggacauaaucaucucugguugguauucuagaaaaaugauacaacagcuggauugaaagacauaaagguuuucuucuuauucaaugacuuuuucucccuuucuuucuuuuuccaagacuggagucucucugcauuaucccacuggacuagaacucgcuauuuagaccaggcugcccuggacagagaucugucucuugaguacugggauuaaagacauauuaccacccuucuguaauucugagaacuauaaaauaaguuuuuacaucuuaggcuuaaaaaaauuuuuaaguauuuuauguguaaggguguuuugccuguguggguuugucuaagugucacuugagugccuagugcccugaaaggccagaaguuggcauuuguaucccuuaggacugaaguuagggauuguugugggcuacccuguggaugcuaggaauugaagcaggguccucuggaagaacaguuugugcuauguaccccugagccaucucuccagcccccaucucacaguguuuagacuaucaucuacugaugguaaaagaaugcucuggagcuagaagaaaauaucaaaggacauuuucauuuagugccgucuucauggcagacuuugugcaguaguaacacggacuguguguaaaugaugaccaccugcccuggagcaagcgaaaccgugguuuguagugguuucuaagguguaaauacuguacugaagcaagccugucuacauugugagaucuaucgggaagaaauggauauagucaucugauuuggauuaaccucaaaugauucuuuucuuccuuccccuuguguguauauuuguagacagacacacacacauaaacccccucccaaccucccacugugccacagugugcacgagguggucagaggacaacuuguggagucaguuccccuuuucuaccauguuggucccagguauugaacuugggucuuacauccugaccucucaugcuaacuauccuuuauuuuccuuaucucuuacauaaguauguaauuugaacuaagggcaagguaauuucuuuggccuuagaugaacaaaucucacaaaucugaaaguuaaaacuggaaaggcaguauuugucaguguggacaagugucuugugugucugugguagacauagcagggagucagaugccacagccagaggguuauuugagaaagagcuggcacagaagcugcguaaggugaucucauuaaucugcgcauguccagcacucuucuccucucgggggucuugguggccauggccccugccagcacuccuuccugauguuuccuuugaugcuaauaguucuuccuuuucuggcagacaccuguuccuugguauauaugaauacacuuagccuggccgcacuagagccuugcuauggaggaaagcccucucuuucuccuucagauggacgcucugucaguguuuucugguaggcuucuugugagugcuuuugugaguacaucugacuuuaucuagaaucuucuuucaaguuucaaaggguuagaacgauuccugacuuucucuuuacucugcucccagaaagugucccuuuccucacagacauuguguugguuucaaguuuagcacucagaagccaucuuacuucuuacacaagcaccguugggguacucagcaucagcaccugugaaaaacucccuuugccuccucagccuccugggcuaggaggagagugugcauacaaguaccuguuuuccuuagacacucacuuccugaucccacugucuagcaaaacuguucucaguauucauuuagucaguuuuucuuuaauucccauguagggcacucucuuccaugugccuagauuaaagaaugaaugaauuggauagguuucuugcccuuuaaaaccucaauuuuauugauggcaaaagagaauguaaacagaagaaaacaaaaaacaaaacaaaaacaaaaacaaaacaugcucauagggccgaguaggagguggacgugaggccugggcagaguggaauuggggagcuaagauacucuacaauaacaaaaacagaauaaauugacaguuuguuuggauggguacuuuaggugcccaggagggucuuugaggaaguggcauuuaaaaccuagcaccaagaauaagaagcagcagcuaucuguagaaacagggaagucaggcugaggcagaagagacagacgacacagccccugaggaggagggugcucgcuuguguuucaggaaagaggcaagggaaaauguggccucugugucagucccacuguggguuggaugagugaaucuagaugugauucguguagguuaagaucugauccaaauuaguaguguuagaauuugaaauucuaaauguaaguuuuugcauuugcuuuucugagauguuaguaaucaaaagugauugaaagcuauagcugucucaugugagauguguccuauaauuucaggaaaauggggaaggaauuaaggccuaauaaaacuucauguguugagguuguuccagucucagcagacccaguggucuguccuacccuccucgugccccagucuccuugacuucggaggugacagaccugagccauuuguguucugcuuucugcuuagacgucucagacacucaagccugcauacauacccuuuuguuccuaacagacaggaagcgggaaacccaggaguguagccagcuuuuccaggucgaaucuuccuaccauaucuacagccacucuuguguauguugcuagguuaguuucuccugauucacuacaugauuuuggguuguuuccccuugaauuauuuaaguaguauuccuuguggacaacuugagucuucauuuccugucuguaucucucaaugguucaaccuuauuuacuaucugugcauacuuaaaccucacacuuuuguuacuaacuagguuagcauccacagagcauagccacuuccauauuauaauuguaccaagcagccuguuucuugcuguguuauaaaucaccucuguugguccucuucacauggagcauccccuguuacuuguauggugccgaaaauagcucugcagccccuuguaucgcauugcauaucuaguuacaauguccuuucuugucacugcuccugauuuacaggguuuugugcucauuuauugaaaugauuugugauaaauuacuccuuuuuaaaauuuuguuuauuauuguggguaugaacagccacaagacaacuuuguggaguuaguuuucuccuugcauguuuauguagguuccagggauugaacucggacucugugcuuguguugcacgcacuauuaacugcuuacaccaucucaccaguccauguguuucuuuacuuguuuaagguugucuuucugugagcgaauggaugucauguguauuugggugcccucagaagagggaaucgaaucucuuggagcuggagguuaagguaggugugagguaggugugagccacaggacgugggugcugggaacugaacuuggauacucuggaagaguaauaguagcaagggcucaagaacucauguaggccaggaugaucuuguucucgcuguguagcuuuggacuucucccuuuccaguuucugcugccguaaugcugccauuguaggcacguguguaccaccaugucuagucucagggauuccgggcauugaaccugacugaguuuaggcuugcuacacaguauuguuaccaaccaagcuacuaucgccugucacagaaagguuucuuuucuuuugcuuauuuucacuguggacuuuagaaauaaagucaauguuauaguugaacuuuuucuuuccuuuuuuuuuccauccucaucauaaauauaaaucguauagcuucaaauauugauuuguuuguguaugugaccaguauguggcgaucagaggaaacuugacaagauucagcuugucguucuguaacacagguuccuggauugaacucaggucuuuaauuguuuugagacauaguguaaguuucccagguuggacuugaccucucuguaacuugaauccagaagccuuggccgcuagaguaccuggauaaugaaccugcacgaccagaccuggcuccagugaguucuaagcagacuuugauucaagaagaagcugcuguucuugacaucacguuagacuguuucuuaaaauaaacuuaugacaguaauuacuauuuccuccuaaaagucuuccaagagggcaguagaaacugggcucagcugaaugaaagcauacuaguuuguguuggaacauagacuccuuuauucaguagaucacaugaagaucacauuuaacacaccagcuaguauauuuauuuguacuuugcuuuccucaacuuaaauuuuggccgugaguggucuuggagcuaucgcuuuuuugugcguguugcuuuaaacaggucucaguguguacuguucucuggccccuucuaauuuugaugaaagcaacacugacuugcuguugaugucacuuaguuacugacgccugcucugccuggugcacauggaguaguaaagagaacagcaggugucagccgucuguguuguggaaaacaacuagcaggcauggcugacuugcauuugggucacaugaaucccgagauagcugugaacaugguccagaauguuuucagaugacaacagacauuacaacgucaaaaagguuggacagucugagaggguaugaagcuguacugucugugggcagauccucuggagaaguuauuccagccuguccauaagggccgcccgccuuagcuguaugcagauguguggucuucuuccuuuuguucucuggauuugcaaagauauuuaauguugaaaaaguuugucuuaagccaggcagugguggcacacaccuuuaauccuagcacuugggaggcagaggcaggaggauuucugaguuugaggccagccuggucuacaaagugaguucuaggacagccagggcuacacagagaaacccugucucgaaaaaaaccaaaaaaaaaaaaaaaaaaaaaaguuugucuuaagacauacuccuuuuuguuggauuauuggagucauacaagucaaguagggaauuagugaucucuggacauccacaccaaucaaucagcuugcuagucuaggagaggacaggaaggagggccagccacaguaaguugaagaccuuguuuguuuuuguuuuuguuuguuuguuuuccgagacaggguuucucuguguagcccuggcuguccugaacucacuauguagaucucagaaaucugccugccucugccucugccucugccucccaagugcugggaucaaaggcuugcgccaccacugcccaguggucuuuuucuagguagcucugugacuuaaagguauguuaaguguuccacggauagaugacagcauaucuaaggucuuucucuucaguuucugcauccauuguuguuaccauuuugauaauguucaucuguuggguggauaacaauacuuacuaaaauuauuaaaggaauuauuaauucuuuaauccagcacuuaauacucuuggccauacacuuuucaucuuacucauuacuuuguagauagaguauauauguuaccaugaaaaaugccaaagagaauauuucuuugacacugcuuucucgaaaugacucccaugugccuugaugacagcaucugaguagugcuuguaaacacuuggcugaacgcugucuucagggacugcguuggcauugcuaucugcacgucggggcccgcacaaagcuggacugccugcucucuuaagguugaugugguuuaacaggaaguaauggucaagguuaauuagugguggcauaccucuacucauucagaugggccaugggagaaucaugaguuugaggccagccagauuuacaaagggauacucuuacucuaaaaauauaaagagucacucacaaggaagcugggagaugguaggguuggguauggugaaccuguaacccuaguacuuagagcugacuuaggaagcuggacaguucaaggccagcaugggcuacauagugagcuccaugccgggcugugcguagaagacccuuuuaccggaaggaaaagagagggaauaaggauauuaauuagaaguuaggaaauagguguugaaauugagaauuuuuuuuuuaaaucuggagugguaauuuauacuuuaacugagauacuuggaaaguucagggucuuccuuggcugccuaacgaguuugaucugaccuggggcacaugaaaccuguuuccaagaaaauuaguacaaaauaauaauaaugcuaaaagugaaaugggcuggaugugguaguucaugcuuuuuaucccagcacuugggaggcagaggccgcagaucucaaggccagccuggucuuauagcaagcuccagaccagccagggcgacacgguaagacccugacucucagugaaauggccuuuuagcaacauuggagcuucuuagugucuguguucucuuuagucaacugcagagucuauaaaucugccaguucugcagucauuauauucguugagguuuugcaugucccacucuugcuuuuagugucuggccuuguccucgcccuguucugcacacagcucggugucuggcaggaacuuugcauggagauucugggccugcuugcuacaucugcucccuggaggcccucugucugcucguucuugcccaggcuuuccuuacuuuguagcaucucccucaucuagcaucaaaauuaugcuguguuuuguuuuauuacuuuaauuuuuacugcucuguuuuuaugggucuagauuucagccucacuguguaccugaagaugaccuuacacuccauuccuucacaccugcaucccugaaaugcugggauuauagguguaccuaccacuucugucucaaaccuucacuuuuguuuguuccuaccucuucguguccaaauaacauuguuuuuaagauacuguggccucagacuguaggucuucaaagacugaaaggucucaggaauuaaacucaaggccaucaggguggaauuaaacucagguggccaucagguaccauuaccugaaaagccauccugcuggccuuagaagaauucugacuccaaauuuuaauuguuuuugcuuuuccuauuuuuguuuguuuguguuuuaguguuuggucuuugaaacaagauuucacacuuuagcuaaggcuugucuucuaaaacucacauuuagcccauguuagccucaaacucuugucaauucuccugccuugccuucuugagagcaaggauuauaggcgugggucaccaugccuggacugugcuuucuacuuagcaugucuuauguuccuguacuacacuucuggcuuucuuguagacagacacuguuuaagagucauuuuguuuggcauauggugcuuauguagaagauuaguauuuuaguagaauuuuauuaguauauuuauuaguauucugguaggauuuuaguaaacaaauucugauagaacugugaucuuacaccuuuaaucccagcacucgggaggcagaggcagguggauuucugaguucgaggccagccuggucuacagaguuccaggacagccagggcuacacagagaaacccugucucgaaaaacaaaacaaaacaccagacacauuaucuauucauuuguugauugcacuguagugcuuccuuccagauucagagaaacaugauuugcucuaguucuuucuuuacauuggggauuucaucacuccacagcuuuucugugugccagugccuccuuuccccucccuuuuuuuggggguggggugggguuggguuuuuugguuuuuuuguuguugcuguuauuggugguggugguuuuuuuuugguauauauauucccccauaguacaucuuaaauacuaaauaucuccauaaaaaguuguauacaagcauuacugcgugugguaauuuucauauuuauaaacagguaguugagaacugcuuggcuuuuugcagcuuuccuuugugguccuuuggaaacagccuggucucaguauggaaagaagcagccaugaaucuugagccucuaaacaaaagcacauucuuacccugugcauccuugggacacagcucuuagggccacuugcuuguuagagcauuaucagcaagcuaaggacccagugauauuuuugcaucguaagcccuugaccugguaaugucauucuuaauggaauaggcuuaguccuuuucucccuugcuggaaaaguucugaacuauauaaaaaucacuuaaaauccugauagacacauuuugccaagaaugucaguugucucuugucaguuuggcauucaccuuuaaauauuauauuguguaaccauaaugccauucggggaaauaagguaguggguggcugguauuuuaaaagugaaacggacuugaguucuuagugcuaaucauuguucuggugaaaacagaauccuuaaggugaaaugcuaagaaggugaaaucuaggaaggauggagggcuugcucaguguuguguuuguccuugaacuaaauuugaauccuuuucuucucugauuuagugucuguaaaguuccaccacaguauaaauuuagcaguuucuuacuauaaacuuguacuuuuuauacuuuuaauuccauuggucuuuggauucucauacaaaauggacucugcugagguuucagcauguaauuagagaccuguuggaucuggcaugugaguuauacuaaaagcagaggaacauugaucuaaucuuguuuuaacaugauuuaggaaagagaaucuuugucaaguagaugcaggcagauuaaaugguaaacgucauaaugaaaaugguuugcuguuuuauugcagccuuuugacuuaggacagaaaagaugccuuuaguugacacccacaaguauaagucacaguuguaaauauuuaagauucccucuucggcagggaagcugcggugcugggcauggagccagcccuugcuacaugcuuuaucauagccccagcuccucugguguaguguauuguguuguguuaagauuguuccuggccuuugaauguuacacacuacagguaggagcuuuggugaacauagcuguaaauaccuguuggcauguauuuaggagggacucuuaacuacguaggguguguaugugugcagauggaggccaucaguuuucuuucucuagauacauggguguuuuggccugaacguauguguguagugcccccagaggcuggaaggcagggucagauccccuggaacuggaguuacaggucuuacuauguaacccugacuguagaacacccuagcuuugaaacgccugccucugccuccuguguaugccaccaugccuggccuaccuugguuuuuugagguggggauucuaaaacuuacuugguacgcugguugaccguagaguacuugggaucugccugccugucuuugcuucuaugguguuuguugggauuacagcuucauagcaucaugccuagcuuuucauguagguucugggaucugacacagauccgcaugcuuguacagcaagcgcuguacaaguuaccuagugagacgucuccccagcccugaguuguaggacugugaaagaugccucaagaggucucaaagcuacgcagguguuuggggagaaccagaaguguugccaauucgacucuaaccacggaguucugauccacaccuaaaccugaagacccagcuauagggcaaaagacugagugaaaaccagugccauagcuuugcuccauuucccucuuuaaacucgacacaggucccaggaagugauauuuucccaguuuguagggagaacaagcacccgagcguaaguucuuaucgcugaccucuccgaagccaaagcuuagccacauucuuuucauaagggguauaaacuguuaaacuacuguagaucuguauaacacugacagacuggcgugucuuggauacuagcuguaguucuuucaugagcuguguaauuuccuuuaccuuacaccucagcauugaaagcaaacaugagguuacaauccuaggaggacucaaugaauucguugucaaguuuuacggaccacaaggaaguaaguacgcauguggguaugugugcuuuuuacuaucuuuacuagacuguagagcuaucaacaggcgcugcauggcuuugggaaguaaguuuuaacuaacugcuagaaccaucgagugaagagaccuuugucagucacgcacuuagcuuucucacaaguccuggguucuguuaugcuugguugcauaaguguuucuugggaagcguauuuccuuguguuuuuguuugggggauuggcuggggaagcaggaaagggaacaugacuaucucucuccaaacaaagagcagugcucaguaggauggaguaagaaagagugaugauuggcucaacuccggauauuuuaaaggaaaauaaaauagaugguguuuuuuuuuucugguacuggugaugaccucaggcuuugugcaugcuagguagugcucugcugcugcuccaccuucccuccucguccucccaucccccgcccccucucuuuuuaagauuuaaaaaaauuuuaaauguaugaguauuuugcaaauguguauggauguauaccaugugugugccugauguccuuuagagguaagaagaggggucagauccucugggauuggaguuacaguugcugcgagcugcaauguggguacugaaaguuuaaucugguuccucugcaagagcaacaagcguuaacuacugagucaucauucaguccccuuaaucaggugcagggucucaguagguguucaagcuggcuuuacccuaguucaggggcccucgaaccuuggguccucaugccccagucuccuaaauaagagauucuaaucagaacaagauaauugucauagaacagcucuguuccuguuagaugcaguguaaagaaaagcacaugaaucugagacacaguaccuacucugcuggucguaguuggccuggagugguuuuucccuuuguagcccaggcuagccuggaauccacagcaauccuccuuccuuaucuuccuaagugcuaggaccacagugaaaguccccuagcucagcugguuccuggcucuuuuggaauugauuugagguccuuuucaggagagagagggauuaauguucuuggguuuauuuauugauuuggagauacaguucuaauggauaacauauuuuauuucuguuacagcaccauaugaaggcgggguguggaaagugagaguggaccuuccugauaaauacccuuucaagucuccaucuauagguaugugaugagaguucugaaaucuaagaggaaaauaaaagucagauauuuuaugagagaugauuguccagaaauuuuuccuaaauugaauuuuuccuuucuuugacuuaaaaaaaaaaagacuucuauggaugcuuugucugucuguauaagucuacacugcacaggggcgugggauuucaugggucuacaguugugagcuguuuuucccaucuucagaacugauuccgagguuccugcaguuuagacuaaccccuacucuagcaaaacagacugaaacauccugaaguuugcuuuaauuccagccuuccacauuuuggucuagugcagguagugacaugguguguuaagggugaucccagaacuaaguccuaucagaagcugcagccuguaccaguaucaaaccacuuuacuuccuguagaguuugguuuuuuuguuuguuuguuuuuuugagacagguuuguagcccuggcuguccuggaacucacucuauagacuaggcuggccucgaacucagagauccuccugccucugccucccgagugcugggauuaaaggugugcaccaccacugcccugcuuccuguagaguuuuauguccuaaaaccacuaaagaacauguguaauucuuugacauggggaauucuuaaggcuguucuuuccuucagguccugagguagguuuucuaaaccugcagcugcccaggagaaauuacuucauugccauaagauucugcaagcuguagagccagggaugguggcagcuagcugugagggguugagucugacacaguucauaagcacauugaccuuagaccgauguggcugggauuggagccuucccacagcugccuuccauggugccagaaagaagagcucucucuucacagggcucaucugugcuuuucuacgccugguuuauuccugugccucuuaacuucagugucucuaaugacacacuucaaauauaaacauucacguauguaucagacacaccuagcuaaagucagaaaguuggcauuccaaguguggucuguuaccuuacacugcuguuuaacagcagacagcagggcuuguggaagccaagagucagcuguggggacgcagccugugcuagagaaguagagcugcuucucaagcucuaaccccgucccagccaagggugccucucacugagcuuucugagauguagccuagaagaccguuuuccacuccauugcugggaucacacauggagcccggcuuauccaggcaggcucccucaccacugagcugcugcgugcaccccuucccuaaaaccuaaaccuaaaauacugcuugucucuaacagagacacacacucccaaggucauuuaacggaaguucuauuuugacuuucuguacauucucagaacuugaugcucuacguaggagcagcauccucuuagggaaguugauguagcucaugcauaccagcuguucuuuccuucagaggaggguggcgucaguuggaaucgcuuugugacaugagccguuuucaguuccucagcagugcaguacuauuaggaugcacuuuaggcauuuugggaggcaguagcucauuuuagaagggcaagguuuauuuuuugaguuguguagacauggaauuaaacaaaggggaagaaaauuagaucaucuuggcucuuuuucccacagugucaggcauguacacuguuguugaguuuaaugagcguacagauacuaaacuguggaauugggagaucguagcuugguggcagagggcucgccuagaaugcaugaggcccugagaccagccccuagcacuuuaagucgaugaacauaaguuuagauuaaauauuucuauucucauucucugugcccccauccccuccccccuucucgacccagcuaguacuucuguuugcccuugccucagccuccugaucuuggguguaugccaucacccccagcuuggaucuuaaaaauaauaguauggaauugguaugugugagaguuauuguuugaguauguuguagauguggcauguguauacguguuuguguguggaggccagauaucacacucaggugguguucuuaggaacuaucuacuugaucuuugagacagagucucauauuuggucuagauugcuuggccagugagcuccagagaucagccugugucugccuuccaguucagagguuuaagacaucugcaccuugcauaacagugcugguguauuuuucauagauguuaacuuguugugcauguuagcaguccugcugguuguuaauuaccauauauagcaauagauaguuaggcauccgugaguaacaaguuaucacugguuaucaagaagauaaccaguucuggauuugauuuuaauuuuccauaaaaugauauucauccuaccuguuguugccuuucuggaaaauaagacacuggccaggagcuauggugcucaucuguuuaguugcagcuacucaguaggaagauugcuugaguuuagggccauuggacaaacuauugacucuaucucuuuaaaaaauagaaaggaauucggaccuggugguucaugccucuguaguaccaguaaucagguaguugaggcaggaggauugcuuggagccaggaguuguaaaucagccuugcaacauagcaagacauuaccucagucauauauguguauuuuuuaacaggcuuaguggugcauaccuguaguaucagcacuugagcagguaagggcaggaggaucaggagucaacgcuggccagccugaauuacagagggcccuaauaggauuaagugaaucauguguuuguuaacuguugaugaaauacucaaacauguauggccuugacaguaggaagguuaguaagcacagauggacauaaauugugagacagugccucuguguagcagaguguguaaagaccaguuuuuuguuuuuuaaaguguuaccuuuacaagcuuuggagaugugaggauacaaauggaaacaugagaacuauuugaauucucugugcuguuuuaaucugagcaguugcuccaugcguucuaaugcccacugcuccagauuccauaugcuuagcuguuaggagcaagaaacaccugcaguagcugcgccaccauugagcacauguguaaaggggcaguacugugcgcucaaaccaaaugguaguuuauauauaagccagauaauauauguauaaaguagauagaaugcuguguguguguccugagcagaguagcacagcacuccagaaacaagaggccagccagaaguacauccguagacccuauaaccaaacaacaaauguuuuauguguagcaaaaagaguaaaaauuuaaaauagugaacagugugguugagcuacagugugugcuuaaaaguuuguagccagcuuaguaguauauauauugcuugguaaagaucuuauauccuuaaaaaaaauuuuuuuuaauuucaaaauuuuaaaaaaccauguguguguguguguguguguguguguguguguauguguguagauggcuuaacaguuaagagcacuggcugcuuuuccagaggacccagauuuaauuucuagcacccacauagcagcucucaacugucuguaacuguaggccaaacacuaaaacauuuguaaaaaagccaaaccagacaugguggcacacacuuguagucccagcgccugucagcagaagcagagggaucaggaguuuaagguacaccuugacuguauggugaacuguauuucauuagauuaugcugucaacuaaguaggacaguuuaaguugucuaacuagucaaaaucccuuuuaaauuuccuagucugauucauuuuuaauuggaagcuacucugguaaucugugugccagauuuuuaugcuugugccagagagugagaagacagugcauuucaguguuuaauucacugauguuaccucacgggggauugagucuuacagcacaguaugacuagcuguaggcggaugcucaguucuauuucacauguucuagacagaaacagucuauagucacucccccgggacuagugcccaucacugaggugaacacugaaguuugaagauagggaagugugugucagucgagacauguuacuuaacaaaggcuuacuugugccaccacaguauuuacacaaauaagugaacuuuugagcuaaagaagcaaaauuccauuuagaucaguuauguccuucuagacuuucgugaccuuagauuugaauuaaauuucuauaucaaauaacugcguuuugaauuugaguagagaaguguaguaagaaaauuuuaaggagcauuuuaaagcuguuaugagaaugcaguuggaaauguucccuuguuacaggugcucugaaaaugaaccgucucagugugcauuaaaauauguguggcagcucauuucaugaaguccaucagaucccugcucuccugaagugcuuucuuucacucaagugcuaggaauacagaaaugagcacaaugugcuccuggcaaaauuuaaaauaaccgauuucuuuaugcaaagaacugauguuaugagauaguuacauuggaucagauauuuaaaaauuaauucuaagccucucuaaccaaguaugucagucagggaaaaguguauggggcacauauaggcaggguuggucagagagcauugugcagguaaggcuuauagcccauaauucaucuuaaauauaauggaaagaucauuuaaagguuggauuuggaguguccaggaugacccuucuguugagaagaaagagcucuggguaaaagcuuuuauuccaucugugagaaagauccuguguggacaaggaugcugaaggucagauacauguagucguagcucaggagguggagucaguaggaucagauuccaaggccaucauccucagcugccuagugaguugaaggccaguuuggguuguaugaaacugucucacaaagcuaaaacaaaguccaucaaaagagaggauuuggccaucauuuuauuuugguuugguuuugagacagggccuugaacucaaagagaacaccuucuucuacuuugcaaaugacuagagguauaggauuaaagguauuaagauuaaagauacuccacacucuuagcuguaaaauagaucucauuauguaucgcuagcuauccugaaacuugaucuggccuugaauuaagaaaucugccuacuucucucuccugagugcugggauuaaagacagggucccaucagugcagccuguugggugguuuuuuguuuuuugguccccccccccgccccccccccgcccccaagacaguguuucucugucucgcuguccuggaacucacucuguagaccagacuggccucgaacucagaaauccgccugccucugccucccgagugcugggauuaaaggcgugcgccaccauguccuuguuuuuuuuuuuuuaaaugggauauucugaaagguuuuugacuuguucucuugagggauuuguuuaggaaagaaaaacuuaguauaguagggucaaguaggagcuaugccuuuaagaaaugaaggggauaaaagaaaggagaagaguaugcacuauagauguuagaaauuuuauauauaagaccaggguguugggcuggcgagauggcucagugguuaagagcgcugacugcucuuccaaaagucccgaguucaaaucccagcaaccacaugguggcucacaacuauccauaacgaaaucuaaugcccucuucuggagugucugaagacagcuacacuguacuuauauauaauaaauaaauaaaucuuaaaaaaaaaaaaaaagaccaggguguuaacugaagauguuagaaauaauauauagggccaggcagugguggcagaugcuuuuaaucccaguacuuaggagguaaggcagguggaucacugaauuagaggacagcuuggucuauaaagcaaguuccaggacagaaacugugugucuaaaaaguaaaacacagaacaugagaaggucugcugauuacacaccugcuccacaauugaguggagagaagagaguggaugauuugcaggaugggauaaaucaguaagaaaggccacuggagaacagugagccgcugcagagagaagaagaguuuaaguggcugaggguccacacagaguuguugagcacauugugacaaguugcuauauuucuuaaaaaauaaaacucaggggcuggagagauggcucagcaguuaagaacacugacugcucuuccagagguccugaguucaauucccagcaaccacaugguggcucacauccaucuguaauggaaucugaugcucucuucuggugugucugaagacagcuauaguauauucacauccauaaaauaaaucuuaaaaaaauaaaauaaaacucaauaaauagacaaacucuacaaaggcucuguuuugcuaacaacccucaugcccagcaaauacucagggucuguugcuuugaaaaauauuagaaagaacauauuucuucuuagugucacccuaauuuccaaguacaauuuacccucuuaaguccaaggauucuguauccacuaauuaaagcucacuuauguaucaaaaccagucuaaaagcuauuucaucaauuugaaaugugugcagcauucccugaauuauaauagugcaacuaaccacagcaugugcauugaaucacuuauaguagucagagguaguggaagaugcgucagucauagacugugucccugaagaaagugagccugugugggugucaagucaggagugacaguggugcuggaacagcuccaucaagggcaugcagagggauaccugauagauacucucugugggaaggaaggaaggaaggaagggagggagggaggggggggagggagggagggagggagggcauuugcagaggcaggcuacagagugauauucguguuagcgcuucugucugaaguugaauaaagccuggcagguaggaagaggaggaauuuuagaagauccuugguaaggacaagagacugguaggaaaggagaugucuggauuugugacuggagaggcauagcuguuuguagacaugacuguucuugguguguccugggcauauagaguggaaugagauggggaacagucauugaggagaggaacauaaaaaggcugagagguuaggaauauggucuuugugauaaugaauaugaguggggcagagagagaacugaguaccaaguuaccacagagaaaagccauuuauuaaugaaccugcugucagggacccaugucaugaacuccucuccccacuaccuuuucuccccuccuccacauugacccugccuugugugcugcugaauagaggacuuagccauuuccuucuugaagcucccuuaauaauaucaguuuaaauucugacccgaacagugccuuuuuucacguuuuuuaaaaaaagauguuuuuguuuaugcauaauagguauuauaacuuuucauacauauauguauauuucuacuguaucaucuauuaccccaaccccacuccuccuaauucccuuucucccuucccauucccagcuaacuguccuuuccuuucaugucuguguguauaugugugugugugugugugucuuuguguguaugucugagagagaggcccagugaauuucauuaaggagcuuagacaccuuucuaguagcuauaccacugaagacugcgucucuaucccuugccucuuuuuuuaagauuuauguauuuauuuuauauaugugaauacacugucacugucuuuagacagaugagaagaggucaucagaucgcacuauagauggcugugagccacuaugugauugcugggaauugaacucaggaauucucuggaagaguaguccucuuaaccacugagccaccucuucagcaugucucuaucccauauugacuguuagcuuugugugaaucuucagagagaguagugcuccguggaccccucucuauuacaagacagugcugaggggccagucuuguagugaacuuaggcagucagcucaggagugcgauagccaugccacauguuguucccucacacucacugcuuugcucugccucucacagccuuucugccugccccuucugcuuuguuuccugagcuuuggaggagugguauaaauaucccguguuaugagucacucugaccacugcagaaagaaccuucuuguaauaagucuaacagcagcacuaaucuaugggcacagacauaguaauuuagaaggcaaucugacaggcauauccuggcuacuuagcaaacaguggcaguagcuucuuccuaugaccuaugauuuuucucggccaaagaauuuuggauguguuuccaguaccugccaugaguuccuucuauggagcagacauggaauucagucagaaaggaguugguuacuccauaacagacuugccacuccugcugcaguaggcucaucuugccuggugagucauuauugcagaguccacaccugaguaacagccacugcugacaguucuccacaguagccuguauaacaacauaguaccuuuggagccuugggggcaagccacagcagguaggaagcuucuagccaguucuagcuagaccaucuaguucuggugggcaaacaagaauaguggucauugcuguauuguuuugaaagccccgggagaagccucugugaccacuaggaaaguagucuacucuuggcacuggguucuccuuuaauaauguauggcuucuggacaguucuugccuuggaacugggguuacauucaagugcgcauugcccaaugugaguguaaggagucaaauuugggccuugcggagaaacagcaaaggcuuuuaacacugaaccgucucccaaucaguuccuuuuuucuuugaacugaguuuaaaggaaaaaaaaaauuaugccaggcuggguuugguggcacacaucuuuggucccagcauuugggaggcagaugcgggagggucuuuaugaguuccaggccagccuuaucuacaacucaaguuucacaacagccaaggcuacacagaaagacccuguuucaaaaaaaacaaacaaaaaauaccccacaaacaguuauguuuuaguuuccuuugaaaagcauaaucacaccacuuaagauuuguauauauuuuggguguuguuaaaaacccuguuguuggcagccacuuuagacaugcauccauuugauugccucaagaugugucgccauauugguugccaaaucugcaauguuugcuuccauccuggagggguuuuucugauuguuuuguuaugaccauaccaaauuguauuagaaugcugcgcaacaacuguuggaguauuauaaauucuauuuucacuugagaauauaugaaagauaguaucaacaucaaaauacccccuugccaguuccuaaaauaaguuguuauggggcauggagugaugguucaguggguaugacuguguucuugccaaagacuagaguuuggaaccucauacccauguuggacagcucacaacugcuuguaucuguaacaucagggcaugccaaaaagccuacuugggcauccaugaguauauacauacauaaaaacaaaauaauaaaaucuuuuuaagagugauaguugugugugcuggagaguuucauuucuagguugugaacaauagcaugaaguuacuuagugggguaugauagggcauacauauaaccccagcccuucagagggcagggcaagaggguuuuaaguuugaggcuagcuuggucuucauacugagaccuuaucucaaaaaacaaagagauuacgagagggagguaauuugcuuaagcuccuuguacugaaacccauucuuuuuccuguuguguugggccuuugcacuaucuccuggcuucugggaccaaguacacaauaccauuccuaguggccaaagcuagcauuacugagugcuaauaguaugcuaguuacuuaacucauuuccuguuucugacccuucuccgauguguuggugacauuuuuuuuuuaauuuuuuuuuugguuuuucgagacaggguuucucuguguagcccuggcuguccuggaacucacuuuguagaccaggcuggccucaaacugagaaauccgccuaccucugccuccugagugcugggauuaaaggcgugcgccaccacgccugccuuggugaaguuauuuaaucuagucuuaggaauagcaguagaaagacaaagaaauugacuuguuaaggcucacugcguugagcaaucugacuuuuaaguaacagcuuaauuaaugacuuuguuaaaauugcuagagccagaugugguagugcagaccuucagaaccccagcguucagggccaucagcaagcagaucucuucuaagauugaggugcuauccuggucuacauagcaagcucuaggccagccagaacaguacagugugagugagaccugucuucaaaaaaggugggagcaaguuagaaaccugcaauucucuacugucuuccugcuguucagaaaauccuuccagaucucuuaguguggcuagaugaaugaccaagacacuaaaggauaaauuguggagaugggaaugaaauacuagggagugggcuaaaggcuuugguaaccugcuaguuugauagaagaauccugcuguugaaggacaaccaucaucguuuuuuacuuagaaauguauguuucuuacccacucagcccauuccucagauucuuuucuuagaaacuuagaaaagcuucucugaugaguuuagaucucaugaacucauagggucaguucagaacuuuccguggcacaggguuuugagagugagcucuuccuugcuuggguccucacuugaagagagacaggccaggucugucuccugagggggucccagucggaagagccuucuguucuggugcagucugucugagauggugugcuagugcacacagcugaaagguggcugucacccuucgucagcuggguaacucuaacucugguugcccgagugucaggaacaaagacagaagcuaggacucaauccugaauucagccagugguugcuugggagccagaagcaacuggcucucuuaaguucgaggccagccgggucuucgaagugaguuccaggauagcuagugcuacauagcauagagaaacuuugucuugagaacuguguguguguguguguguguguguguguguguguguguguguguguguguguguguuucugagauacuacuucaaggaaagauagcauucagucugguuuuguauguagguuuuucuuuugguccugggaauugaacucagggcucuauacuaaauaagcauaagcucuaccaccaagcuguauucucagccccugaauauauuuuuaaaacuauuuuaaaaaaacaaaugcuuggcuuugaaucaucuacuuucugagaagguuugugugggcauauguguccuaacaaauaccaaaaaugacaauguuuuuacuugcuuuuucucaggaauucauacacuacaguuaaauaccaucagccauagcaaaccucagccacuucaguccuggcucuuucuaucccuuggcauuuccccuacugccuuauuuccuuagcuccaaccucucauugcaucaagauaaaccugucaaauuuccagauagggaauugaccccaaaauauuucuuuacccacagaucugaucauuaguaugucugcuagcaaguaaaauguuaagccauauagauuaaaaaaauauauguucagagaauggaaucguauccuugugugcgugagauccuggauucagucucccucaugcuccugccccccaugucugucucugggacuugcugcuucuaguuacuuaccauauucccauaaaggcuguuuucaaaauauguccucuuaaaauaucuucauaauaguuucugguggaauggaaacaggcauuggggaaauugucuugcugcagacacauucauuagugugaucacagcauugccaaaaggaagaagaccgugccagggcaaacaugcccaguccugagaauguuccuucucugaauuccugguuuguucuuucccagucuucucccuuccucguccagaaguuucauuguuggcauccuuguccagaauaaggggcuguaccagaaacugcacagacuguacaagagcagauguaaggaaacaggguuccuuuucacugauuggcuuuggguucuuguuuuaacaauuugagcuauggaucguggcauaugccuguaaucuauguaccuaggaagcaggagaaucauugcaaggcacguuccagcucagucagggcuacaaagaucaugucugaaaaacacauucauagucgcagucuccucuuccuuaacagccugcuaauaaccucccaauguagucugggggcuggaggggagggaugcagauggaguuggagacuaggagagguaugacuaaaauauaugcauguauggaauuguauaaaaaguauauguauuuucuuuuaaauaaaagccugcaccaggaagaacuuucuguggccugggaagguuucucauauaguguuggucuaauaguaccugguccuugaaggugaaggugucagcuaauacugcccacuuuggaacagucaguggguguugugacucugguggugauacacacgguacuuacuuauauauguauguucucagauauucugccuuacaaagucaccacuggccguuuccuuuuaaguccucuguccuuggagaucuagauacuuaagaaauccuagauuuuugacauccaaaggaccucuagaaauagaguaagaaugggaguuuagagaugauacauacaguccagcuguuuaaucaucuccccagauaaaaaacagacccaugcuuggaagugaagugacuagcccaaagccugacguugguaacagaguuggggccagaacaucacccaguuaguacuuugcucugugcaugugcuucuggccucuguuucagaauucugauacuuguaauucuuagcauauuggaggauuacauucuggguuccaaaucuuuuggguuuugguccuauuauauacuccuguauucaaccaggccaaauuugaaacuauggauuucaaacguacugucaggccaaggccaaagaagggcauacuuuacucauugccugacaguuuugauauuguccaagcucuucaccaacguuacucuuuuuuuuguuguuuuuuuuuguuuguuuguuuguuuuuucaagacaggguuucucuguguagcccuggcuauccuggaacucacuuuguagaccaggcuggccucaaacucagaaaucugccugccacugccucccaagugcugggauuaaaggcgugcgccaccacugccuggcaaccagcgucauucuuauuucuuuaaggugccccauggugucagaaucugaaucugaauucccauguaggauuccuguugauuccacuugcuugagauacaccauuacaucaucucucaaauaaugagagugaugggagccaguugagcuguacugcagcaagcuuuuuuuuuuuuuuuuuuuuugucagccauuuguuuaaaaacaagaaaugauguucagacacuaguuucuagggcuuuacauuuuccucuuauugaaagcuagcaucaucucggcccugaaucuggucuauuugucccaucauuucagcugugucuuugcugauuuucaaaagaugagugaugcaaacuugcagugcgauucacauuccacuguuuguauagcuuaggugaucucuugcauaccaagugcugcucccacucccacuuggugagcuaccuuuuccugccacaacugaacauugaaaccucuucucuagccuuccuaucuuuuuucuccgugacauuaguuaacuuacaaucaaucuaacauguuguugaaagaacgcuccagaaaagccucuucuguagugagcuuagggagcauuggcuucaguaggacucacagcagauucuagcaaagcagagugcuaacugccacggacacauguggacugucaguaguggcagagcugcugucauucauagaggaccauucuucugaguuagaaaacaguguuuaguccuguuuccuagucauuggaaggcuuuguaaggcugugggguagaucaguuguagaauacuugccuagagugugugaggcccuugauuuaauccuaguacuugggaggcaggaacaggaggauuauaagugaggccaggcucuaaauuccuuuauaaaugacguaaucauaguauauuauuuuuuucuaagacgugaguacacucuggcugucuacagaacaccaggagauggcaucagaucccauuacaggugguugugagccaccaugugguugcugggaauugaauuccgauccucugggagcagucagugcuguuaacguuauucugaggcaucucuccagccaacacuguuuucuuaaaugaucuugaguagcaugucccucccaagcugagugugguguuuuguuuuuauuuuguauuuuaggaauggauucuuguuuuauuuaaaugaggaaauuaaagauguuaggucucagaagaguuggcuuugauuuuauugauccuuuuccuuuaaaagauucagcgcuaguuuacacaccuaguucaaccaaccuuaaagacuggauacuguuuccacuuauuugacagguuuuuaacuuuuaaaauuaaacauagaaauucagaagccuuaggaaagggaaugaagaaaugcaggaguuaucacgcagacaccugacacaggcugguccccguguagagauacaggaguuaucacgcagacacccgacacuuggcacauuguugaacccuaguucugguucugaggauguggggguggggguaggguaggauuuugaaaauauuguggcaaguguucuacacuaacuuuugaauguguugcuaccagcuuccugucuaugcauacuugcucuuaacaaaaaaggaaaaauacccaaguacuuugucucuccuuuuuaaagaaaauuuauuuuuauuuuguauauaggagucuuaccuacaugaauauuuguacaguguguguaugcauacacugccagaggagggcaucaaauuuccuagaacuggaguuaccagauaucuguuacucuuauguagcuguuaggauuugaaaccagcuccucuaaacccaggcugaaagagcaaccaauauucuuaaccacugagccaucacucuagccccaucugacugucuugucugucugucuauuaugauuucuuuauuuuauguguauguaucuaugugaguguguggcaugaagccagaagaggacguuguaccucccggagcuggaguuagaguugauugugagccgccacauggaugcugggaauaguagcucagcagcaguagcguagcaucugcucuuaacugcggagcucucucuccagccaucucuguucucuuuuaaaaggaauauuuaguguugcauaaaaucugguuuuuuuuuuuuuuuuuuuuuuuuuuuggagauagaauaagucuguaucgucagagcuggucucagguuugacacccuacaugugccuccuaguuacaggcauguagcacuaucccuagcagaugaaauccucauggaccaucuuguccauauucuauuuuaauauccacuguguucauggcucuguagccuaguaaauuaccuuugcaacuuugauauaugugguucacuacaaguguaccauaaaauccaggggauauuauuacuuuguuauuuaaauacuguuauuaauacaucagucuguuacauuguguuugccuuuuuuuaaauaguauuuuuaguuuauuuuugggcaaauuuaugcauguauacccacagaccuuccucccucuucccacucuuccccagaaauuuccaauauggccccccuuacuuuuaugguugaguuccauguccugaaggcauuacaucacaguacuccuucccauccucugccuuuuaccacuguuucugcuuccucuuccuccauguuucugaaccuuggaguggggccuucguguuugcugugaugucccauuagggcuaaguguucaagcaauacucaucugagagcaucaguaaccuguggguauauacagacacuuaggcagcagcuugacagcaucuccguuuaggaagacaguacgaggcucuccuuuuaagacuugccaccaccucagcugagggccuuuaccagguuuauaguaucaugcuuuguuuguucauuucaauauaacuuuaaaucuauccaaacugacauguugaucuaguuucauugugccuggcuguguaggauuccuaguccauggcugcuuuaguuauugaauuggggggagggcgcugggggugucucacuuuuuagugcuagccggccuggagccucacuauguagacuagacuguccccaaacugucauagagaucauucugccuccuccucccuaaugcuggaauugaagaugugcuccagccgugccagcuguuagaaucuuaacuuccaggauucucagagcuuaugcaggccaugcauauugguagcguuuuccuaggguuacaggggauuuuucuccuuuuaagacaugaacuugggcuggagagaauggcucagagagguuaagaacacugucugcuauuccagagguccugaguucaacucccagcaaccacauggagacucguaaccaucuauagagugaucugaugccaucuucuggcaugcagauuagagcacucauauccauaaaauaaguacauaaaucuuaaaaaaaaaaaaaaaagacaugagcacuuuuauuagcuuuuauuaaucucaagcgucuuaaugaaaaaauaauauuuaugcagucguuugcaucacugugauuuauacauuauaggacuuuugcuguaguuaaaagauaaagccguaaacauaaagacaagaaugaaagagugggacuguuugggguggcuagaguaaagucgagugccugugcguuuguguucuuguccuguuaccuaacagagagauguuuguaaggcuuuuagaagucacuggaggcugugcuuugaguugccacaucaucuguguuucuguacccucucccucuucccgcaugugcugucuguguccauacuuagaacacauagcaguuccuuccuccugucucuuggccugagcuacagugaccgccaggaagauggcccuuucucauuccugugcccugacgacaugacugccaagugggugcuaacaggcauauuuggaaggacaggcagacccugugggaaagggaugagaagguggaguggggucaguggugguaagaauaguucagagaacuugucaaugguauguaacauaguagggcuacaacuuaguagggcugcacaguccuccucagcgagcaucaugggaaaacggcauagugaggagcucugaguguuguucuguuuauauacugauaaaaucauuaacguuaaguuuaaaauggauacauuucuuacuggaauuuaagcagaagaauuuuuaaguuuauacuuuccuaggaauauauuuuaaaaguuaaaucugacagguugaacuaucuuagauaauguauuuuaauucccuuuccuuauuucuuaguugucucgauuuuaauuaaaauugacuuccuuugagugaauagauucaaaggaacagcuuuggucacuguucuugugaaauuuugugguuuggaggcagugcucuaacuucaguagcucugguucauguuguacuguguggucaaaugauacccauaacuacacugagaacuuuuaaguuaagcacagcuguuggagugucguuucuuagcuuucaucauggcacuaguuauaaaucacuguuaaauauucucuuggcaagcuccugcauaauucagaagacaguugcuuaugagaugaucugaucugggugguggugucacacaucuuuauucccagcacucaggacgcugaggcagucgaaucucuugaauucaaggucagccugaucuacccaacgaguuccaaggcaaccagggcuaccuagagaaaacccugucacaaaaaagcagaaaagaaaaaaagauuaucugauacaaauagcugcauggucccaaagcuuccuugguuguuguuauagggcucuguauuuuaguuagauggagugaauacauauauaaaaucucauauauucuauagguagccaaagauguagguuugaaaguaacaauuugaggaucaccgccuuugccaguccuacagugguauccaguacugacaaguuaagacucgcuguucucugcauacuuugugcugcuaauuaacaucucuuuuugcaggauucaugaauaaaauuuuccaucccaacauugaugaagcguaaguaacuauuuaaaaauguuugaauuuuagcagcagcuguucuugauuaauuagaggucaucucuuucagauauaaaaacucuguuaucuuuuggguuuuaugggaggcaggacuaugugaauggucacuuaaacuguagaaugcuagggccgugaucgucugagccauugaggguccagugcaguuacugauugugcugcucacguauuuccauuuccaugacuggaccuuucauuuacuuugguauccagcugaaauguuccgcaucucaauucuuacuauauagaccccaaagaccucuuugucagcauguggguucacuguuuucagcucugaauguauuucuuaguucuugagggacaaauaugaaugacaauuucauuuuagcuaaugaaucuuaauuacccauuucuuaaugauuguuuauaaguaaugucaucgcagccggucuugcccauccugugcugguuaucuggacuggacuuuuuucuucauccagcuuuaguuuggcugucucacaaccacacaggaaaguuuugugaacuuugcaugagcagguuacaugucuguauuguguucccuaaucuuuaguaccuugguguauccauccugaugacgaauaacguucucuuaaguaaccacaguaaaguagacucagggauuuacccaaucuguagagcgguaguguaagauucauauacuaccuuuaguugucaaguuuccuuaaguaacuuuaaucuuugacaucuacaauauuuuuaaaaauauagaauagguauuuuucaaauuauucuuuaaguuuguuuucuuaggagacaugcauacacuugacugucuagugaaauucugugcuggggaauuacaaggucuaccuaucggucaucgccugggucagguguguucuucuuggaacgcugcucacucuuguuccuuguugguuguaaaggaaacacagcagagcuugccaaucccuggccuucuccccccaguucacucccagcccaucuuaaagggucuguuacaaaguaguuuugauaaaauuggcugccagaaacaugcaacuagauuucuaauuuuuaaaaagugccauuuuuuuucaucuguuucaggucaggaacugugugucuagauguaauuaaucaaacuuggacagcucucuauggugaguuuggccauggaauauuauuuggagauucugagacgacauugccucagaagaauauugcuugguguuucuucaguugugugguguugggaaugggaaagaauuuugaggggcugagugggaagguuugggaagaaaacggggugggcaguggggcuagggacauugcucagugguuaaaugcacugucuacacaagcgugaggacuagagucugcucccagaacucgugaaaaucaugugagcguggggccucucaaggcagauccaaggaguuccccugugcaagcuggcuagggagacgagcauaucaggggccucugguucaauugagagaccccgccucagugaauaaaguagaaagggcacguaugacauuauacagacaacugugaaaauggguauagaaaacaacuuuuuuucacucugaaguauauaagcuucaguuuaguaacgcaaauuuaaaauaaagaaugaagaagagcuggagagaugguugaugagccacugcugcguagaacccaagcucauguucugcacccaugucgggcugcuagcaacugccuauagcuucagcucugaggggucugaugccucuggccucggguaccugcauucauacccaccuuucacagacagacauaauuuuaaacauuuuuuaaaucuuuaaaacauaaagauucugugggccaggcauggucauuugaguacucagagaagccgaagcaggaagaagagugaggguguucauuuuuggcugcaugggaagacuggcugggagagucagggcagagaggagaagugguccacuuugugagguuccgaacuaaacauacaguuuaguucacgcacgcgcacacacacaaauguuggugguuuuuucuuuaaugggugcauucugaaacuuguaugcuguaguuugagagaaucuuagcaaggugccucugagaugaggugaguaggaaaguaagcagguguuccacggaucgcugagccauccuucaguuccaaaagugugacucauccauuguaacagaccaaccgaucgaugacuuaguucuucagaguacuguggugagugucaccugcuaggggaacugaaaacaauuaaaagucuacugaaagcgaaccagugauacuaaacagaguaaauguuucuacuuuuagccacaaguccgcuccacagacucaauagauauucccucucugaugcucucacuccaugcgcuucuccugcaguuucugcuguuacucaccucugaguauguuuuagaguucucucauacacccacuuugacuugguauuauauuaauuuuuuguucugcuagauuguuaccuacuguaaggacuguuaaguguguccaauuugucucuaggugggccuucuagcacaguaccucucgcuaaaaggaauugcaagaaugacuaaauagaucauaguugcugaaggcacaaggaaaggagggaaggucacucaaagcuggauuguucagaaacgagaagaaucaggcagacgcagaaugagcucugaaguuugaggacagcccggucagagagacccugucucaaaauuaaagacuuggaggagaguuggagagaggaauaggaaggaagaaaugauguaauuucaaaagacaaguuuaagaggaaaaaaagcucaugagagagagcauaauacucuuggcccucccggagccugagccaccuuuugcagacaucccugugcuagguuugcagggagcucacaggauggcugcucagcagccgugugcagcucaucccuugugcuccucacuggacagaccguugaggaaggaguuccucagcagaauuccgucucuugucucucaagaacaagacugguuccuuuauucacguuuccucaucacaagcauuacuuucucagaugcccaccuaagccauguuugcauguguuuaaaccuguuaucuugaucugcuggauuguaagccccaguugagcaggacuuccugaauuuucucgaucugcaaccccccuuuagcuccagaguaacuucgaguuuugggguguuguuuuuuguuuucuuuuuaaucuuuagauuguguuuauuuauuuguuuuugagguaggaucucucuauguagcccuggcuguccuggaacucuacaucuagaccaggcaggucugaagcucacagagaucugccuuccucugccucccaagugcuggaauaaaaggcaugcaccaccauauguagccaagaagaaagaaaaacuuuuuguuguuguuguuuuguuuuucgagacaggguuucucuguguagcuuuggcuguccuugaauuuacucuguagaccaggcuggccucgaacucagaaaucugccugccucugccucugccucccaagugcugggauuaaagaaaaauuuuuuaaaagacuucuuuugaguguucugucugcauaugaauagcuaucacaugcaugcuuagaaccuauggaggccugaagagggagucagaucagccauguauaugcuauacuaaacccggaucuucuacaagagcagccaccccucuuaaccacuaucuaucucucuagcccguagaugaagaaaguuuuugugacccuggauauauaagcacauaaaacaaacacacaaguuaaacauuuacugguaacaacuacaaauaaauuuaucuuaaaacaauucuuuggcaugcauauaauuuuuccauuuauuaaaaaugaaagcaaacuuucagacugauaagauuaaugaauuuguauuuuuaaggaauuaaauauuaacugaauuuuugauaccucaaauauagaguauuuuggauauuuuucagaguugauugauaauggucaauauuaaaaaggccaccuagacuaauauauaauacaaaaugacagcuauguuuaggaacauuucagaaaauauuggaacuuuuaacuuaauacuuccauguagaagacugguuguaaaaauauugaaaguauguguuuuuguauaagagcagaaaaggugugcaguaaagcaucacagcucuuaacacuggagucacaggucuccgggaguguucacuggcauggccucccaugcccacagacauagugcaaagugcacaccugcguucagaguuagggcuacugugaaguucacaguacaauacaggaaaguacugcuguaaucuuugguuucauuauauguuggauuuugaauuaauuuugguuauugcauuugacaaaaugcuauguuuuuuccaaaauauuuccauuuuucauucccuccauccauaugccaucacuguccacaguuaugagaagcuaaauaauagaggaaggacuuggucguuucuuuuuuuuuuuuuuuuuuuuuuuuuuuuuuuuuuuuuuuuuugcaugaaaauacaaaaugguauaauuuucaagaaggaaaauaaagcauuuuaaaaaauagaagacaguuuaagcacaggaugguaaguaagaggucaaagcuggaccuaucuuuucucuucuggcuuacauaauagugcaucacucuuaguaacaguaauggcgcugagagaagccaguguauaucagguaugguacugcuugccugcaaucccaggauuuaagaagcugaaucagggaguccagauuagccugagauacauagugaagcugugagucaaaaagcccaaaucaaaccaaacaaauaaaaaccauaaauaauggucacagaauccuauaucaacugguuuacaagcaugaucucauuuuuuuuuuuugaagcuuacaaaaccuuuauuuuuauuuuuuuucuuuccauuuuuuauuagguauuuagcucauuuacauuuccaaugcuauaccaaaagucccccauacccacccacccccacuccccuacccgacuuggucguuucuaaaacacacacacucaccgggcagugguggcacacaccuuuaaucccagcacuugggaggcagaggcaggcggauuucugaguuccaggccagccuggucuacagagugaguuccaggacagccagggcuauacagagaaacccugucucgaaaaaagaaaaaaaaaccacacacacacuccuagaauagugccugcuguacaguaugguuuguugaacuaaaucaguguauugaccauguccaguacugcuuaccauaagcuuuggggacuagagcuaaaccuaauuggguggauuuaaaaaaaaaaaacacacaaaaaccgaaaaacaccccucacagacacacauuuuuggcaagcuaccugaacuauuugguaaugauguguuuccuuaaaauguauucacauuuuagaaauguaaauaacaaaauaucccagucugguuccagucacauucaaguaaguuagauacagucucacgaacuuuuguacaacugaccagaaaaccuuucuacugauucucaaaguuaacaacagauuuauuaauuguaauucguaugacucagacaaagugaugguuuuugucugucagugguaugcaagcuaucaccaccacccccauccuaaagagaaagacacuugcuagccagcaccacacacacacaccaccagccagcccacuucuuauguuuauagagccaucugcucugaacauucuuaucaacugugugccugcuguggcuggcucuuuucagcuugcauggccuuggaaggcucacccuuguagucuuuuuucugacuaaguagucuuagcacauuuuauugauguguuugucagacaguggucauuugaguagugcuuugguaacuguguacaaauuaaaccuuuuuuuuaaacuuauuugucucauguguauggguguuuggccuauauguaugucucugcgcugugugugcagaaccugcagaggcuggaagagcccagucuccuggaauuggaguuaacagacaguugugagccacccugugggugcuggaaacagaaccuggguccucagaaagagcagucagugcucaaaccucuaagcuaucucuccagccccuguguacagauugccuugugaucauguuuguucauuucucuuuaguguuaaggaguuaacuuacucgcagaauuacugaccguuuuuaaauuuuuugucagaaggucugagaugguuagaaaaggcuuaagaguagaagccagugugaguacuaaguuucaucacgcuuaggaaaugcuaugugcauucuuguauucucugcuaggguguuuaauaugcagugagugguaagccacuuuggucaaagagagagaauuaaaagcacacuuccggggcuggugagauggcucaguggguaagagcacccgacugcucuuccgaagguccagaguucaaaucccagcaaccacauggugguucacaaccaucuguaacaagaucugacacucccucuucuggagugucugaagacagcuacaguguacuuacauauaauaaauaaauaaaucuuuaaaaaaaaagcacacuuccacaguacacuugaagguuuugugggaguuaagacuuaucugauuuagagaacuaaacuguuauuggaguuagaacacaguuggugagcucugaacagucaccucguuuccuacuguuguuuguaagagucuuaguaauauuauuggggucuugucgggcaugauagcaaaugcuguuaagcaaacacuugugaggcaggggcaggcaaauaucucuuaguuugaggcuugcugucuacaaaguugaguuccaggacacucaaggcuguuacacagagaaaccuuguaucacagacagacagacagacagauuugacaagcuccagaaaaauuucuaauacaagacuaacuggagcuggagagauggcuguucuuccagaggauccgaguucaguucccagcauccacauggcauccacagcuguuuguuacuccagaugaucugguacccuagcauaaacaugcaggugcaaauacacaaaaaaguaaauuuuaaaaaaaauuuacuaaaucggagaaaguuagcuucacauaaguauccaacugaaagcauaaggcuuagcuuggcacucaaaacuuguuguaacaccugcuucugauuuccauggaggauagggcaggaacugucuguaaggguuccuguuguucacugugccauggguaugugcuguuccauggacacaaguguguauagaauaguaauuccagcugaagucccaggucugugcuuaccauagcauguucauacauuguucauucuagcaguaaauuuaguccaugugacuggcaauugcuucgguucucaucuauugucucuuugccaaguauaccugaagcuuguucguucucaaguucuaaauugcuaugaucauaauuuaaucacuaaguaauuuuauauuacuuuauuucuagagaauuaauuuuuuuguuuuugguuuuucgagacaggguuucuguguagcccuggcuguccuggaacucacuuuguagaccaggcuggccuugaacucagaaauccgccugccucugccaucuagagaauuaauuauaguggguaaaauacaauuacuuuuguaaagaugaugucaucagugugaaguucucuaucugacauuuauuuaguagcuaacugguacucugagagaaaacagcaggugguaaaagugauccgcuugggguuggggauuuagcucagugguaaagugcuugccuagcaagcccaaggcccuggguucgguccucagcuccggaaaaaagaaaaaaaagaaaaaaaaaaaaaaaaaaagugauccgcucuugacuuguagcgugacaaucuucuuccaucccuuccugcucucgcagacgucagugaugaaagcacuggaaacuuaaacugcagacaggggaucuggauucagugucaaagagaaaugugauuuaagaauugguggaggagccgcgcaaugguggcgcacacuuuuaaucccagcacuugggaggcagaggcagguggauuucugaguuccaggacagccagggcuauacagagaaacccugucucgaaaaaacaaaacaaaacaaaacagaacaaaaaaaaaaagaaaaagaagaauugguggagggcugaagagagaugaggcucaccagucaagugugccuggugccuuuccagaguuuguuucccaguuuccacagcaggaggcucacaaccaccuguaagcccagcuccaagucugugcuagguuuuuuuuacuuguuuguuuugagaggggaacaacuugaacaacccggagucaucugagaaccuuaagaaaauguuuccaugagauuggccuauagguguuuuguuguugguuuggcuucgcuuuucaagacagguuucacuuugaagcucuggcaguccagguacuugcucuguaccucaaacucagagaucugccugugucugccuccugagggcugaaauuaaaggugcacaccaccuccuagcaggaaugaugguuaauagcgcuuaauuccaucagaggcagauggaucggaugcuuuguugaggcauguagcugagugguagagcacuccuggauuugacaccuuguauugaaaaagacaaaaccaggaaaggccuuucuugagcugugcugauggacagcacuuguaauccuaaugguuggacagccagggcagagagaguacagguuccaggugagucuaaucuacauggcgaaacacugcuuuuaaaaaagaugccgggcuggugagauggcucaguggguaagagcacccgacugcucuuccgaagguccgguguucaaaucccagcaaccacaugguggcucacaaccaucuguaagaagaucugacucccucuucuggagugucugaagacagcuacaauguacuuacauauaauaaauaaauaaauauuaaaaaaaaaaagaaacccuuacuccauuuaaaaaaaaaaaaaaaaaaaaaagaugccgugcuggagagauggcucaucagcuaagagcacugacugcccuuucugaggacucagguucaauucccagcacccacauggcagcucccagcuguaaguccaagaucugauacccucacauagauggacauguaggcaaaacaccaaugaacauaaagaugagaaggugaggaggagggggaauggugguuugucccucagugugccucccaggugccauguguuacagaugcucagcuguuuguagaaguuugaguuuaguagauacacugagagguuuguguguucaucuuuaugacugguugggcaacaacuauuugaagaggcccagaggcucaguguugugucuguguauguguagacucauaacuucauaccugguaucauucugcaucuuguagguagaggcuaaguagaacagguucuucucagcaugagaggaaugccgccuguucuacagaagagaggaauugcgcgcuuaguuucaggcuugccggcuuugacaggacuuagcuagcuagcuccaugaccagccccccuuauggacuuguaacucuucagaaagcaacuauuucaggcaaguggaaaaguuguucuucaguagaagaguuuaguggauuggguaugucauguucacuggucagcauuagaccauguaguaacccaggcuuuguggauuaugcaucccaauccagccaguauaggacccaugaagcugaccugcuuuauuggggcuauagauacaggguucacuuuaguucuuaaauaagacgaggagcucugauuauuuuuauuuaaaucuuuauucauuauuauauguuaguacacuguagcugucuucagacacaccaaaagagggcaucagaucucauuacgggugguugugagccaccauaugguugcugggauuugaacucaggacuuucagaagaacagucagugcucuuaaccaccuagucaucucuccagccccugauuugguuuuuaaucuguguuuaugauaauaggcaaaauuuaucuuauagauagauuucuuuuuuguguuugucaauacuggguuuuucuguguagcauuagcuguccuggaacucaaccuguagaccaggcuguccuugaauucacagugcuaggauaaagggccugucuagugcugggauuaaggguuuacaccaucacaaccuauggguucuuagcuuauaauugcacguaguuaucuuuuuugggaagcaggggggggucgugguagauuagagauagggguucucuguauagccaugacuguccuggaacucaccuuguagaauagacucgccuugaacucagagaucuucugccucugccacccccaccccaguacugggaauaaagauaacuggcucuuuuuucuuacauuaacaccaacuauuauugccugguaguucaaaguucuaauaaaagcuuuaguguaacuauuguguauaccacacugacuggcugauuaaagauuaacugccuucauuucaggaagguugguaacgaauccuagcauaagauaagcaagguugugucagguuugaacuacaaugaccucuaaaaaacaccccaauaaggugagaaguguucugaggugaugagcagugucuuugagagcugcucaucugagauauacagaaguaugcauuguuucaggucauuuucagguuaaauacauugggaagggacuacaacuaagcaguuaauggggauuuuuuuucccauuuuuaaaagauuuguuuguuugucuuaugagugugcugucacugucuuuagacacaccagaagagggcuuuggacccguuacagaugguugugaaccaccgugugguaucugggauuugaacucagaaccucuggaagagcagucagcgcucuuaaccacugagccaucucuccagcccaggaaaauaacuuuauauguggguuuagaugacuuuguuuuauauggauggaugucuugccuacauguaugucuuugcaccacguuugacuggcauccucagagggcaggagaagauaucagauccuuggggaacuagaguuacagacaguugugagucaucaugugaguguuuggaauugaauccaguucuuugagaagagcaaccagugcucuuagucauugagccaucccucuagcccuauuuuauuuuaucuugagacacaggcuuacuauguagccuuggcuggccuagaguucacuucauagaccagacuggacucaaacucaaagacaucugccugccucugccuuccaaguacuaaaacuaaaggcauauacuaccauucccaccuagagugcuuuuaaaaugguccauguacuggagauguuucucagugguaaagcauuuaaccuaccauauguaaaaguccuggguucacgcucugauaucacaguaaguauguaaguaauuaacuugcacgaaaugugauacaaugguucuuaggucagacuggugaccugguggucuggcaguuagcaggacuuuaguguuccucaggucuuaggauacuacagccuuacuguugucuuuccccucaaagaacaaaauuacuuucuuuaagcuuaaaauacugaaaagcaaaaauacuaccaauaaguggaauucaaggucaguggugacugauccauuaaccuccuggaugugccauguggggucuuucuuucuugauccaacagcauuuauuuuagagaaaguuacuuuuaaucucaaacuuuuuaaagauggucuaccugucugaggcuauuccucauuagcuuuacugaaguguuauuucugaggaugccggcugccuguuauagccccuuaucauguuuuucucgcccauaacuggguaaguuacucgcaguguagccucucugguugcugagguacguagguauugugguuggagugugaagugucuccgacaggcucauguguuggacagucgguccccaguggguagugcuauuuugggagguguagaaacuuuaggagguggcucuagcuagaggaaguaggucacuagaggcaugccuuuaaaguuacagccacucccuggucuccugcuugcucuccacuucuggccaacaaggaaggcgccuccucugcaugcucucauugccacugcuccauccaaccaugugcugaaaccaugggccaguaaggcuugccuucuuuagguugacaucugaguuuuggacauauucuugaaugccaggauagccaggucuacacagugggggucccuggcuccccuacccccccccaaaaaaaaagaaagaaaaagaaaaaaggaguaaugaagcauuucauuuguuuguagauucucacuguaguuuuucacugcucauguacuguaagcaggagaagaaaauguguaaacacguuccagaucuucuguuguuccccaggagcuggaaaaggauuuuaaacaucuauuaauuagucugaaauuauaaaaaagaaaagaggaaagaaagagagagagagagagagagagagagaagaaggaaggaagggagggagggagggaaggaaaggaaaggaaaggaaaggaaaggaaaggaaaggaaaggaaaggaaaggaaaggaaaggaaaggaaaggaaaggaaaggaaaggaaauaagggcgucuuuaauuauuuaugcaguuucaaucuccuuuuuucuuuaucuguuuuuggcuuuucaagacaagguuucucuguagcccuggcuguccuggaacucacucuguaaggagggcugccucugccuuuaaugccccugggauuaaaggcauggaccaccaucaccacccagcuguuuucucugucugucugucugucugucuugagaugaggucucgaaguguauugggauuuuugccugugccaccaugcccuccucuguuccaguccuuagaacgcccccaggacgccugcccuggcucccuacagucaguacuuagccuggccgagcacugcaguaaagucucaugguugacuuuauucuggaaacaguagaaacuccugauuugcuugugaauugaugguaggauuuuggaaauucaguggcugauuuuuuuucccuuaguagucaaggauaugaauaaugugauuaaaauccuaaaaugacuacaguuuacauagccauaauuugaauuacaauggccagaaucccaggaaagcucuguguaagucauagaagaaaucauggguucuagaccacaggaauugacacccugugaugacaccuuggguucaucuuuuucucuaagugugagcaagauuuuuuuuuuuuuuacuuccucuucuuugagccugcuccuuacugaauuauggaacaaaggggaacagugauguggcuguugacugcccaggguagaacagaacacagagacguauauacuccucuguccuguccuguuuguguuaagagaccaaguccagggccuugggcucgccaagcauaugcuguagagcuggaacuugauccugaagagaagugacugacugucuuuuuccugguugucagggugagaauuuggaguccugcaugcccuuuaagguccaccuugacagagaugagaccuggcagaggcauuuuucucaaggcaguugaggaaaaaagccuaaucaaacucugcaucucugaguuccaggacagccagggcuacauagucuacacagggcuacacccugccucgaaaacaaaagaaacagaaaacuccuuucugaggacugggcucuuacuuuuuauuucuuauagccaaagcagcuuauaaaagaaagcauuuaauugggacuugcuccaguuucugaggaugaguccauuccucucaugguaguaggcguggccuggaaccacaguguggagcuuacugagccacugacuccuccccucgccucuaugcaggugguaggcaggcagagagggaggcaagcccuccuccagacacaccuucuaaugcuuccuaaacugcccaccgcuaggaaccauagucauuccaaccaccagcggccaaggacaagggugcucagugaaacccuuccuucuucagaagggaauggauuuucacaaaacuaauuuuaugcaugucaaaucuaauaaaacuagaaauaugaaggaacuauaucaaagauuuuauaguuaucagcauaucuauugcuuuaauauuauaagacagugggcuuccagaguguauauacaaagcuaauucuuugggggagauaggugaaacaaagucuuacuuuguagccuugacuuguuuggaacucaacuauauagaccaggcugaccucaaacucugcuucugaacgcugggauugugcuaccacauguggcuugcaagcuaaugcuuacauuacaaauacucugaaaucacaguaaguuuguuuggugcacgcacagccggaggauggacaguaggacaaacugggggugggcggcggguccugagaguguagacagggcucuugggaggucagacuacaaccucagaugcuguuucucagauaccuugaacuguuuguuugagacagggcuucucagugguauagaauaucaccaauuggcaaagcuaguugucugucaagcuccagggaccugcccagcucugcaguuaucuccccagcacugggaugacaagugugugccccuggcuuuuucaugaauucugaggauucaaacucccaggucuuaaugcuuaagaggcaagcaucccccuuacugagccagccuucacaauaauucugaaaagcaaagaauuugcaaguaaaagucccuguaaugauggcuaauugugguuucaaauuccuagaggucccacugccuccgggccagagccaggagcucuggugcccagaagcugaugaucugcacccgggacugcugugcacuccccauuacaggugugccucagcacgucuguaacagugggucagcagugaugaaaccggaaggaagaaccaauguucaaggguucuuuuauuguuugaagcaagcacauugacagagguacuuaaaaguaguagaaaaguuuauuagaucuuuuucuagaauacgagcacuccccugguuauguaauaggcagucuacaguguuucucuagccccaaagcccuucugagugucagagaacaaaaccuauacuuuauuuuuaaaagguuuuuguuguuguugggugggaacagucaguaguaaucuuugucagcagcaccugucauaaaccacaugagcagcgugagcuguuuccucccuggggacuugacaagaagcaaaaaguagccgcagagucaguguggaccuuuuaguguuuaaugcccacucugcuagaaagggaagcugcagagagacagccugucccugggcacagcaugguaaauaagcucagcaauagguaaccucuguaggccucuggguuuuugagguuuuugguuuuuuuuuuuuuuuuaagauauauuuauuuuauguaugugaguacacuaccacucucuuaagacauaccagaagagggcaucagaucccauuacagacacuuuugcuaucuaggaauaacuugcuuugccccacugaaacuacaauuagccaucauuucagggacuuguacuugcaaauucucuacuuuucagauguuaaaucaugcaccaccauguaacugcagggaauugaacucaggaccucuggaaaagcagucaguguuuuuaaccacugagccaucucuccagcccugagcuuccauuucuuuauguguggauggacuuggugguaaccaccucugguugaagugaagcgcucagcaaagcucaaagugugucuggccaaacuggacaugguggcccaugccuauaauuccagccuguugggggcaagaagggugaggcagaaggaucaagaauuugaagccauggcuggcgagauggcucagcgaguaagagcgcugacugcucuucugaagguucugggcuuaaaucccagcaaccacaugguggcucacaaccacccauaaugaggucugacacccucuucuggugugucuaaagacagcuacaguggacaguagacaagagcaaguagaguuggccuggugagccgagacgaccgggagaagcagggguccuaaaaauucaguucccagcaaacacaugaaggcucacaaccaucuguacagcuacaguguacucacacgagaggggggcgggggagggagagagagaaugaaugaaugaauuugagauuugaggccggcuuggaguacacagcaagauuuuggcuuguggcuccugggauguguuagugggacacugcuguuacuaucuuaccucuuaauuagaacuguugcuaauucccccugcuuuggcuuaugguuugcacaacuauuucuauucuucaucuuguacguguaggugaguauguguaaguucaagugcccugaggggcgcuucauccccugagcuggaguaacagacagauaugagccgccugauguuggugcgucugguugaacuccgguccucugcaagaacccuugaccacuaagccacccuuucuccucguaauguagucacuguuugccauuuuuaacccauugucugucugggguuuuguuuguuuuuauuuuguuuuaguuuuuuugaaacagucuucuguguagucuuggcuuccuggaacucaguuccagugcuugccucaaacucauagagaucccccugccucuguguucgcagugcugagaucaaaagcguguaugacuaugcacagugccuaacccauugucauacuugauucauucuccccagaauuaaauugggaaagcaaagaaaaagcaauauuuuuuuguuguuguucuugguuuuuuuggucuuugguuuggguuauugcuguuguuguuguuguuguucuuggcugggaaauaggucucauugcauaauccagcugucucauacucgagcauccuugcguccguccgcaucccaugugccgagauuacagaaguguaccaguaaguccuggccuacuucccauguuuuauuagauauaccacccaagugcuaggcucacagguguguggugacgaugcaccgcgucagguauggggugcuaggggucaaacccacaguuuagugcaugcuaggcaaacacaaauugagccaccuucccagacccuugacaugccuuaaagauacuguuagcugggcuuggugcucacaccuggaaagaccaagggaggagaaucaacacuagucugaggaauauguugcuucuagauuuuaaaaauuauaaaugaggaaauuguuaagagaaauuguuuuguuugccuuuuuguuaaaacauuuagcacugggguccugauaugguacuucacuguaauuuagucccaugggacuguucugaagauggccuuuuaaaagcccagguggaaaccucacauucuggagggaaguacucaguggaaggacagacagacagccacccagggacucuggugcaggaucuacugcccacauugcagugcucagaucaggcuuuaguagacggaacagcugauguccuaguucacacucaccacauguccuaggucacaccacaucucaggugcucagcacaccugcuucaugacagcuguuguggauaauucagagauaggaaauuuuuaucucugcaaaauguuugguuaagaagcacaagucuagaauauuccagggagugagugagcaggaagaaccuacagucugaaagguuuucuuguuuuacagugcugggaaugaauguagggccuugugcuugcuaggucagaggucugccacugggcugcaucucucugugcaggcacuugguguggacagcuuuacuggagcauagucauggucauuugugguguuuaucuuuggcuacuuggagccacagccacagagcucuacugaacugacaccuuuguuggcuguaaacucuaaaguauuuacuccagucuucugugaaaaguuuagauugaucuuuuuuaugucuaaugugggauuucucaggcuugcaacaaauaucauuuuggucuugauaauucuuuauuggaggugcauccuuuuuuuuuuuuuaauguucauuugauguuuggcuuauauauauggggggggguguugguucccccagaacugaaguuaacagauagucaugagcugccaugggugugcugggaauugaacccugguuaucuggaagaacagccaacacucuaaaucucugagccaucucccagccccuauauaacauuuaauagcaucucugguauuaauagcaucuagcacccaguagauaucaguagcaucccaccuguugugauggccacaauguuuccauauacucauucccuagggguucacaggcuaggcauccaccaguaacaguacuuagucauucuaacagcagcccaaauccaguaagaacaaggggauaaagagggaggagugcuuacuucagugcucccucuagagaagagacuguuguuaugacaggugguugaaguaggaagagugcugaggcccacuuauaaacaggcacugaggauggaaucacaucccuacuagaagaguagcuugccuaucugucucagucauuuauaacuggcuuguauauguuucugcccuugucuugaauaauugaacuucauuauaucuuuuuauuuuuuuuaagauuuauuuauagcugggcgugguggcacacgccuuauaucccagcacuugggaggcagaggcaggcggauuucugaguucgaggcuagccuggucuacaaagugaauuccaggacagccagggugauacagagaaacccugucucgaaaaaccagaaaaauagaaaaaaaaaagauuuauuuauuacauuuauauaaguacacuguagcugucuucagacacaccagaagagggcaucagguucuaauacagaugguugugagccaccaugugguugcugggaacugaacucaugaccucuggaagagcagucaguucucuuaaccucugagccaucccuccagcccaaacuucauuauaucuauaucuaguagaaguuaauaccaauccauucuuacaaucccagcauucaggagcuaggggaacagaauauuaaauauuaagcaaguccuauaaaaguuuuccuuucucucucccuccccugccaaaauacgauuuugauaaguaacccaggcuggccuggaauucacuagguagcucagguuggcuuucaaccuuaugaaugcuggguugcuugugauccugggacuuggguagugaagcaagacuauaagggaaugucaaguuuguggcagccugaucuaugggagacccugcaucacaaacaacaaguaauauacaguagagggcuuugaaaauuguagaaguugguuaucuuaaggaauuauucauggggcuggagagugagcucagugguuaagaacucuggcugcuuuuccagagacccaaaguucaauuccuagcaccuauaugugacugcaguucaagugggaucuguugcugcuuucagcagcuguggacccugcacacgugguacagacauacaugcaggcauaaaacacucacgaaaagcaaaaauguuuuuacaggaaauuaucucauuuugaacuaguuaauaggggguuccugccccaccuuggaucauucaguuuccagauaaaagaugcaaaacuguuacauuuauaauaagccuuaaagcacuagagcugggcagauauccacccuuggugcuaguuugucuguggugaggaucuccucucugaggcaaccugggccaguauuuagcauuacaauaaauagcaacacaccaacccuuaccauuggugagauggcuuaguguggguaagcuguuugccagcuccacagaguugccugacuccaguacacacacacacacacacacacacacacaccacaacagaugcucccucacgguccucaugcauauacauaagaagauguuuuacaaaggaauuacaguagcuuggaauagaguagauaacugggacauacuguguaaugauaauagugucuguuucuguuugggaaauggugugaauuuaauugggaaaaugggccuguggucauaccagccuuaucauaagauccuugauuugaacucuucaacaauggaaaaggaaggaaggaaggagggagggagggagggagggagggagggagggagggagggagggaagaaagaaagggguguggguaaagguugagaaaagugccauucaaagagaaugcucugcauaugcucgugcguucggcugcugaaguuuucauuuuaaauaguuggaguugauauguuauuguggaacaccucuguggaaaauccucuccauuguagcugagugucuaagcaggugagcaggagggagaggucuguuggggguggagagguagcccuguuuguggguaagagugcuugcugcucuucuaggaccuaccuguaguuuccgcacccuuuggccuucgugggcauuagcaugcacaugaugcacaugcguuaaugcagccuaaaacacauacauguaauaugaauauucuuagcauucuugacuacugaauuucaguuaagugggugaaauucaugcaugaagugguuugguuuguuuuuuuguuucagaucuuaccaauauauuugaguccuuccugccccaguugcuggccuauccuaaccccauagauccucucaauggugacgcugcagccauguaccuccaccgaccagaagaguacaagcagaaaauuaaagguaagguggcacuugcuuuuaguuggccauauagagucuguuuguuuguuuguuugauacaggguuucucuguguagccuuggcuuggcuguccuggaacucaagagauccaccugccucuguuuccuuauugcugcgauuaaaggcgcacaccaccuccagcucaaagccuccauaaaugacuccuuuccucguagguuuucucuaagaagcaacugcagugguggccucaggacucccuguuagaguucagaggcuguguucccacacuaugaccauuugcaugaggcugggagaggacaccugcagcuugaguuguaucagcucaccuuggcuuucucuucaaugugugugcugguuggccuacagccaccacccugcugccccuuuaccugggucuacauuugagagcuugccuaugaaaagugcaggugcauaaagcauaacagagggaagagacaagucagcaggcaggcgugcgagcgggcgccgugcuccccaugcuaaggacugaugugcuuaccugcacagcacacagagcaucgggagccccaguguggugagaauccauuugccaacgagagcaguaaaggaauguuagcagagcuugaauacauagguuuucccaauuagcugugcaaggcuuaagucaaacaggaacauuggggaccauguguugaguaauaguuuccuucuauuuguuuucuccuauccccaguucucuauggaguugcugaguauuuuuguuuaaauaaaguaaaaauguucauuuucauaggucucaaguaauuugcaaauuaauaauuuaauauagcacaguaaccaacccccccccaaaaaaaaaccauguauuccaagaaaaaugcaauuucaaccagauaagauuuuguuaggaaacuaugcuaaaauuuugacauugccuucacuucccagugucuguaaaccauggcuaucuuaauacagaaaauauuucuauaguucuaacacccauuaggccuuugcaauauaguauuacccugacuguacuacagguuugcucugguccuaguuaccaaagaaacagaccuguguucaucuuaggguagcuagcuacuucugucucagggacccccuaacuuucugugguguccauauugagggucaguuugccauccuuaguagucugagauagcuguggcuauucagccugagcucaacccugcuuucuguuguacuuuuguauacuaacccaucuuuaccacgccauucaggaaaugaggucccugccuuguuucucagacuccuccuccccagcugguuggugugcuccccuugugccuggggucacgcauuuccaaagcccuugucagccccugccacccucuagggacucgcuugggcucugcuuccuucccuggaaccacacuacugcuuccugcucuaccuaaucuguggacccuucucaggccccaucccugggcccugcuacagcucggguguuuccuuccacucugaaauggauuucauuccauuuccuggaugugaucauucucuuuuuuuuuuugguuuuuuaggacaggguuucucuguguagaccaggcuggccucgaacucagaaauccaccugccucugccucccaagugcugggauuaaaggcgugcgacaccauacccggcgugaccauuuucuuaugaccaauuuaugcuuuuacccccaggcuccucccucuccccccgaguugcuuacucauggcuuuagguaacccucuagguacacgggcuccguggguuugucuaggccugccccuucucccagguuaucuuugcagcgggagucgcagcuuagcaggcuucaucacagcagggccguaacuacuacucucccuaggugucaguuagcauuuaggucuacuugaugcucuucagaaaugcacguguugcacacagcaguugcuagagauaugucucaacagcuaaggaugcauguuacucuuccaggguggcugugucacuguucuguuauuguaaggagagaccagugacauaacuccuccaauaaggccacaccuaaauaguuuggauaacuggggccaaguauucgaauggaugagucuauggggccauucugauucuacgcaccacacauaugguuuaaauucaguucucagcccacagaccacuacugccucgaaugucagcgucagaggguccagugucucuggucuccuuggguaucccacccccaugcacacaaacacacccauauccacaucaauaaauguaaaaauaaaucuuuguuaaaaugcagguguaaaaacaagguugaggucuggagagauggcucagugguuaagagcacugauugcucuuccgaagguccugaguucaaauuccagcaaccacaugggugcucacaaccaucugugaugagaucugaugcccucuucugggguguaugaagacagcuauaguguacuuacauauaauaaauaaauaaaucuuuaaaaaaaacaaaacaaaacaagguugaguacuacacagccuguggguggacauggagagccuugacauugucuaaagauagguaaacuucccugcucgaaaccuuugcuagugccagccagcacuguggaggaagaggcaagcagaucucuugagcuagaggagcagccagagcugcauagagagacccuguuguagccggucuuugcugcuuuguguauucuuuuuccuacuucucacgcuagauaggagagagagaucccugaaucuaauuucuuucuuucuguuucuuugaccacgacuacuaacaaacugcaaccaacccacugaaccaacaacaaccuccagcuggggcucuaacauuuauaugcucuccagaaguucccagaauuccaaugucacgcaauugcagaaacugucuguuagagcacaaggcaaauuacagccgcugcagucaguuugaagcagccccacauccccacaccugggauuaaaacaagagacuauauauacauguaugugcguauacauacauaauguauuguuguucuguuuuuaaagaaaccaaaauuccagaauuuucacuacaucuuguuucaguaaaccaaacaaacuaaaacaccuaugcuaguggaacuggagagauagcuaagucuuuaaaguacucgccucauuagcaugaguagaaaacccgggagaaucccguagaagguagagaacaaaaaaaaauggcugacaucagccucuggccuccaugcaaugcaggucugcacacacagcaucuuuguugagugguaucagcuugcugaggaucugcaguaccgagguaaucaaccucuuuuccuuaccuggcucauucugugauggucuaaauggaugaguuugagcuacugaaguguacacucucuguguuaauaugaaaaacuaaccuguagagcaaauauucccgaccuuccuaaugcugggacaguuccucguguugugacugccaacaauaacauuucacugcuacuuuauaaucauaauuuugcuauguuuaugaaucuuaauguaaauaucugauauucaggguaucuaguuuacauccccagucagaauuucuugauuaauauguacccaccaagauuucuacauucugccucauuuuuuuccauaguuuuccuuuguuacuauuuuucccuuuauuugcuuauuuauugaggcagggcuuuguggggcuuuggcuguccuggaacuggcccuguagaccaagcgggccuugaacucacauagaucugccugccucuaccucccaggugcuggaagggaguaccagugcuugccuagcauacacaacuguggguucaguccccagcagugccuaaacuagaugcucugucacaggcacaggcuguuugagucagggaggucagaggucagaauuucaggguuguccuuggcuguguagagauuuuugacauuagccuggacuaugugagauugaauuuuuuuuauuacuauucaguuuucauagccuacccacguaguuuuggugauacuaagucuuuaaaugaacccuuguguacagaauugacagugucggggcugaagugucucuaacuccugucugagcccucauccaguucccaucauguaugcccugugucugcuuuguuuuccccgucagcgacuguguuuguaauuucuuggucuucugaagagccuucuccucaaaugcuuuuuagacauuugguuauuuuuuaauauuuuaaaauauguaacagggauccaucccauaaucaguuuccaaacgcugacaccauugcauacacuagcaagauuuugcugaaaggacccagauauggcugucucuugugagacuaugcccggggccuggcaaacacagaaguggaugcucacagucagcuauuggauggaccacaggacccccaauggaggagcuagagaaaguacucaaggagcuaaaggggucugcaacccuauagguggaacaacaauaugaacuacccaguaccccggagcucuugacucuagcuccauauguaucaaaagauggccuagucggccaucaguggaaagagaggcccauuggucaugcaaacuuuauaugccccaguacaggggaaugccagggccaagaagugggaauggguggguaggggagugggggggggagguaugggagacuuuugggauagcauuggaaauguaaaugaaauaaauacccaauuaaaaaaaaaaaagauguaacaacuucugugaagggaaagaccggggcaggagaaauggcucaguagcuaacagaacuuggugcucuuucaaaaaaaccugaguuacagcaaggcaugguggcacacgccuuuaaucccagcacucgggaggcagaggcaggcggauuucugaguuccaggacaggcagggcuauacagagaaacccugucucggagaaaaaaaaaaaaaagccugaguuaugguucuagccagccauaggguagcccacaccuguaacuccuccagcaccugugcacacacaugcauauaauuuaacauuuuccuuauucuaaaaaguacauuuuuuaaaagauuuauuuauuugauguauaugaguacacuguagcuguacagaugguugugagccaucaugugguugcugggaauuggacuuaggaccuuugcuugcucuggcgccgcucucuccaguccaaagauuuauuuauuauuauaugaaaguacacuguaacuaucuucagacacaccagaagagggcaucagaucucauuacagaugguugugagccaccauauguuugcugggguuugaacucaggaccucuggauaagcugucagugcucuuaaccacugagccaucucuccaaccuaaaaaguacauuuuuaaccagacauggugguauaugccuauaaucucagcauuugagaacuguggaagaggcaaaaaaggucagaaguucuaauuauccuuggacucaaguuagaaccaugagcucccgacuaaaaagaaaaaaaaaaucuuaauuacauuuguuaagguuuuaagggcucugagucucaggucuauaaacuucguucagaaagagccugaguguggugguacacaccacauccucucagcacuggagguacacuggcaaguuagugaguacaccguuguugucuucagacaucccagaagaggucuucggaucccauuacagaugauugugagccaccaugugguugcugggaauugaacucagggccucuggaagagcagucagugcucccaacagcuaagccaucucuccagccucccucauggcaaguuuuaaaguuagucuagucacagcaagauccagaccugccaagaauacacugcugucucacaaaacaaaacugaagaaacagggaaauguucccacccagacccagugcagucuggucagcaucagcagaccugugugaucugccugcuccucagcagcuucaacagcaccacccacagccugaggaugagggaccuggguccagcuugugcccugaugggauucccaccacugcccuuccgucguauguguuggccauuuacuuacacagcgugcuuuuaggaacaaauguguuguuuauucagcacuucuuaaauucuuuuuaaccagcacuuuggccuaggcucuugggugagugaccaagggucucuuccaugacccugagccucacauagcagcaguuccugaugagcaaacagagaccauuaucacugucugcuuccaaagcccaggggucaggcagaacauugucggguggguguccuaauaagucacuguggagucaccacauuucauuucugucagcgagauaagucacuuuauuuugauggaaaguaaacaguguuuauuggggcuggagagauggcucagcgguuaagagcucugaccgcucuucugaagguaagaguguggauugcccauuucaaccuagacaagucacuuccucuucagagucccccuucuuugcuuuucguuauugugacacuggugagcaggugaguuugcaccuuggggucacugcgcucacacccuguguuuucuucacccuaccccucuuugcagaguacauccagaaguacgcaacggaagaggcccugaaggaacaggaagagggcacuggcgacagcucaucggagaguucuaugucugacuucucagaagaugaggcccaggacauggaguuguaguagaaaaggcaucugcuuuucagaaagacuauuauuuccuaaccaugagaagcagacucuaauauucauauuuaaacaaagcaauuuuuuuuauuacuaaacaagguuuuuaugaauaauagcauugauauauauauauuauauaucacccuuuagaucuugauuucuuggucauuucucaaccugaggugcauagcauauucccacauuccauuuugguagcaauaugcaguccgaaugcaugcauucauaaguccauuuggccaagucagccugugugcuacugaacugucaagagauugccacucucauagguaaacaugaggaaaacaggaaaaguuugcuucuuuuuauugaugguuccaaagaaacaaaccaaaucuaccagcucuuggaugaagauagaacagugcuuuuccagagugggaaggaagggguugagacgcgugcuuugagagccugugaggcugcuccguccuugccagcugcucccuaguccugagugguccuuggugaggagcagcaagaugcagcgaguugagugagacuuagggcuuuugauuuuuuuuuuuuuuuuuuuugacucggauuuaagugcauuuuucuagguagacuccugcccuccuugcuaccagaccugcagccaccuugguuuugccuuggagaacauuuggggagcauuuccugaacccaugucuuuuggggguacagcuugucauccagcaggaauuauugagcgagcaggacuggaggagacgggaaugaagacacaagagugacaucugauccuagcacggggccuguugauccauugccuggacugagcugugaaacuggacgcgguuuugguuuuuuguuuuguguuucuuuuuucuuaauuugugugaauuguaccuagacagguuacagauuuaauuuucaccuaccaagggacagucuccucccuggacaaggcucaguggaccaucagauggaggaagacuggccccauugcuugagccccugugcgacccuugaccuccagccuuaguucuccuggaagcugccaacugcuuacgggaguggguagauugggcgucugagacccagaacauccuaaauuugcaauggguaacagcugaaacaaacggaaguuuuuguaccaaaguggccggagguggggaagaacuacuuucgagaauuguuacggaggcagguugaggggacacuuugacccuccaagguaacagccagucagauggcuugaggugccuggcccaugcugccggcuaaaugccauccagugugcccagcaguuucagaccugacucuggagggaauuuggagacaguguagacagcagcucugcucuguauucuuuuugacaaaaccagaacaguagaaguagccaaucguaagaccugaagacauuuugaaugucccacuggacuaaccuuucuuuugauguguguuuuuaguuuagaagugcuauauuccacaaggguuaagucaaugagguuggaagacaccuaucuuuuuuuuuaauucaaaaagcacaaucagucuuuccuuugaaaauccauauaaaguacaacuuuuagcgugauuauuuuccuaaauacaaagacaaauaauuuacuuauuuuauguuaauuacgggcaugaagcaaaagguuucuuuggggaacaugcaguuuuguagugcugggguugguucauguccucuggcacccuggcuuguugaaagguggcuuuagcugugugcuguguaccugcuuacguggccugcuguccucugugugauuaggaggguuucugcuggcccugcagcuugcuucccugcggauuaggccuuugcucaugcuauagccuucaugugggugcuaccuagagcaggcgugaacugcuggguggugauugugaguucagacaauaaaaaaaauguauuuuuuucaauacuguauaaaaauaguauucugauuaccucccccucaauaaaaaaaaaguccagauaauugcuuuugauauugauggaaaaacuacaaaacagacacaacaaaccagagccaaguuuggggaacgggugugagcagcucuggcuccugacccucaccggguccgcuuugccccagugaagagacagcauuccuuccugugcagaccugagugcagaguguguccaucucggcguauggugaaggugucacuggguucugcagcacuggaguuuccaugaccgcucccacaucaccccacccucgacucuggcaccaguaugguucuaugcauguugcagcucucugggcugugacucuguuaagaagguuugccagcuuucuggcccuuccccgcuccuaguuacuagaugaccauacucauacuugcaaaggagaggagagagugcuaaagccugguucugacugagggcucugcgucccugcaguaaacaggugagaucugcagcagggcagggcugcuuuaacaggcagggguggcaguaagucacagcugcugcugcugucgucugcccgccauucagcuaaccguucuguugagguccugccuugugcuuuccuaguggaagccguccuuugcccccguugaugacuugagcccuugccaaacaaacaccgaugagugaaguggcugcaacuuggcagccccaaaaccugccacaccccugcaccccuggaagcccagcaccggggccagcaggcuguguuccgugcuugccaaccuagacccuggcauuagaaauuguuuugucagcagucucugcccucucgagagagaugagcagccucaacugacguuucuauuaaugaguuaucagaaguugcaacaucucuccagcacuaauguguuuuguccacuucaaacgcuguucuaauugccaaccggcugcucuaggcuccugaggagugucccuucucaaaggaacugcgcccuggaaagggcuccccgaaguucuagguggccuugaccugacacuugcauuuucuaggccacucuuugggguggcugagaaucaugacagacccucugccagucucuaguuucucugggucagguuucugaguacuggcauuggauuuuaagcggcaugugacccuuuguguuuuagugacucagaaaagucaagccauuugcaaaaguuagcaguuuguuuugucaacuuguaacugggucauagccuugcugagugaaaccaacucauuucugauugggcacaaagaacugcauucuuuggacgugugaauccauguuccucuuccucuggccacugaacaccuccaccagcucuuugggaauuggauggaaaggcggccccugggggccaggggugugcagcuucccacucacgggaggaguggccagggcucuugguuuagcaauuacacagcucuaggugcgggaagaaauggccuuuaauuacugauuguauuugguacauauugugugauacuugaagagauaaaagggacuuaccagcccuuaauugaaaucuaagcuuuuuaccgcuuuccccuccuugcccucucuccucccuucugcccuccuugcauugugaugaucuagugggcaugucugucaccuggacaauugccucuucugacuauaaccucuuaauaguuguguauaaugaaaacuguaaacuuuuuuaaauaaaauguguauauaccuuggcaaau

SEQ ID NO: 2881 - RNA, 53681 nt, Mus musculus
cagauguaccaacaccaaguacaugcauuguguaccuaugauguuucuaaaugcagugcuuaugggacagaauuccggaguaucgaccaugcugaggcagcgacccugcuugggagucuccucuggcguagccuccccgcucggucuucgacuaucuggucugagcccccagcaucccggagaagcgggcgagcuccgggaaucgaugcgcucucugagcgucugcuuacgccuuuucuccccccaucucuuuuagcuauagcuaugguuaccacgucucuccccgccucccuccaccugccaagaaagagacugcccauugguccacugucaccaaggcggccagccauugguugcuggagagcccggcgcuaccccggcccccgucucccgggucucuugaggagcccgggaaggaggcucggcucgcgcugccggggcaggggcuugccgggaccgggcugcggcaaucguuagcgggccaugucggcugcccagggcugggaccggaaccgccggcggggaggaggcgcggccggcggggccagcgggguuagcggggccggcgcggccggcgggggucggggcaccggacagcucaaccgauucgugcagcucucgggacggccgcaccugccaggugagugguggggccgcugccggcgagaagguggcggucgccgggcucugcugccccucggacacacagccgagggaggacagggaagcagagcagcaggaagguggcguugaggucaggaggggaaccggagcacgccgaagagaagucucgcugugucgacagcucggggaggagaguuguauuuuccucccgaccgagaggccgcugucucuuugacauucccaaauguuucgcuugcccgguucuuaaucuuuuccucuuccgcggauggauguugugaaagaaagacauugguguuuaacuguggaaaauuauuucaaaaggagugccaaauuaaggagaggagagcaauauagaagugauuuuguuugaaaggaaaaaaaaaaagccaaccaacugugucagaguuggauauuuugaaauggaaugagcaugugaaaguguguguguguauguauguauguguguguguguuggcuagggaguauaugggaaagaaaauaaaaaagauuaagggaaaugguugaaucaguaauauuuggggauguacagagacagaauggguaauggugacuagauuuuaaaagggggaaaugaagaucaugaauauaaagaaacgaaaggaugugaucccgguaucaaaacugaaaauuggaaaaauauaccuacugcuaaaaauuucauggucuuugaguucacauguuuuaaaaaaaacaaaacaaagucauguagguauguguguaaacaguuguaaaaagcguacguuuacaaauuuucagucuguuaaaagguagagaauuaaaucaugcacagaaugcuaaaucauuuuauugggcagucguguuuuuuuuuuuuuuucaccgugaagagaauugucaggaaugauguacuagaccuucgccauguuuuuuuguguaugugugacuaguguuaaguugauuguaucagugguauauuuguuuagauguuuugagaaccugauuguuucugaauuguguuuacuauugugacuuguucuucuaggugguaaaaaaaaucaguugauuaauuuaaagauaacaaaggggauuuuacuuauucagagagauaauuacuaauauuugugauaugguuuuugaugugugccagaaauguucauuaacccauuuguucaugccauuaaaauaaaauugagacauuuguaaauaaucaaauauaccauaaauuggauuugaauaaacaguaucagacugguauucuggaauugcuaaauaugugauguuuaacaagaaaaaaggagacauuuuuuuuuguuaucaucaguuaacaacaaaacccuagguuuucugcauuacuaagccuagaagauaaaucccuuggcaaggacuauucccaguuugcucucugccugcaaucuuuuaagucuuuggucauagauuaauuauuacaccaugaacuucaugugggcauucucaggguccugcaacauacuggugcaguuccucucugcuaccacaugagggcaggguaagccaugauuucaaauaagggucugaaguauggcgcuauuucugcauucccuuagcacaggaggacaagaacagccauuuguccagaggugaagauaaaacgugcuuaaacugugaaaauuggagaaguggaguugucagucuucguucugcuuccuuucuuccaggcuggcauucagcuccuucuucccacacaggcggucuccaucuuucccucguucucaaaauuagaaaauucccaauagcucaauaauauauguugauauaaauaauaaauucuuucauacuaauccuuuguucuccuagguacugcauauuauagcucuuuacucuauuuugaaguaauucagacuauuuuaagugguagugaggaauaggaaggaauguguaggucuguuuuauggcugacgcuagagaccuaucuuuucuuccucuuuuuuuuucuuuuugauuuuguguuuguuuuuguuuguuugguuauuaauuuuucaucucuuuugacuucuaucccuauuuuccaauucacccuucuuuacuaaggcuuccacauacuugaagaaccuuuuuucuucuuucuaacauuucugucuuguguccagucccugugaaacaaagcaguauaauauggugguguuccuggaguguccucauugucuuucagggauaguaucuuuugagaaaauguaaaagacaaaaaucuuacuauauagcauguagaccagcguggcuucaaacucaaagguaucuuccaggcucuacuuccugugcacugggguuaaaggccugugccuggcuuuggugguaggaccuuuauccaucuacuuaugggaaucugaaagcugggucuccuuaagcuccccaccaacuucaguuauaguuagcuaccuagucuuguucauuuuguuuccauuguaacuaauucugucacuguccuuuagggucacugcaguagcuuucuaagcagacuuccuacgucugcuagagccucccauucauauaucacugaucuuugaaaauacaaaucuuuuauuaucucugcuuauagccuuuuucuuuuaccuuuuuuguuuuuaacauagggucuaaccuuguccaggcuggccuugaaccuuucacccuucugugucagcuucuagaguaguggcauacaggcacaugacacuguaccuaaccuuucuugcugcuucauugcucucacaguaaggcugagacccuuaucguguccuagauggcccuacaccaagugccuucucgccuuggguuguccuccauuuuguucuguguucucugcuuugcuucccucagcacaggaagucacugcacacgggcgucucuccuggaggaacccgugugcuuccuccucuuauuuaacuuaccuuuccuggaucucaguuguauuuuuuuccauaagagccuucuuucaccuuucugacagcccuucucccuguaucacucauuuuuccuaagguauauauagcauuuguguaggaauauuguugggaaagacguacucuauguguguguguguauguguguguguauauauauauauauauauauauauguuauauacacauaaaccauaucugcaugcauguaccacaauguaauauauuaacaauuagugacuagggaguguagagagggcucagaaaucaagaagcugcucuuucagagcagguuuucauucccagcacccacagagugacuuauaaccaaccaucugcaacucugcuuccagggcaccugcuguccuuuguccuccacagggaucaggcguauagaugguguacagacaucuaggcaggcaaaauaucugaacacauaaaauuaagauuuuuuuuuuuagguggagaagugguggugcauaccauuaauuccaacacuugggagucagaggcaggugaaucucugugaguuugaggcuagcccagucuaugaagugaguucuaggacaaccagggcuacagagagaaacccugucuugaaauuuuuuucuuuuaauuuuaaaaagauuaaauuaauguauuggcauuauauguaagauauucauguauaaugacuugauugcuguacuucaguccugcauagccccacuggcucuggacaaacagauaauauugaguccuuaaaaguaucacguacuacuacauuaggcauuguaucagcacaguguuuuugaaauuuugaauauugccuugcuguucugcuaucuuuuuuuauuucuaaaauauauuuuuuucuuuaaaaacagaauuuuuuuuuugugugugugugcauaugcacucauccccuauguaugugccacaguguguaugugggugucagaggacaacuuuugggagucagguuucuucuucauucuauugcaugguccuaggacuagaacuugggucauuagauuuggcagcaagcucauuuaccugcuaagccaucuugcuggcccuuuucugcuauuuucuaggauacagcagugaugcuauguuuaccccauaggcuaagaacauuuuuagguuagcaauuaaaagucuuuauauaccuagggaaaauauagggaauggagcugccauuuuguagauuaugcauuuagagauagagcgcagagagcaagggacuugggggacagaguacaagguagcauuacauuuaauaugugaguuuaauuaaguaaaugugcuaguaggaaaaaauaguuaaacauuguugcuaacacagauaaugacaaagaggaagacauacuuaacaguaagcugggugaaaaaucauugugaaaucuuaauuuaaaaguuuuaaauaaauguaaaguucaagugguagaaaagaacauguguuagucacauaugguagugucugagaucgaagccugaggagaagaggcaggaaggccuggucuccuccacaucauagcugcauuugaguuggaggccaucuugggcuacaugaaaccuugucgcaaaaagcaauaaaacaaaacauagagaaggcagguuuucuuucugccuucaugaauauuggcuucucuccuuaaugauauauuucuugccuguuuuuuccagaaggggugugcauugugccucagguagagcuguuguauguuuagauaugccauaaggguccugccacagugaugccuugaguuucccuauaugucaggaauuucacacuuagggucuuuaucuugcagguaaauuccuagaagcucaguugcuaggccaaaggcuacucacuauuuaaaucuugauaaagugucaaauugcccuuuguaaagguagggucaguucauggucugaugacaguguuaaccugcugguggcuuuugcuugguuccuuuauuggaauaccaacccccuccucaucuuuguaauaacugcagauggaacccaggcuuuguacaugauaggcaagcaugcuacccagaagcuguucucccaggccagaguuuagauuuguuugugagacugggucucacucuguagcccuggcugacuggaacucacuauaugaccagacuggccucagacucacagagaucuuccugcuucugucucccgaguacugggauuaaaaccuuguaccaccuugaccuacaagccccuuguuuuugaguuaguguuacuguguugcccauucuggcugggaauguguggaaauccuucugcuucugcuucucaagugcugggguuacaagaaugcgcauuaugccuggcuaaacuuuuacuuucuauuuuuaaaaauguauacauguguuuuccuugcauguaugugucuaucuguguaccauguguauacugggugcucucagagaucagaagagagcaucagauucccuggaacuggaauuauugauuguguugugagccaccauguggauucugggaguugaacccugguccucuggagaagcagagccagugcucuuuuuuuuuuguuguuuguuugguuuuuugagacaggguuucucuguauaucccugguuguccuggaacucucucuguggaccaggcuggccucaaacucagaaaucugccugccucugccuccaaaauauugugguuuuauuuauuuauuuauuuuauuuuauuuuauuuuauuuuauuuuuuuccgagacaggguuucucuguguagcccuggcuguccuggaacucacuuuguagaccaggcuggccucgaacucagaaauccgucugccucuaccucccaagugcugggauuaaaggcgugugccaccacugcccggcuugcucagccuuuugaauccuuaguauuggugagcuggagagcuggcuuagugagcacugcuuuugcagaggucuguaguucaguucccagcacccacauaguggugcacagcugccugaaacuccagcucuaggagaugugugcacaugcacguacacauacacacacacucucuuaaaaaagaaauaggggacuugagagauggcucagcaguuaagagcacuggcugcucuuccagagauccuggguucaauuccuagcaacacaucaacucauaacauaacccuaugggauccaaugcccucuucugauaauacagacagacuugcagacaaaagacccauauacauaaaguaauacaucuuuaaaacagauaaaaagacguguguggcugcaggcuuuugaggguauuucuuucucccucucccccuccccucccccccccuccccgccccuuguuucuggcugcccuggaacuugcucuguagaccaggcuggucuugaacuccuagauccaccugucuuacauucauuucuugauguucacauuuccugcaauacuccagcccucuucacauuugcuuacuguugcgugucugugagcucacaugugccauggcacagauggagagguuagaagacagcuuuaggaguugguacucuccuuucuuuguguguguucuagggauggaacuuaggucaucaggcuucuggugccuuuaguugucacgccaucuugcugguacccuuuuaaaaaaaaaaaaauagguuccagggcagucagggauauaggagagaacaugccauauuuaaaauuuuuguuuguuuguuuuuugauuuuuugagacaguguuucucuguauagcuguccuggaacucacuuuguagaccaggcuggucucgaacucagaaauccaccugccucugccuccugagugcugggauuaaaggcgugcgccacuaccgcccggccauauuuaaauuuuuuuauucaucuauuuuuuuuaaauguaugaaugcucugcuuuugugcaugccagaagagggcauuagauccuauuauagauguuugugagccacuuugugguugcugggaauugaauucaggaccaaagaagaguagccaguucucuuacucucagagcccucucucuucuauuccuuuuuuuccuuauuuauuuauauguuucuauuuguuuguuuugcuuuguuuuucaagacaggguuucucuauguagcuguggcugucguggaauucucucuguaguccaggcuggccuugaacucauaaagauccucuagucucugucuccuaagugcuggaauugaaggugugcacucucaccaccugucuaugaccucaguccuuuacugugaucuuaguuccauugauuuucuuggcaauggcacaauuuuaugcuuuagagcucaagaauaauaccaaguguuaggauuaaaggcaugcacugcacaguccugcuugcucucgcucgcucgcacccucucucucucuuuuauauuuucucuuuuuuuuuaaagauuuguuuauuuuauguaugugaguacacuguagcugucuucagacacagaugguuggagccaccaugugguugcugggaauugaauucaggaccuuuggaagagcagucaguauucuuaaccacugagccaucucuccagccacccgacccccuuuaaagguugauuuauuucugugucuguauguuuaugugugugguucuguguagcaaugccugcacagaggacaaaagagggcauuggauauccuucucuuucacucugccuauuuuuuuaaggcaggaucucagcugaaguugggguuucuuuuguuucaaguaggcuagaagcagcaagcuccaacaaucgaccaaucuccgguccccuuggagcugggguuaagguauguuauauggguguugggaccugagcuuuggucuucaugauuaugaagcaaguguucuaauccaugagucaucuuucugaccccgacuucauugauuuauuuauugacauuuauuuguuugaguguacgcgugugcauuugugugcacacaagggccaggcuguacauguagaggucaaagaacaagucuuuugggaguuaguucucuuuucuacccuggggucccagggaucagacccagagcaucacgacaagcaccuuuaccagcugagccgucacggcuccccucccaugguuuguuuuuauccuucccauauuaauuuaccaaaucaucuguugauauguacuugggauguuuuuaguuuuugacuguuaaguguucugcugcugcguguagaccuguguacagaugucugguuauguguuucccuuagguaaauacccggaguacaauugcugaauuguacaaggacuggaacucaaguauuucuguggaauauguuuagccacuugaugaauauccagacaguuuuccagagcaaguggaauuuuacauuuccaccagcacuuuguccaucuucccaaacacuugucaucucacuuucugagucuuuauaccaacuauuuuaauaucugugaaauagaaucuuaacgcucuuguuuuuagaccaggucuucguguuguucugucuuagacuccugagcugaagcaacuucagccucaguggcugggcuguaggcguugcaccuuccugucuucauuguaguuuuugauguguuuuccuucagugacuaacaaugccaagcauguuuuuaugugcguguugaccauuugucuguggcuguuuccuuguuagggaguaucuuagucaggguuucucuuccugcacacacaucaugaccaagaagcagucggggaggaaaggguuuauucggcuuacacuuccaugcugcuguucaucaccaaagaaagucaggacuggaacucaagcaggucaggaagcaggagcugaugcagaggccauggagggauguucuuuacuggcuugcuuccccuggcuugcucagccugcucucuuauagaaccaagauuaccagcccagagauggucccauccacaaggggccuuucccccuugaucacuaauugagaaaaugccuuauagcugggucucauggaggcauuuccucaacugaagcuccuuucucuaugauaacuccaucuugggucaaguuuaaaugucccauccuguuuuuaauuggguugucuuuuuguuguuuuaagaguucuuuauauauuuuagacuuaaguccuuuguuuauauaauuuaacauuuauauguguguuuccuccuauuuuaucaguuucuuaguuguguugcuaaaagcacacacugaucuuuuacauuuugaugaagucuagcuauuucuuuccuuuuguucauguuuuggugugauuuacaaggauccuuugccaaauacaaggucauaaauauauaccucguguuucccuucagucuuguguggccuuguguuugucccuguacuuggugccagggucuucugaucucugucuggccauuccgaugucauuuguuuauagcacuuuucuuucacuucugaacgguacugucacccuuguuagaaaugauuugauuaccacgaagugggcucauucugauaucucuguucuguuccauugaucuguaugucugcuuauaugccagcaccauauuaguucauuuccugguacuuugaaauaaguuuugaaauaaagaauuaugagccuuccuauuuuacucuucuuucaaagguccauuuuguccauucuggcuuccuuacaauuccacaucaauuuguccaucagcacaaagcagucagcuaagauuggcuuaaccucacuuccccaucucuuuccugagacagcucaugagugcuggagggaugugucuguaccaccacugguagucucaugcuugcuuuuuguuuauguuuguuuuuauguuguuguuuuuuucaagaugggggucucauuauguagguaauucuggcuguccuggaacuaacucaugaucuagaccaggcuggcauugaacuuagaucugcuuggcucugaccucccccaaaacacuggaauuaaaguuguguaccugccuuaacucuugcuuuuucacuaagcucuuuuuuguuugagacaggguuucauacagcaaaggcugucguuaaauugagaacgaccuugaugucuuugcuucugaagugcugggauuauggagguuggucccuaugccugguucagacgguaggugcuagguauugaauugagugugcuagcuaugucaaagcccuaguugggugcuucuguacacauuuacucacaguguguaaguagguaaauucgguacuuauguuugucccccuuuuuauagguaagaacacugaggcacagaagguaaaacucuugucuaugaccauguaagccugaaagguuagagucaggcugugggucauccacuugacugcugugcugugcuccuucucagauuguuccuuucagcucacucuaucacuaccacaguuuaggucuuuacugccuucagcugcaguguauggacacacacacacacacacacacacacacacacacacacacagcuguagauauauucuguuauucuuagucuucugaucuacccgauguguugacgcagaauuaaucuugccucaagcacaacuauauauugcuuccuagaucaaaauucuauguugguuuccugccacauuuagaauccagccuggacuucugcuaucuaggauauaaucauugaaaguaagcuuagguaguaaagugagaaguauaaugacuaguaaggaaaugagaugauaaaauaauuuggaguugaacaaugccuuuugcuuuccuuuuuuauccauaguaacuucuugccauaugguuucauuauuaaacuaucaacuuuguuagcuugaaucagauagauaauugauuaaaugcuaaccauacauaccuuggugucacaugaaacaaauucuguuuuguuuuguuuuguuguucaagacaagguuucucuguguagcccuggcuguccuggaacucacucuguagaccaggcuggccucgaacuuagaaauccgccugccucuacccuccaagugcugggauuaaaggcgugugccaccacugcccggugaaacaaaaucuuuuaaaaauauguacauaaaucucauucaagacuguggaauuucuaguguggacucugauuuugauaauuucaaaagaaaaauagauuuuguuuuaaauacauuuacauauuaaacuacuaaggaaaacagcuuuuuuuuuuuaagauuuauuuauuauuauauguaagaacacuguagcugucuucagacacacuagaagagagcaucagauccuauuacagaugguugugagccaccaugugguugcugagauuugaacuuaggaccucuggaagaacagucagugcucuuaaccacugagccaucucuccagcccagaaaacaguuucuuaaaguuguaucaaaaaauuuagggacuuaaaauaaccaugguguguaccuuuuaucccagacuuaggagacagaggcagacaaguauaucucugugaguucaaagucagccuaggcuacaagagguccagaucaaucagagauacauagugaagcccugucucaaaaaagggucuaaauuaugauuuuaaaugaaacuugucugagcuuaugggaaaaauccucuaguguacaacauacugucuuuuaucauucugcuuuccaaggaaagaauagguuuacuuuccugaaauggcaucuaacuauguagccuacacugaccuguaacuuaagauccuccugccuuagccuccaguguaacuuggauuaggggugugcacauugugcuauucccagaaauagauauuucucaguguaguacuucauucugaagucauacuaggccuagguaucuugcuuacuuuggccauauucauaguucauacuuuguuuuauuuauuuauuuauuuauuuauuuauuuauugguuuuuugagacaggguuucucuguguagcucuggcuguccuggaacucacuuuguagaccaggcuggccucgaacucagaaauccaccugccucugccucccaagugcugggauuaaaugugcacccugcuuugcuguccuucucagcacugugauuauaagcuaugcacucuuacccuggcuacacgcuaccuuuugggguugguguagauacugagauugaacccagugucucaugcauguuaggcaagugauacauaccacuaagcuauauucccaguuauaucuuauacauacauacauacauacauauauauauauauauauagagagagagagagagagagagagagaaauuuuuuuagacaagcucauacauacccugaaacaccauauaggacaaccuuagcuucucaaaugcugggauuacagacaugggccaccaugucugguuuccuuauuaaauauuuuuuaaaauuaaauuuauuuauuuuuaugugugagugugugcauuacauuccacagugcauguauggaggucaaaggucuuucaagaguccucuuuuaucauguggauccuagagaucaaauucaaguugucagccuuuacccacugagccaucucuugaguccaucuuuuuguuguuuuugagacaggaucucacuaugcagcccugguugacucggaacucucuguguagagagacuugucucagaugcacagggauauggagauauguauauauauguauauaucugcucugccuccccaguucugagauuaaaaguauggaccaccacugcccaucagaauuuucucuuuaaagacuuauuuuaugauaugaauauucugccugcacgcaugcauguacaccacauguguuccuggagcuugugggggucagaucccugagaacuagaguuauggauggucaccauggugggcccuagacaagagcaacaauuguucuuaacugcugaaccgucucuccagcucuauaauuuuuuuaaacagaaaaaauuuuuucuguagaugaaagcauggaggugauccugaaucaagaagucagggcugagguuguagcugugaaguaaagcguguccuucguguauacaggauuguagaaucagaguaauaaagacggucaaacaccacuaccaacagagagaagcaagcaaauggacuuaguagcuauaggguguauuucauuguagacucaugugcagaaaaauguagacuauaacaaaggcagggguuuugcuuuuaaauccucaaacacagaaaucaaccuuauaaaucauaauguuuagaaugaaauuuuaguuuuucucuccuuugaaccauaagauguuaaaauugaaaaagaacuuagggggcuggagagauagauggcucagcgguuaagagcaccgacugcucuuccagagguccugaguucaauucccagcaaccacaugguggcucacaaccaucuguaaugagaccugaugccucuucugguguguuugaaggcagcuacagugugcucauauaaauaaaaauuaaaaguuuaaaaaaagaaaagaaaagaaaaggaaagaaaaagaccuuagaagucuuaacaccaauccuaauucagcaaaccuaauaaugguggcaaaccuuccucuaaaagcccuaaucuuagggggaguccccugcaccuacguaaaaagcuagauggguagcucauacuugcagucccagagcuguggaggcaaugucagaaggauccuugaggcucuguggccaaccagccuauucaaucagaaagucugggugccagugacaagguugacugcucaggagcgaugccugagguggacgucccugccuccacaugggcaccuuacccacugguacuccacacacuuuaacauguacccacccacacauacacacaaaauaaaagucucuuaauauguuuuguuguuacuaacuggaaccuuaagaggucuacacauuuggaauaaugcauuguccauuacuuugaaagaaagcuggcacacuguuuguaggucuuaauuaucccaacaguugucaugcauuugaucgaaacuucuguuaugccuccugguaggugucuucccuauaaugugcgaguccauugaauugcccucuugauaauggucauagauuugugaauguaacucuuuucuuuuuaauguaguuccauugacuucugagucuaacggauauucuucaggggcucuaucagauguuauguucuucuuaggagagagccagguuuuaguucuuuggaaacuaauuucuccagccugaguuuuaaguuuuauuuauuuuuauuuuauguuuaucuggcugcaugucuguguacuauuugcaugcaaugcccacagaggccagaaggagguguuggacacccucccccccaucccuggcugaauuacaggugguugugagccuccacauggguguugggagucaaacccgagucuucaagggcagcuaguagucuaacgacugaacugagaaggcuaucaucaaucugguuuuuuuguuguuguuuuguuuugcuuuucuagucuagugucucaacaaccauuguaauguguugugggaaauagagaaaucuuaaaaacuggaacuggcacguucucucugcccuggcagucuggccagucuguuccuaucucauggagacucucuggccuggagcuccacccgucccacuggcggguugcuaccacaccaguccuguacuucaaauuccccauggccuuugugguccacaucuggcaaacucaggcaucguucucucuugaacccaguuggaccaccacgugaaggaaaacaccacacaaacuuaguucagaaaugacaguaacucaauuguugggcacagcaauugaaauccuaaucuuguaaacuauacuaaaucuauuuucuccaguggggaauccuggugaauucgccacaauccgggagacaauaguagcuacaucuuguccucacguuaucuccgcccaaaaggaacauaauuccugcuuccuuucuuccucccucucuuccucuguccagcccggaagucccuccuacucgcccagagauuuggcuccuuuauucauuaggggauugguucacaagaacagcaccaggcccacccacaacgguaguggguaguucuaaggaucuguaaguaguugcaauuccuuugagaguuguaggauuugggggcuuaagagacugccaaaaggguuggaguuguuauuuguuuuucuuuuuuaguuuuaguuuuaauuuuuaaagaagguauguauaauuuauauaugcuuuguuugcauguauguaugugcaccacaugccuaccaggugcuccagaaggcuagaagagggccucagauccccuggaacuggaguuaaagucggaucucggucuucuggaagagcggcaaggguucuuaaucacugagccaugucuccagagguggggaggguuuuauguugaaaucuuggcagauauucauaaacaauaagaauaugauauuauuuuagaccagaguguucucagaaauuuuguauuuauuagauucagaugugaugcuucaaucuaacagauuuaugaauuauaauacuuuuugauuaacauauguaaauauguaaauuuuagcuuauuucucaaggauagucuagccaggaaucauucauuuauguagaugaauaucauuucaguuugugcccuuucuuucccccaaagacaaaaacuucucaccuaaugagcccacuuuuuuuuucuccucagaaaaaggaugcuuacauaauaaaaccaaaaugacaaagacuagcucaagauuagaagcuguuccucacuaugcuaugauuacuuuguacuuacagaagaaaugucuaugauagccugccuuguuuuauaaaaauuaagaauaauguugggggaauaagaaaaugaaagaaaacuacugagacauggcacgagaaagcuguguaaagcagaaaggaccaucaggcuguucagaaaggacaggaaucaagucaugggcaaguugagaacuagccaugucugcccgcuuaccuguuuauuccucuguaguccucacauaguugagagaauuucuaacugagucuguaugaaaccacagugcuuagcauaaauguauauaagcugcgguuaaccuuagaagaaauaacaugucuguuuauuuauuuauuuaauguauauaaguauacuauagcugucuucagucacaucagaagagggcaucagaugacauuacagauggcugugagccaccauguggcugcugggaauugaacucuggaccuuuggaagaacagucaguucucuugaaugcggagccaucucuccagcaccugagauaacaugucuaaugucuagaggcaaugucuuaggguuuccauuguuaugaagagacacugaccacagugaguccuuuuuuuuuuuaagauuuauuuauuauuauaucuaaguacacuauagcugggcaguccagaaaauuccuuuauuagauucauuuagucuaccacccuuaagccaugggcaaaauaaagacaaauucuuugcugugaugagacacaaguggcccuguguccaguuuuaagagaguccucauuucuacuuggaagaagccuguugagcugucucuacugaaggauuugacuucaucccagaauuaagcuaagcguguaguaguucuaggauucuguggugugcauuccaaacucuucugaauuccuccugcacaccagguacaaaggcuucugaaccagaagguagcuagcaauagcccuacuucccuagaagcagcucuguguguguguguuaacuuuucaucacuacaaugaacaccagagaaacuacuuauaaggagaaacguuaucuugagaugacuuaagauuugagauguuucuguuuauaguucuugguuccaugguuucuggggccaugaagcaguaaaggagaaugucugugucuuagcacuguuaaugcuaugaaaagacaucaugaucaaggcagcucuugaaggcuggcuuacaguuuugcggggccggggguaugugggaaagaggggagugggagagaaccugcguccaguuuugaugcucuggguggguggacaugggaggacugugcacgcuuuccacacagcccugggugggcaucuggcuauguuaagccacugaccccacacaacgggugguggacaaggggcagccccugguaccagguucucaaccuccggcaucccacacuggauacggcagaggaguagaaaacagaauaggggccccagggcagcacucagccuuggggaugaaauggggaaagggcagggggauagggaggcgcugggugguucccaugcaggcgaaaguccuuagcccgguccauggcugcagcguagaaggccuuuuggcggguguguguguguguguguguguguguguguguguguguguguuagaagaaagccuaccccaccguucaagcacagcgggccuugauggucagagacucaaugguuuuagagcuuuauuguagaaagacagggagaaaggagagaagguagaaaucugagagggagaggccggccauggccacguggagaggggaaaagagagagaaggaggacuagagaguaagaaagcuuaaaagagagagagagguggggccaagcagcccuucuuauagugggcugggcuaucuugcuguugccagguaacuguggguggggguggaaucuagaccucuccuguggggguuuuggggucaguaacuucgauaggagccagggguccaggagacaugaucuuaugccuucugacccauguagguggaaauuaccacccaucaggucccacugggguucaagaucuaagcucgacuggagaccaggcugucugugcauaaccccuugccccacacaguuucagagguuuaguucauuaucaucauggugggaagcaugaaggcaggaauggcccuggaacugagagcuuuacacccugauuuacaggcagcagggacaaaaacacucugggcccuguaucagcuuuugaaaccccaggccaccucuagugguauaccuccuuuucuuuccaaacuucuucauauggggacuaagcaugcagauauaugagacucugggggccauuauuauucacacuaccacagccuguucaggggucucuuuuccacucuuacucuaucuggauccuagccuauaauauuggucaccuacauucauagugggccuuccccucucugaaaacagccucacaaacacaccuuaaauccagcuaagcugaccucaagauuaacuauggaaaugccuugguaagcugaugcauuuuacccuucauaauucccuucugaucuacccaaguuguuccccaugucaauguuucauagauguaucuaucaguuuguuuaaccacucacugaagggaauugggguggcuucauauuuuaacuauagugaauaaguuugucaugagcuuuguguuuauguuuuaugugaacauaaaauuucaauuauuugggauaaaugcccaagaauguaauuaccuuguucuauaguaagcaccuguuuagccuugcugugauguccuuuucagagugacugugcaacccuuuccuuuccuuuccuuuccuuuccuuuccuuuccuuuccuuuccuuuccuuuccuuucccuucccuccccuccccuccccuccccuccccuccccuccccuccccuuucccuccccuccccuccccucccccuccccuucccccucccccuuucuuuccuuccucuuuuccuuuccucucuuuuuucuuuuucuuccucuuccucuuccucuuccucuuccucuuucucuuucuuuuucuuuuuggcaggcgagcguuugagacaggaucucacuauguggcccuggcuguuccggaacucacuauguagacuaugcuggcuucagacuuacagauauucugccucugccucccaagaccugacaguguuuacaugaccucguuucuaugcaugcucaccaauauucagugcuaccuuuuuuaaaauugugcuuguacugauuugaugcacaguuuugaaaaaucuuuuuaaaauauuuauuauauguguauggguuuuugccuccugucuucauuaggguuucugucgcugcgaugaaacacuaugaccaaaagcaacuuggggggaaaggguuuauuucacuuacauuuccauaacacauucuaucauugaauguagucaacagagaaggaaccuggauggaggagcugaugaacagcuugcucagucuccuuucuuaagggacccagacuaucagaucagagguacauacauacaugcacacaaacacacacagaccaccagcacagcauaacacaaacauaaauucucucucucuugcucgcucgcucgcucgcucgcuccgcucgcucgcucugucacacauacacacacacagaaaaugccuuacaggcuugccuucaguuggaucuuaucaaaguguuuucucaauugacguucccuccuuucagaugacugugucaagcugacauaaaacuagccagcacaccugacuguaugcaugagcacuguauaugugccgguaucccuguaggucagaagagcuacccuggaacuagaauuacauauggcugugugcuaccacaugggugcugagaacugauuguggguccucugcaagagcaacauguguccuuaaccacugagccaucucuccagccccuccaggucaguuuugagagaaacuaaaauuaaggacuuuuuagcaaaagauguaccuagucucguguguguguguguguguguguguguguguguguguguguuucuuguuugggguuuuguuugcuuggcuuuugagaugggggucacuauguaaccuggccuggaacucacuaaauagaccaggcuggccucagacucaaagaucugcuuguugggugcuaggauuaaaggucugcuccaucacacccuggcuuuuauguguauuuuuuuuuccgagacagauuuucucuguguagcccuggcuguccuggaacucacuuuguagaccaggcuggccuugaacucagaaaucugccugccucugccucccgagugcugggauuaaaggcgugcgccacacccagcucuauguguguguuuugagggucucccuuuauugagcccaagcuaauugcaguuaugaaugucaguaauuuguuauuucccaguuagcugaugccuacuaagcuuugaggcuuuccuggucacucuuucuuaugucgcguuauuauuuuuccauuccauauguauauguuaagugauucccuuuucagacuuaugagggagcaauuuuauuguguccuuacacauccaaaaugcccuuuuucauacaugaaaaagagauuaaguguagaauucuagguuuaaagguugaacgugguggggcaugccuaccuauaaccccagcccucaggaggcagaaaaggagacucauagccaacuuaaaccuggccacagagugaaaaucccaucucaaaacacagaacaacaaucuccaccugucccuuccccccaaaaaaugcuagguuaaaauguauguaguuguagagugaguuggaaagaugauucuugcuaccuguaggauuugcuugucacuucuccaaaauuaauggauaauagauguuuguguuuaacugaauucucacauuuauuuacuuauuuauuuauuuaugguuugucugacuauguagucuuggcugcccuggaaguuuguaucuagaccaggcuggccuuaaacuccugguggugguccuuccagcuuuggccuccaugugagugcuggaauuacaggcacaugccgccacaguacugaguucucacuggaaaucauuuguuuauguauguucuuaugucagucccucugcuuuaaauacuguaccauuguaaguuugggagugacgugucauguuagucuuccaaucuuuuucagauuguugugguguucugggcuccuuccauuuccauaugaagcuuaagauucauuugcucauuucuguaaugaaaaaaaaccaguacuugacauuuugauagagaucacuucucuuuguuaucuucacguuuuacuucugacuuguaccauguuugagucuugauuuuaugcugguucaugcuacuuugagaaucuuugcuagccuugcugugacuuucccucgguguuuugcacagaucccacuaauugugguagggaggagaguggacacuggaugagucauggugagggaguguaccugauauugaccauucucuaguguaacugcccuucaucugucagaaugcugauacccacagagggcucuucuuagagccaacggcucaucuuaguccuaccuggggagcauccucuuggucauugccaccagucucaucugggagcaaauaccucuucuucuuaaacacuuggcuccaggggacaaauaggugggagggguugaucuguaauauaacuucuguguaucaccaaccaccaauguggugaucuuuacagucuguuucagcucguucugcugccugccucuguaguuaacuuaguucagcuguuuaaaccagugaagcuaccgcucacccgcuccugguuguuagacugacuucugagucuguucucucagcuuucccuuucaucucuuuaucuuuccucucuuuaaaacugacuccucuuaguuuuagucuauuagaguauuuguuguuguuuuguucuuucuuguguaggccuuccacccccgaaaggauuucacucuguagccuuggcugugcuguagcacacucuauagaccacacuguccuuggacucagauccacuugccucugccucccaagggauugaaagcaugugcuuucucuguagauuuauaaaaagaugacauuauuuaugaaauuggggaaaagcugaguuagugugugucuugguaaaguuuuaauuuuagugauuauggugaagcaaauuuuguaaaaagaaaauuaaggcuaggcguggugacgcacgccuuugaucccagcacucaggaggcagaggcaggcgaauuucuaaguuugaggccagccuggucuacagagugaguuccaggacagccagggcuauacagagaaacccugucucaaaaaacaaaacaaaaauaaauaaauaaauaaauaaauaauuuaaaaaauaaaaagaaaauuaagguagcagauuagauauugguuaaaugacuggagaaaauauguuuuucuuugggaagguuuauuuuaaaauaagcacuaauagagauugguauuugcuuuauuuuuaccauaagcaguuuauguuuguguaaauguuaaugaauagaaguuuaggucaagaauaaauuuaugaaauuuaaaaggugugugauucuguaaaaauaaaaagugcaugugcacauuacuguuacguuguuguuguuaugguacugugcccccucccuccuucccuuuccuccccucccccuuuauucucuccccccaccccccaucucugcucuuugggggaagaagaacacauggauccuaaagucagcauccauuuugauugaauaacuuccaugaaguuagcauuagcuucaucugugacagaaauaauauguugguugcuaugagagaaacaugccaaagauguuuaacagaaguucugauaaaacaaaacaggggugggugcuuagguuuggccccagggcccugugcaugcuggccaaguguguguauacugagcuauacacucagcccuccaaaagaucuuugguuacagcuuugauucacuaauuuuuuuguuaucucuauauucuaagguaguuuuaaauuucacauggcggccagaugugguagaacauaucuuuaauucaagcaaggaagaggcagguggaucucugugaguuccagaccagccugguccauuuaguaaguucuggagcagccacgccuacacgaggagguccuaucucaaaaaaggcaaaaggaaaauucaugauuauguuauuuucuauaaauaauaugccauaaaaguuuuggcuaacauaagaagaguaauuacuccaaccuuagucauaacucacuguuaacaguuuugguguguuucuuuccaguacuuuuuuaaauuauauuuucaaaaauuaaaguaauaugauauugucuuuuuccaguccaaaaguaauguuuucuuaaaagcuuggaaaauaaaggcaagaacaaaggagaaaaaacaaaaucacucauaaaauccacccagagauaaucacaauuaaaauuugauguaaaucuuuuuuguacuuuucaugaucauagacuuuuuuacuaagauuauaucuuacuguaaugcuacuuuguaacuggcucauuugcaauauauuguaaaugcuuguuaauguuaauagccucauauaaacuuuuaagugguauguagcacaugaacguuuuuaaguauguuuaacuaacauacuuaaccaucuccuucuuguuggauauugaaaguguuuauaauguuuuuaccauuauaaauauuacuauaguuaauaucuuuguccauacaucuuuccaugcaucuaugguuguuucuuuaggaauagauuccuagaaguggaauagcugggucaaaggguauguacacuuuaacacuuuugauacauaaaaaugucaaauuguaagcuaaccacuuguuauauucugucuuguauugcuauucggugguuuugugugucuaucuugucuuucugcuuggagccuaggugagagagacuaagggaagguuauaauguguggugguauccuuuggcaguauggcucccugugcaggacucaugagucaucaaugguggaucagauugauucaaagcagcggcucagucuguauguguaaaauauauguguguaacuuuagaguaaacuuuuguuugcaaaguuucuauuuuuuaagcaaagauauguaaaaguauaaccaaugcaauuuucuaucaucauucucuuagaaaauaaagaauauuuaauaguaaaauggauagaccuuugaagagaauauuuuagcuuuuuuccauauauuucuccuuuuauauugggcugggaauuucacuuuaaccuagcagugaacuagagaccagcauuuggaaaccacagacuuaaaagauuugagauauugugcagauauauaauuuccccaccagucucuucuccccaguauugugaaggucauacuaagcagcauuuguguuucuccauguuagaguguuugaauaaacaagcuagaucuucugaugaucaucugaauauaccuccaauugcuuaaagcaaaccccauucauucuccuucuggggaauuggaggcagagaaggugcuauguagugggaagacaggaugcucaggcugggcccucacacuccaucagucagucaguuuccuucugcuuccucccucccuuacguguugacuaccauaagaucuuccagggggguuagaacccuugucacacuucccucaguguaauuauuagacaaguccuuugcuucccugagaggaguucuagguaggaugacucauauccuuuuuugcaacucuaggucuuaaaacagggaugcaggcauaguaggugccuaaaaaaaugagugcggagcuaguucugaauugcugagggaauuauaugaugcaauauaaguuuuaugugcuaugcaagcaauguuugguuuuuuuuuggcaagagguauuuuaaugcgaaguaucaaaacuuugggaagagagaaaauugauccuuugaacaguucuaugaguccauuacauuuuucuucuauguugugagaaaacaaacuguaauugggauucguguggggcugauuagcuuccuaggaggcgcauccugugcccuccuccccgugcugcauggaggcgcccagauaggaaccuuuugcuugacuugcuuaucaucuaguuuuaauuuuuaaggccggaagauuuuuuaaaauuuauuuauuuauuuuauguaugucaguacacuguaacuguacagaugguugugagccuucaugugguuguugggaauugauuuuuaggaccugugcucgcuccagucggccccacuuggcuuggccuggugugcuccggucaaaagauuuauuuauuauuaaacguaaguacacuguagcugacuucagaugcaacagaagagggcaccagaucucauugugggugguugugagccaccaugugguugcugggauuugaacucaggaccucuggaagaguagucagugcucucaacugcugaggcaucuugcuagcccagcagauuucuuauuaaagguccguauccauugcuuuguaacuaguaaaaacaaaacaaaacccuugagcagaggagccugugcugugccugaugcuuuuggguggagcuccuuuuggcuuuauuggcuuuaaaaggcuguucugucuaaucgcuucuaaaauuccugguaaauguuugccgcagacggcauuggugaugauuugaggcuguugaacagcuuuacaaaggugcacauaauuguguuguuggggauaagaguugaaaacucugaccacugcuuauguauuaugucauuuuaacuuccagaguuaaacgagacuuuauaucacuuuccuucuguauucaaguauuguuuuguuuccuguuuuucugucuuuauaauacaguaacuauguauuacuugccauguguuguaugugucugacuuacugcugauaauuguggugacagguaagaagaaaauacggugggacccaguuaggaggcgcuucauucaguccugucccaucauaaggaucccuaacagguucuugagaggugggugauaacaggcaagaggucugugcuuccuguggguugaagggaauuuugaauggauuuucuaaauucaaaacuguucucuuuaaguugucuuaacagccaaaauugaagcaaaaagucuaggccuuaguuuuaaauuuauguuuuauauugaccacuguugggauuauaaugauaaguuuuggggaaguuagauucucuuaauguaucuuagauaguagaguagauuaccucacuaguaucaguggcagaccaccauaaccacaucaaaaaaccuucaaguguaggaugugauucuaaggaagaaccaagugaugauaugauaggcuaagaauucuuuguaucaagcaucauagauaaaaacauagccaugggaagcauuuauaacaggugguuaaucugaauaauaaagagcucccaggaacuaguagucuauacuaaaaaauaagugaaugcacaugaauaguuaauacauagcaaaugguaguuggggagggcaaaauggcucagaggguaaaagugccuguugccaggcucagugaccugaguuugaccucugggacccacaugguaggaacagaaaugacuccaaguuguccugacuccacacaugugcuguggcacagcauguacacacagccacauacaacacauguaauuuauaaauaaauaauauauaaauguaauaacaaguucaaaaacaaaugccaguaaauauaaacuucauuauucauuacugucacaaacacaauaaguaaaaugggaagacuaaagccauccauguuggcaagggucuaggaaagagagcuuaaacgugagcuuuuaugcagucuuaggacuaacuagcaaacuguaucaccuuuaaagcugcugaugugucugacaggcagcuuuucuucuuagaguucgcacucuuucuacuaacuacuuuucugucagcuguagacuguucugaauaaaaagaaaaaucuagcucacaguuuuuccuucuuucuuguuuuuuagcuauagcaaauuaucagauaagcaugcuugauguuauaauuaagacuuacuaaauuacuuacaagucauuccucuaauuuuaacugaagagauuaaauaaaaaaccuaagcugcauggagccauguaaaccuuuaaagccggcagaucagugaaugccaagccacauagcaaguuccagaauagccagggcuagacagaaagacccuuucucaaaaaacaaaaacaaacaaacaacaacaaaacccaaaaccaaacaacaaagaccacuacgguaaaucccacagcugcuauagaugucuccauaucuaguuuuuaacauauuuuuagcagccaaacccuggaacaugaacagacuuaaaaccaggccugaaugggucaagauaagaaauucaguaauagcaaggugccucucagcagaauaauuguuauugauaaaugucaaagguacuuuaguaguguguuaugggaaaauaauacauauaagugcaagccaggcgugguggcgcacgccuuuaaucccagcauuuaggaggcggaggcaggcggauuucugaguucgaggccagccuggucuacaaagugaguuccaggacagccagggcuauacagagaaacccugucucgaaaaaacaaaaaacaaaaacaaacaaacaaaaaacauacaaaaaaaauauaagugcaaagagagauguuaguucuguaauauuuucuuuuuaaauuaaauacuaacuuauuaacuuuuuuaaacugagaaauuuaacuuagucugaaauaagcauaaacuaggcuucauaagcaauguagcaauauuuuaaguacucauguuuacuaaauauaagcauaauuaagaaguaauuuaaggccaggcauggugguucaggucuauaaacccugaauuugggaggcugaggcaggaggauguccuuuuacaguauaggccagccugaguugcauggugaauucuaggccauccucaaaugaaacucugcagagugaaacugucuaagaaccagaacaaggguuagagauacagcuuaguuggcagggugcuuaaauggagcaugcucagagccaccuaaaaaccccugguccccagcaccacauauaacaccaaguaugggggcagggggaugacucaagacuugacaaccaacucacaaucccugggagccacuacaauaaaauucaaacaaacaaaauacuaccaaagcaaacaaaggcaaaaaugguaccacuuuuaauucucacacuuaaaagggagguggaggcaagacgaucaguucaggguugucuccagcuacauagugaguucaaggggccugaagcacgugggaccaugucaccaccaccaccaccaccaccaaaaaaaaaaaaaaaaaaaaaaauugggacauagaguuuaaugaaaaagcaguuaugugaguggagagagggcucagaggauaagagcucuugcugcuuuugcagaggacccuuuuggguuuccaucacccgcaugguggcuaacaagcacuaaaccacuuccagaggaucugacgcccuucuuuggcuucugcaagcauuaggugugugugcacuucacauacuugcagacaaacacucaagcauauuuuaaaaaaacuuaaaaauuguguaaaauccuauacaaauauaaaaugucaaaagaaauaguaaaaacaaauuugguucuaucuggaugguggguuuuuuuuuuuuuuguuuuuuguuuuguauagcuuccauuuaaaaaaaaaaaaaaaagaaucauggggguaaaaaacaccgcacagguaaguuuuauaccauuggagauuuguaaguccuaaauucagagaaauugaggaaguuggugguagauaaugcugagcagacugaagcgggagcaggcucagcauugggguguaaggaucaccacuagccuccuuagaagcagaggccuugccuugucugucuucucuccuucgacgaguuucaguguuugaugcuguuggccuccugcaucuuauucacguuucucuucccuuuggaucacagugcuuuguaugauccuagauguuuucugcuuccuccucuuuguccauuuuguucucuuccguguuuucuuauuucuacccauuaaagguggaaacucaguguucuguccuuucccauugaccucuggccgucccaucgacuuucuuagguuuaacucuguucaccauucaucccuucacucgguguuucugguggcucuccaugaggcaguuacugugcuugauagauugaugaugcggagcuagagaaccaggugaacgacagcugcagagugauuagaacggaguuauuugugacaguguccugauaagguaguggagcacacacacagguuucucaucagcaaauggugaagacgaugaauaguaucauuugguuuaucagauaagucacuuaaaccuaagaggguuuuuugagggaaggguaauugcagacacagguaggugccagauagcuugaauaugguguuuguguagaugcuuucaaaggucuguagaaaguuuagcauaaugggaaauggcagccagaaucuguaaggggccagauagaucgaguaccauugaaggagaguuuuucaugaucagacuuggucuuguagcuaguaaagagauaaugacuacaguuaccaaggugaggaaaccugcauccugaaaugaggcagcuguaguagggaugugggggagguacaaacuugaauuaugcauggugcugaguuagagccuagaucacuaauugaagaguaggaggggaaaacaaggaaugacuucaaggacuggcugcagaguggugccucagugggcacgaggcggacacccagggcauacauacugaaggcaggcagaauacucaugcacauugaauaaaaaucaucuuuuuaaaaagugacuuccagauuuucuugugugacacuucuugucauuaagcguggcauggauaaucccagggcagaguuugggaguaggugauaaacucccauugauuugcaaaccacuaguugauuaucccuuaacacuuuuaauaaguauuuccagaaaaaccucugauucuuuaacaguaagucuagcaguuacuuccaggaaaacuuggaagaccuguccccacuuuguccugaugucacuuucuguguacagccuguaauagcaccagcacugaccacauggaguucuguucacuugugugccuccccuuggguuguaagcucuuccaggacaggggcagugggacuucagcugcuucugcaucuccguuugauaguacagugcaugugagagguguauugaguucgaucuaauuauaaacuauaaagaauuuauuuuuauuuguuuguuugucuugaaacaguaucucacuauguagcccuaucuggcauagaaccuacucuccagauguggcuggccuugaccucucaaaauaaaugagagaucuggaauuuaugcaguacacucauuuugggaaaauuaguuggaaagguacuucuggugacauaaaguccaaauugaggaauauuugauuauaugaaguaguguguagagacucuacuaaaacuuagccgugaagcuaaauacaacuauagauauuucuaacaguguagaggaauuguguaauauguguguauacauauguauugcauuucuauaacuaagauuaaacaguuggaacuagugcuaaaagucucauaauuuuuuuguuuagugaauaaagugcuugccuaaggaccagauugggucccucaaaaugucuguaaaugccagggggcacagcaggcugccuguaauccugguucugggaaggcuaaggcaguagguccaagagcaagcuguccagucagacuagcuggaugagaaaugaacagaaagaguuuuccucagucagcaaaaagaaggaagucagccuugggccugccuucaugcacacauaccuaugcccuuacacacaugcacacacacacauacauuagugaaaauaaaucuuaguaaaaguacagaauuucaguacugaaauauauaggugagaagugagcauucucauuucaggaauauaccaugaauuuaugcaaaucaggauuuauaaaagacaucucuauaagaaugugugcagucuggaguaggcauuugcugaaugaaauuccagauggccaacuaacauaaaaagugcucgacuugguugggcauggugauguauaccuucaauuucggcauucuuggaggcagaagcuagaggaucucugggaguuaaaggacagccugucuacauaaugauuuacagaacagccagaacuacacagagagaccucaucuaaaaagauuuuuaaaaagugcccaauuucugggcuggagagauggcucagccguuaaaggcuaggcucacaaccaaaaggugcccaauuucaucagcaaugagaaaaauguguguucuaaugugagauagguuuguagacuaacaggaaguacuaagugggagcagugacugccaaguauugacaugaacgugggauguucaugcuguugguuacuacgggaauuguucuagccauuuugaaaacuauggccucaucuaauaaggauuuccuuuaagacucaggaauucagucucuggauuuauagccaacagcauuguggcccccuguucaccugaaaacauguaugaaaauguuucuaucaauaauaggccacagauugaaagcaccuaagugucuauucacagaacuagacuaagugaguaaacugggcugcccacucagacagagaugccacucaacaguggagaugagcagacugcgcacaccaucuucaacaacaacagaaagggagccuuggaacaaucauaaauaagaacccaaaagaauauguacuauaucuucuuauuuugguuuuuugacacagugucucuguguagccauggcuguccuggaauuugcauuguagaccaggcuggccuuuuaacucggagauccuccugccucugccucccaagugcuacaaaggcgugcgccaccauccagcuacuguaucauuuuauuauacacuucaaacauuauuugggaaugcacacuuagauauggcaauguauaauaaaacuauagagagaccacucguuuuaugauugacagaaaaauuaguggguuggagaaauggaucagagauuaaaagcauugguggcuuuuguggaggacccagguuugauguccaguaucuguauagcagcucacaauaaucuaagguaaagaggugcaucggagggugcugugagcaugaagggagggcaagcuucuggaaguugguaguaccuacacuaauaggcucaaagaaaagcaugacacccccauaaaaacuuaacaaaaauuuaagcauucuuuuuuuguuaaaauguaucacacuguggccuuauaugugucccuuucuguauguaacauuucaguacaaauuuuauuuuaaaaauauacccuuuucuaauaaggaacaaaaucuaaugauuacaagaaaccaagaggaaauaacuaauuuugaagugaaauuugaccaguguccucacugaauuaaauuaagcaagacuaaucucuucaguaucaucucuucuauucaaccuuguucuguuaaauuucagcuaaaacuugaauaggauaaacaaaaaaauguauuugcuggggagcuggagagauuaagagcacuugauuaagacccugauuuguuucucagcacccacauggcagcucacaauugucuauagcuccaguucuagaggcucugacuucuuuuucugacccacuuaggcaacuugguauacacauaguguacguacauuuaggcagucauacacauagagaaauaaucuuuaaaaaaaccaauuuucuggauugcacccuggggaagcagagaaagaagaucaggaguuugaggcuugucuagaugugguggugcacgccuuuaauccuuucacuggagagacauaaacagguuuuuaagcauuuaaggcuagucugaucuaaagacuguauuucaggucagccaacucuauauagugagauccugccucuagagagcugaaggcuggcccagacuguauacugagaccccgucugaauaagaagauaggaaggcaguggugcuuugaggugugugguucaguugguagcacacuugccuuucauccaucccuacacugugaaaguggacauggugacccuaucuguaauccuagcgcucugaaaguaggaguaggagggucaguagcuuaaaucauccugggcuacuuaagacccugucucaggacaagaucaaaauacacacuuucauacgcauauuuaggauuguaaauaguccaguaauauagcucuacaguaguuauauuuguaaauauuugaaaugcauguuucuuugacccaaaaauucuauuucuagauuuauucauacauuuucauaggaauauguagaagaaacuuuaguccaguauuacuuguaauaaugagaauauuggaaaugaccuaguaaucuguugcauaaucucagagaacuagcugguuucugcuacaaaaucaaacccaccucccuaguuaccauaacuccuguuuaccccugaguuagaacagaugcuugccucgggaaagaaaauggcucagcuguccaggucccacagcuacguguaugugucuucugauguucagaucaccucagcaugcagggucauuugucauuccucacuuacacacacauuuuuacauuccgugguguguguguguguguguguguguguguguguguguguguguguguguguguuguauguuccaggaguuggaugcuggucuuuaggcuuggcucugugaaucuuuacuucugagcucacucugaaaccuacuccucuguuuucuagugagaguuuuggaagcaggcaauccaaaccuguggaugauuguaucaggggaaaacuugguggaggacucagagacuuuagacuaaaacuaaauuucauuuugucaaggucaaggagcuggccacaugugcuuggcuucugcccugacacauuccugugguuuuuuaaaaaugaaaugggagucgggcgugguagcgcaugccuuuaaucccagcacuuggaaggcagaggcaggcagauuucuaaguucgaggccagccuggucuacagagugaguuccaggacagccagggcuacacagagaaacccugucucaaaaaaccaaaaaaaagaaaaagaaaagaaagaaauggguuucugcuauucgggagucacucuugggcuauaggaagggguucuguggagagagaacuuaacucugucagcucuaaaggcuccuugacagaagguucagcauugaucagguacugaucacaugcucuuacccagccauuuaauuagacuagauccggagaacagcagaaguuagcaguuagauuaacucagcacuaucugggagacacaggagcuacaaacuuaaaguuuuguagcagccacaugaaaaacaagacauuauguuaauauuuuuauuuaacccauaucauuuuaucauaucauuaacguagaacugguaauuuuacuuuuucuguuugguugguugguugguuuuuuuuguuuuguuuuguuuuuuugagacacaguuucucuguguagcccuggcuguccuggaacucacuuugcagaucaggcuggccuugaacucagaaaucugccugccucugcuucccaaguauggggauuaaaggcaugcaccaccacuccccaacaauuuuacauucuuuuagggaugcuaaauuuuugaacacaaauucccguugggcccagccacauuucaaguauagccaggaauuacugcauuauguugggcagagcuaggcuguaagccccagagacagugucacuggcccagaaccugucacaauaacaguucacagcuguuguccaguaauuuuugggcuuagaaugaaugaauggguacauuuuaugucaaaucaucuuuucauuuugccguaguguuugauccacauguuauguucaucaccaagauggcgguaagccuagaccauguuuucugcucuguguccauugaaaguucuagaaugcuacugucauucuuuucacauuuucccaauauguaaaaccuaaacaaaaaacaugagagucuuccuuccugaccagugagcauagcaacuguuuuacguuugucuugcuaauuccuagaugcauguaccuugcaaagaucauuuacacaaucuagccauccccuagucacacuugcccucucccccuucuauucuuuuggugcuggaguuugaagccaggcuucccacaugcucagcaccugcucgcuguugagcuccacaccaucuaucuuggaaauacugugucagaguccacagagcuggucauuguuuuaaucaucccugccacuguuuacuuuggccuaaaguuaaacccagggaaacuuuuagauauguuguauuuuccggcugugucaggugauguggguaaugcaggauaauuguacaugcuguuugccuuugaggaacuuuuacucuguuugcaauaaaaaacaaacagaugaaacgaguggagaggaaucaguuacaaaccagcuccauucucaacccccuucagugucucaugugagccucacacuagguuacaggaacgugggugcaccugcauuucucuuuccucacauagcuccccacuaccugggaagauagacguguaagccagugagcguucaacaauagcacaucugcgagguacagugguaccuccccagcacagaugaggagacagauucaguggaagguugugucuacaccaagguccuggacgaaagaacuaggauguccugggagcccuugcucggucucccauagcuuacucuccuguuuucagugagccagacagaaacuuaauucuucacuuacaccaaaucauaaaucaguugucaaugccuaguugccugaauucuacuugccugguauuggacucauauuuacaaaauacaguauucccaucucgauaacuuuaggucugcccuaacauugaacggaggcugcugauccagaagaaccuaaagggacauaugguagacuugagagcauuucuacacuggagaauuagagagcaggucgccuaggccaaggucaaaggaaggacuccaggcuugcugggcagugaggcuaauagcucuagugaguaagugaaaggaagugguuuagcaucagagggcucugagaugcuuaaccuaggccuuaaagagcugucagugauuuacacacaggacugacaggacaagagcgacuaaaagauacauuguugcuuuguuuuucagguacucuauuucugugcauagcaucuuaauucuuguuccaaaguuuaucauguaaaguagaguuuuugcuuaaaaagacacaaaaggccuuauuagguugguaauaaauacuaauuaguaaagcauauuaggugucuggcagugugcuaaguacugguggacauuauacuaucaucaguagcacauaaaauagagauaucuuuaggguaguaacaaauguagugucaucguaguccauauccuauugcagcuuguuugguucuguaacuauuuaaggacuucuggagaccuguguaagaaguuguaaggauaauugaaauauaaagaaguggauuuuuuuucucccuuuaaacugaucucaaaauuaguuuaaaugaauuauguauauaauucagucauuuacuuauuguauaccagguauuuagccaagggccuuaaauaugcuaggcaaguacucuacucacuggagcuauauccccaaauugccuagguuguucuugaacuuaugcugugagcccaggcaggcccugagaugaugggucuccuaccucagccuccugaggacuuuugauuccaggcuugugccacaggucuagcuggugacggaacugaaaccucaggcuguagcucagugauagaaugcuugcuaacuaugcauaaggcaagcuggauucuugcuaucauaaagaaaaauauuuaaaaucuauaacuugcuuccuuccuauuugacaaacuuuguccuuuucagggaggguuguggggaaggguccuggaguccuauccagaaaaugcugucuuuacccauaucauggaguauuucagaggucaggucuuaccuacaguuuuuuuaauuuuugaucauuuugaguuuaaauuuuuuucauaauagcuuuucuuaguaauagccuuaaacagaauauaagauguccuuugggauaaaugcaggauuuucuuugaaaaguuuuggaaugguauucaaaguuuaauuuugcucugagcacacaagagccaguuuucuuuuuaagcguauaauuacauguauguguuuauuuagacaugacucacacauguuugugauugcucucuccaacagucacaguuuaaucuagcuugccucugcucucaccuaaagaggaagagaucugaucucugaccuuagcgucugaagcacuaggccucucuugcuucucuugaauuccauaucgucagucauuuucuugaguuuaucaugcugugucaccucuccugggaagaaucuuuuagucuuugaaauuuaaaaaucguaggaaauaaaaauggagacuaacucccuaaaauccuaaguagucuguguaagugcauacaauaagcgagguaaaugacauacauguguauuaggaaucacccccccccccccacucccuuuggaaguucagaugguuguuacuaauucuguuuaugcuccucaucugaagccauuuuuggaaaaccauccucuucuucuuuaggccacagaccucccccagcccgcaguggacaccguuguguggcagacaauaccaaucucuauguguuuggaggguauaacccagacuaugaugaaucgggagggccggauaacgaagacuacccucucuucagggagcuuuggcgguaucauuuugcaacaggcguguggcaccagauggguacagauggcuacaugccccgggaauuggcaucaaugucacguaaguaccagcaguuuugaaguuuugacuuugugaacuaucugaaauggcagguuuggugucacuuguucccuucuuaauaacguacacuguugcaacaugaugaaguguagucacggaacagguauuucacuguggugauaauacaguguaaugacucugaaucgcugcguuccuggguuugagccuaacuguauaauuuuggauugccagaugaguuuuuaacuauuuaccuguaaagugagacuaacaccaucucagguucaauauaaaguauuacauauauccuaggaaaaauguagucaaaugaaaaacuggaguugcagcuauaguaauuaauagcuauuaaaugaaggacuucacuuccuuacagcaucauugugauacaaguuucuacagugauugccauuguacaaaugaagaaccaacauuugagaggggcccugagaauagauggcuaaaaguaaaugcucugaagccagacugcuugggauugaauccagcucuuuuuaggaaaccuucagcaagcuauuuaaacucuuuuuaaccaguacaauggugcaugccuguaaucccagcacuuggaaggcugagacagaaggauugcaaugaauuuuaggcuagccugggcuacauagugauucugaggccagccugagcuacauagcaagaccuuaucuccggaaaauagaggaguuaaaaaaacaaacauugauuacuuuuguuucuguuuagcaucucuaaaaguggaaauggguucauugcuuaaugguggagugcaccaagcucuggaugcagacagaaagggagacaggagagagaggaaaguaguaaugaaagagaaaagagaauaacauuuacaguuccagccucagggguguugugaaccagcuuuccuaaagucccacuagcauuaaauccaacuccugacggcacuggguacagacuccacuacugcacugugugaauuaaaggguuguggggagguuuuauuuguuuuuguuuuuugagacaggguuucucugugaaggccuggcuguccuagaacucacucuguagaccaggcuggccucgaacucggaaauccaccugccucugccucccaagugugcugggauuaaaggcaugcaccaucacgcccggcuuuaaacuauaguuucugccaguuuaauccucuagcagauaaaaagaaacaccaauccugcaggcaauuuugguauucuaccuuucucuuuucuguuugccacacuguacacaaucgucccuuucuccuucccucgcccccucucauuucaguagcuccucaacuuccccacaaucgcagggcagugguggcgcacgccuuuaaucccagcacuugggaggcagaggcagguguauuucugaguucaaggccagccuggucuacaaagugagucccaggacagccagggcuacacagagaaacccugucuugaaaaaaaaaaagaaaaaaaaaaaaaaaaagaaaguauaguuuaaaauauaaagaucauuccucuggcagagaaugagcccuuaauccccauuccaguccuauggggucuuuucuaagacaaagaugauagaucauuuuucccguuuuucuguguuuuugagcugucuugaacagcaaugguauucuguagacuugacauugcaaugcacauuauuuuauuuagugaauucuacaagugcauuuuggcuguguaucauauaucuaacagugagccgugugagagagauccaucuaguauuaacuaagacauuucuuuugcaaaguccuauaguuagauaugugugaucuuagaucauuaaaguagacauguuugagccucucagguggucugggcucaugggcaacaugcuagagauagcagugcacgaguggaaugugugcuucuuccuccccaguugugcugcauggaaacaaccuguuaguguucggagguacaggcaucccguuuggugagagcaacggcaaugacguccaugucugcaaugugaaguacaagagaugggcucuacucagcugucgggggaagaggcccagccguauauacggacagguacugccugcuacggcagguccacggcugugcgcuugccuugugcuugccucauguuuugugcucuagcagcagugucagaauccaguguugcugugguugcaguggagaugggacuugauggggcauuucacuuccuggugugaaaguauaauuuauggaucuuacauuccccccucuucuugucaccauucugcgcuguguguuggguuuguuuuccaaguguaggcgagaggacagccucagguauuguuccugaggagcuguccaccuuuugauuuuucucucuuuuuuuugagauagugucucuggcuucuggggcuugcugaugaggccaagcugccuggccagugagcugcaggggucugccaauccugccucaccagcccuguguguacaaguacaucugaccgcuccuggcuuguuugguuuguuguuucgcaaaggugcuaggaacugaucuugggccuuaggcuugcacagcagcauucuacccaacaagccaucuucccaggaccacuguuugcuucuaauccaacuugaaggucgggagcuagaucuacuuggaaauuuccuuaacuacaccaacccuuaguaacguggagcuuuagcauggucugaggcuggucugaugacagaacucucugaagaacuuuauuccuaagaaguauagcucauaagagacugaacaggaguuugaacuaagacacguagagauuguguagguugguguaaagauauccggaaagauagugggcugcccaauaaacagacuuuaagacaaguggcugcacuaacaguaagcacugcguggcaucuggcucagcugucuggcacacaggugugguuaaacacuccugagcucuaacuuugaaagggagcgucccuagaucacgcugugucccagcacacaggcucugagaagcagccguggcagugcuuccgagugagucugguggagagugccagcucucucugcguuucauacucuaggaugaugcuagcuuaguuuccuguugcugcugcuuggaguguauuucuucagacugcuuagaggagaagcagcuuucaggggggugcuccuguucacugucccuacagucgugaccuuuaagagucaucugacagauuccuuucuagguagaacuggcaaagcuucaccuuuguauaggcgaggggaaaacagccccugaguucuguacaaugcuuuagucguuucuucauuccuucguggacaagggcucacguguugcuggucccagcuugagaucaacuucaugacaguugggaugauaggcauauauuagcucaccuggaugaagggccugaauuuuaaccuuucaaaauuguucauuuauuguuauuagagaguguguguguugugugcguguguguguggguguguguguauaugcacagaugccacacagcccacagguauagguuagaggacaacuucugcagguugguuguuucccgucacuggauucuggggaugagcucggauaucaggcuguaaggccagcacuuugaacuuaguggucaucucgccagcccuuuuaccuuuaguuuuuugagauuuugaugugauuuuuuuuaauuuguuuguuuauguuuccuuuuuguuguuuugucuuuuuugcuuguuuguuuuguuucauuuuauuggaacaaggucucacuuuguagcucaguuuguuguggaacucacuauggagccccuaaucuauccucagacuucagaucuuguugccucagccuccugaguacuagaauuauaagcaaacacuaucacaccugagucaaaauuugacacuuuauuuuauuuuuagauuuauuuuauguguaauguguuuugcuugcauguguguguacuacgucuguauguagugccaaaggagaccaggcgagggugugagaucucuuggaacuggagguacaggaugucugugacaccaugugggugaugggaacugagcucagguccucugcaagagcaaccggacucaagugcugagccauugcuucaaccugguauuuuauuuuuguuuaugcagugugugugcacaggugccuggggagcugaagucacagguggucaugagcuacccaaauggcuggugggaacugacuccagcucucugggagaacaggaaacacuccaacuacggagacaaguuucuacccaagauucacauagcuuaaaggcugaagaagaagaggccaggaggguggucaugcacacauuuaaucccagcacuugagaggcagaggcagauggaucucugaauucauggccagcauggucuauagagugaguucuaggacagcuggagcuacacagagaaauccugucuugaaaaacaaaaacaacgacgacaacaaaaacaacaaacaaaccuaagaaaaagccaaaagaagagaauucgauaaaacacgguuuggggacaucugugcuaaaguauuaaggaguuuuucucacucaccuuccacaggccauggcccucaucaaugggucccuuuaugucuuugggggaacaaccggcuacaucuauagcacagaccugcacaaguuagaucucaacaccaugguguggacacaacucaaaccaaacaaccuguccugugaccugccggaggagaggugaggugcggggacugagcgcuagccuuucuugcugaaaucugaccucuuccagagccuuagcaacaugaagacagaaagucgcuggauccagaguggauccagacuaauagagaagaaaggucugcuaaugagaauagaguauuuuccucuaaguguaacauucuuaauauaguauuucuguuguccuuuaguaguaagaggcuagcaauguuugaaagaaaccaauaguagcaguuaccacuaaaagucauacugagggccagugaguauugacuggaagagaguauucccucucuucagacugacuggguaucuuuuguugccuuaaacaucaugucugcauuugcuguacucuaguguccuugcaguaggaugcugcugggcugccugggagggaacuugggagauggagauggucaguaaggcaguucuuuggauauaauuuaugcuuugaucacuggggcauuccagggaaaggcaagcauuuucacauaguggccuucuauauacauuguugccacugggaaacugaagcaggaucuucuuaccucagccuuuaaucccaguaccgggaagacagaggccagccuggacuacagagugaguuccaggacagccagggcugcacagagaaacccugucucagaccacuaugccacccaacccccgccccaccccuucgucacucaaaaacuaaaaauaaauaaaaagaauuccaauucuaaagggcuggggggaugguucagugguuaacauggcuuccagagcucuugaguucaauucucagcacccacauggcaacuuacaacugucuauaacuauagucccaugggaugccauucucccuucuggugcucagaguacaugcagacgaaacacccagauacaucaaacacaucuuuuuaaaaaagaaauuccaauucaaagaaagccuguacuagucaggagucucuagaagaauagaacacacacacacacacacacacacacacacacauacacacacauacacacacacacacauacacacacauacacacacacacacacacacacacacacucacacacuggcuuauaggcuaugguccaacaguggccaucugccuauggcaggcccaagaacccaguaguugugguuguucaguccacaggcuggaugucucauuggaucuucacuauacacuacaauccugaagagguagacuagaaugccagagagagcaagcuuccuucguccauguccuuuguauaggcugucaccagaaggugugacccagauuuaagguggaucuucuuaccucaaaagaucuggauuaaaagugggucuuuccacuucaaauauuuuaagaaagaagcccucacagguauaucuaguuuuaguuaacuccagauauacucaauugacaacaaagaauaguacauagagccuuucacuuuggggggaaaaguuucacuucuaguuuaguugccuagaugaaaguucuaguagguguuucauucagcauacuguauauacaauuucugucaaauaucuuaaaaacucauaguguaggguuuaauuaaauacagguuggucauuuauuagaugauaauuucuccuuagaccuaugacaggaagauuauagacaaucuaaaaaacacaaaucagcaaacuaggaaagaaagauaaaauuaaucuuagagauagcuaagauacuagucgauuggacgcccucucacccgagaguguuuacauggcuggaaguuuuaacccugccugcagccuguuuaguauggaacucauuucuuuuccagguaaugguaugaaaagaacuucugaguggauuagccauccuuuauuccuuauugacuguauacuaaugcauuuuguguauauucuguaauucauuaaccaguucacugcugguuaacacuuagaucauuucuaaucauuuaucaccauaaauaauguuauauauuuaguuaauaaaaaccucacagcaaaaccuuaggaaagucauguucaccuaguuguuuguuuuguuuugguauuuucagguacagacaugaaauugcucaugacgggcagaggauuuacaucuugggaggagguacuuccuggacagccuauuccuuaaacaagguagguuuuuuucuuaaagaaguaaagguacugggagaugaauagacaggcauaugucauacuaaucaagcugauucuguugucuacuugaauuuuggagcagcuucagcacuuguuuugugaccaguguugucugugacagaagguugcacucagagcuccuaagaggcuuugcaguugguagucacauucuucacacgcugaaaagucuuuaugaaagugcgguggaugaggcggugacuagggauugggacuagagaauuggagcaggcuucugggaaugugacaucccugucgggacuccacagcacugacucuagagcaucgagcuccuuagggcucucagucauccguccccagggcauuucaaaugaauuagaaaucacagaggagaugaggaucaggugacagagcucuugcuggccuugcagcaggcuguaagaggucugcugagcuucugucugugcccucuccaaugcugcuuuauuucuuccuguuacaagaauagcucucacucacuguggacaugugaccgguccaggacagcacacaguagggcagcacagaccacuaagaggcacgugcaucucuccuuaguuuaguuuuucuaaaacuguucuaaaaauguuugcuuuuagaaaaucuguuuccaugguaacuaagauuacauuuauuuaccugaacauguguucucuuauuucuuccaagauccaugcauacaaccuugaaacaaaugcaugggaggagaucgcaacaaaaccucaugaaaaaauagguaaauuaaaaguauggauucauguguuuacaauucuauuuuacacuuguguuuuaggggguaagggugauuuucuuaagugguauggcacauaaaauauuuauaaagcugacauuagcaacuaccgauauucuucagcccaguuauuauucucccuuaggaacccagcagagagguuucaccuggguuauuggguuacacggcacagggagaagcacgugugacauaaggacuggggccuaggggcugcagagggcucaugggugaagcacacacugcuuuccagaggaccugaggucagacccaccaucaggcaguucacagccuccugcaacuccagcucacuccaagugguccauucuccucugcugggcucucugagacacacacaaagucacacaacaacgagaaaaucugaugguuucugugaauaauugaguuucuguauuuauguguuugacagguuuuccugcagcccgacgaugucacaguuguguucaaauuaaaaaugguauggagucuaaauaaaguuugguucauuucuguaaucauagcugcugagaaugacugguuuccuaaugagcuccucaaaaggggugcauaguuuuggacaguaccuacuuuuuaauuuaaacuuaaagggaacuguagagaguuuugccucucggcagcuuucagaauguaaagucguuuugggucugggcucucucaguuacaagaacucugaagcugacgguaagucagcuguuacuguaccacuggcuccuucagcaugauuugugugcagcaugugggugcuuaugcaguaagaccuuggugcacaccguacuacaauuguaauaacucucagaguacuauaccaucacgcuuauucuguucucugucugaugucagaacuccaaguucauucuuugggccuccuguagcaaaggcuugguaugauuuaucuaagugugauaaugagccuuuggcuaaugacuuuuaauuuacugugcaauuaauauuuuuuacaguuugauaacauccuugagcacacccgguccuccuccccugggaaggggucuaugcaggagcuuggccgcugcagccuuuagcacuccaguucagacuuaaguagcauuuaucugccacuuauauauucaccgggguguguuaaaccguugcuuaugcucuugggugagguuuauaggugguagugcugcucugcuuugccucugagaacagagagaugcuuucaaguuucucuugcauucuagucaaaaaaauguucugcuguuuuuuauaguuuaauuaagcauugcauuaaacaugaucccaacuugaauuaaccauuuauucauuugcuuccuggaagucacaccguauaguuggaacuucucagccuuuaaaaggucauauggccuuuacuacaaauugaucaauaguuaugaacuaaccaacccacagcucuacagauugaaugaguguuugcuaucaugguugaagauggccaggaagaaccuguuuugugaccccagagugcauauugcagugugcauuucuccauauguccacguggagcauauuugucucugggaauaaaaaaaugcaugcucuuuccaggauguuacucaaaggaagaguuuggaaacucaucuguagcuguguuuuguuuuugauuaguguuuucugacucaugggauuuuuagcuucucuuggaaacugagaaguagcuagccugcucccuccagggcaucucccugggccugcauagccacccuccuucagagcaugagcucucccuacaccuaguucauuuauuuccagugcugcuucucuaaaguucaagcacuggcagugucuguaaccgagauauauuuggauuggagagccuugccaugaagccuccuugggcuggcauccuccaucccagccaaugucccagguguguuguggaaugacccaccugucagcuaucacguguucucuguaagacguccuguagcugcagcucauuuccuuuguucgugacagaugucuucauuugugggggcuauaauggagaagugauccugggagacaucuggaagcugaaucugcagacguuucagugggugaagcucccugccaccaugccagagcccguuuacuuucacugugcggcugucacuccugugaguuuguucucacauugauauuacguaguuguagguagugaggaagacuagucagggaagaguugcuuauagcaaccagauuuggaaaaggagagggaaacacagucacauccaaguuuaaaggacaauguaauguauuagagagcagaaugaugucacccuuuguuagcaucuuauugaaaagacuauagaaaccugauuuucaucuuuguaguauaaccagcauuugguauuuuggauaauuaguauacucuaaauuuaauuguuaauaaaaaguucuuuguacuugaaguuaaaacacauggacaccuuuaaucccaccacucaugaggcagaggcagguggaucucuguaaguuugaggccagccuggucuacagagugaguuccaggacagccagggcuacucagacaaaccccgucucaaaaacccaaaccaaaccaaacaacccaaccaaacaaaaacacagugaaaucaaauuacaaaacaaaacuauagaauuggccaugguaaucccagcacucagaaggcugagaugggcaggucacuugagcauaagacuccaguuccagcucagcagaacauaaaaccuuauaucgaaaccaaagcccuauucuuucucuaauacccuacucauuauacgaacagucuugguuuccacguagguuuagaucagugagacagucugugucugugccuguguguugagcccaggccuggcagucccacaagugcuguaccugguucguauguccagccugugggcugguuuuguuuccguugcugagucugccuuggucacucuugcucugguguuugacuuugucgucuucucacugccauuuguucacaggcugguugcauguacauccacggaggaguggugaacauccaugaaaacaaacggacugggucgcuguuuaagaucuggcuggugguaccuagccugcuggaacuggcaugggagaagcugcucgcggccuuccccaaccuagcaaaccucucccgaacacagcuccugcaccuuggacucacacaggaacucaucgagcguuugaaaugaagauuucuggacuguucauugauacuggaaauguuaauuuaaagagacuccuuuauuuaugggcaguguagaaugugcuacaaagaggauuggcuacccugaucaaggccuuauucagaaaauacaucagaugccuuuuugugaauggguuuaguuuauggacauuucacuuucucaugugcuuucuucuuugcuccccucccuccugccccucauaaugcaccccacacuuaugcacucccucuuucuugauggaguugagggaaugucugaaagucccuuaauaauguuaagaaucaagagagagaaauuguugccuuuuuuuuuuaauucugagcauauugaccaugucaacuaacacuacagauuaaaauaucaucaacaaacacaaagcuuaaaaagccagcaacaacaacucuuggucugggagauagagcgagaacacuagucuugguagccuagcagguuguucuuaagucuggauguugaguuaguguuucugagaugugcggaguggcuggacucaacggugcuucaugacuugcuguaaaaaugccugaccuugacacuagcaggcagcucagugacgucugauuagcgaucccuucaauccuguaacgcuccggugguuagcguuggccugccaauguuuagugugucugucaucaucacccucuguuguugucucucaaauuaaauguauauggcaucaaguucuuuccaggcaguucugaacuucccuugugcuuauuaauggcuuuaaauaugucuuugacuucuuggugggggauuguagacucuuaagugugugauguaaaugucuacggacaguagauagagcacagcacccgcacccuucaggcuuaacugucuuaccuucugcuuggggugcuggcuuugacuagcauagcagcugcugcuuuuuuagaacuuguuucucuuuaagucucuggaccaugucccugcguuuucuuaaacuguugguucuugauugccuccugagcuuguugccuccuuugcuguccgcuucuguguucacgaugcugugguugccuagugacuggaggaaggucuuaagggaaaagguacagggucuccuucucaagaagcaggggucauuggagagccagcaggaggaaggggugagacagggugauucgcuucuguuggugagagauuuuguuuccuccuuucuggagagaaaaguaacguacguuuuuacuccuuuuguccucaggcagcuagaagagcugaggagugacuuguguaagccuauggguguccauaggugcagucaggaugcuagaggccugcaggagggugcagccaguccccccugcaggcuccuugcagaggagacauguaggagauuucaaacacauuuuuccuuuaagugccucuuuuccaccuagcuuuaauauuauucauuuucuuuuagcccaaaagagaucucuuuaguugauaugaaauaaaagucaccuuugaguuacaguaaaaaaacguuccugcccggugugcagucuuagagaggucuccucccuuuggcucccaacaggccuuaugcuccauccguguggguuaaguuaguggagccuuugcucugugguccugagugaagcccuuaucucugagugaggggauggaccugcguuucuggggucuuaacccccagcucuggccacuuccuguugguguggcuuuuacuuccugccaccgauaggcgcacuccucauaagaccccucuccagagcaagucagccugagccacugugugcucaaaacugugacucugggccaggucuccuggacacaugguggaaguguaucccaaacuaaauaagccauguuuucuagggugacagaaggauauuugucauugguuuauauagggaccaaaggcaauguucagccucugugcuuugacucccaugguccuuggacaacugaggcugacucugguucuguuacacuagaaagcuguagaaagggggcugauucaagccaacacuuguuggcauccuuuuuaagccaguugaaggcagucucuuugagauggauguuggaggccugacaucaacgaccuucuguaucuuagaagugcauguugggucuaaagugucuuugaauagaacacuagcgaaaguggugcaggaagcagcugaaugccgcagccacucacgcacauguucuggaugccaaaugacuguggagaaggacuuaaaggaaggugacuggauccucucuaagggucaccagcauuuugguuucucuauaaccagcacucgggauucccaguggcaucaccuggugugggaagguugugaugccugcugccccccugccuuuuugaggugcgcccagacaucuuccugcaguccuggaaguagaagugcaauauguagaaacauauggucuguacagauuauguagaaucgacgaguguaaagcagugacaccacucuuuguaccugucuugggcaagucaacuuauuaccuuagaguagaauuaugccaagaacuuuuagugugaucauaagccaacuucuugguaaagcuggauuucuuucagguccauguuuucuuauucuaguuauaaaaaaaaaggucuguuccucaguuugcuaggagcugaggguuucccaucccuguuuguacugccucccauuugcaugucuugcccaggaauaaggaaguccacuugaaaguguugcccagguagagaauugaaaccuaauguuaauacagcccccccccccauauacgcuaacuuaucugggaauguaauaccuuauuaaaugauguuuucuuuacgauaagguauuuuccacuuuacagaaaacugcaaaccaguauauaauagauugaaacuuuaccugcuuuucaggacaaacaaaacccuuccuucccacuggcagaaaucaucuuucagggccuaaugauuugauauaaaagcuugcuuuauagcauucauguccaguacagagcuagauuuuaaaauuauauauaugaugaaaauauuaacauuucuagauuaaaaguaugacugaucuuucguuauccacuguagcaaggugaaagcacacacaaucgaaauccauagauaaucaguguuuagccuucuccuucaaacaguugauuuacauaucuugucccuuccuguccuucuuccacacacauccccuuuucaagggacgagaagucagagaaggaaaagaagcucaaagaagggccagcagcuagccaggccaggcucccaguuaacuuagacacugguaggaaaaugaccaccggugggaaccuugagcacagccugcugcugaguucucugcugcuuccugaccagagagaacucuuaguuccugugggaugaacaggcuguguugaacagaaacagaaaccccacugucugagcacauuuccuggcucuuggcaaagcuugcuuuuuuguuuccuccuuuggagucaccuucugcagucugauguccuggugugcagcaagggugcucuguccucucggacuguguugguuuuguccccuguaaaagcaguuugcuguucuguggucuuagugaugcuuagagaguggcccucccaccaacacucugacguagcacaaaaagccauuuuccuuuuuguuuucuguuguuuccugguguugggcuucagggugaaugcaggaggauuuauuguuacagccacgcuuuucaagagcugguuaccauagguguaaauuccauugguccccagguaccuuagagcucugguagcuuuggcugggccugaagcaggcucaguggggguucugggaccuaugucuauauguugucacccguccauaaguuugugagauuuggaagaaaaaaaaaauaucuucccuugucuggugucaaaagcagagcugugcuucgaugguagcgccaucuccuugguggucuuuccauguuguuaaucuuuuuuaaaacuuuugagaaguuuuuuuaaaggccccacuuagucugcagagggcgagucagaggcaguuuucagagaaaaggccaauuucacuaaguaguugugauugcuguuguguuaguuacacagcaggaauauaaaggaggcagggggaagcuacuggcugggguagucuuagggagcucacaggcuucucccugcagaggcaguagggacaggcaggaaaggucagccucccuuuggagcuguucccaggcugggccaggcucuacucuuccugcaggcaguggaggccauacacagugcuugccuuacuucaaagcucuuugccacaguccuguugcacaguguggacguccuuuugcagucuggugugcaugccaugugagcaggacagcuuucccgccucucccgguuuccuaugagcaagugaaccuagccugaaacguuccaccuguacuucccuaccuugucaguguucgcuguugguuuucuaaaacaaucugaucaauaaaucucuaaaucuacuugguccaaguugcca

SEQ ID NO: 2882 - RNA, 3188 nt, Mus musculus
uaaucugauaauccuuuuuaugaaauuaccucggaaacgcuaacuuuucaucuuuugaaacucacuguguaaauuacucugaagauuacauuguaccagcuuuuggcuccguaaaucuuaauggcaauguuuugccaaaagcaauaaaagcuguccuggauuuaucaggucaaucagggaaggggcaggcaggcaggaaauugaaggugacucaaacugcaaagucgggagggaggggucguugacugaagaaacuguuggaacuugccacuguggccacaugcaagcaaggaagugaguagccucaggaagcagagaggcaugcagaacgccagucacagcugccgaggcucccugucggaaagaagagaugugcaguucuuagaggucuuagaagaggccuucuagucgugccucuucuccccacccccagcagcuccucccagugcccagaaggcagaaggcagaggcagagagaagaugcuugggcuguugucuuccucugcuaugcccgacgggcaggguccugggccucaggcugacuugaaucacuccaauccuacuuuagauguuaucaaccaugccuccuacagccuggcugcagugacccagccuaucuaucugagugcagcauccccuucuacuguucgcuucuuuccuacauaguggcuacacacuggaucccucugcgggccucacuggaagugugucacauugcucugcagcuuguaggagguagcaggcaccacaggccucuacagauugcaggacagguggagggcccccgccuucugaacccaggccccuagcuauccagcuagcugaaaguguuuauugaacaccuacuuuguuccaggcucuaaggacuauggaaugaacaagauagagucagcuccuguccuccugaugguggaacaaacaggcaguaaacucuaugaccaugggggagaugggaaggggacagagccgguagaagggucagggcaaaggccuuggagucuuccuagugggacccuagcuuugacucuuccucacugagaugauauuugaauagagaaccggagauggaggacagacccacagaaacgcaggaggaagagcgagccacuggugccaaggcccccaacaacacacuucaucauccaaggagcggcaccauggcuggacuaaagggagcaucguggcaagacaccaaggucagguagcuuuggaauccccacgccauggaaagagcugagauguggccuuucugggcaucuuacaaggaaaacgcguccaucuguugccuuguucuggucugaaagguaucucccccccccccagcccccccccccccgacagaucaggugcuuccacuggcuccagggaaaggcuccggagcugggauuuccaaaucuuggaagccucacugccaggagucaccguguggccugaggaaaccaagauaccucauacagauuccacauagucccugucucuacugcugcgucccuggggucagaagaagaccaacccauagcuucugucuuuuuucuccuggccgggcuauucagaugauagcuaaagacaaggcaagcugccuuaucuuccccaagccgggacagaaggaguuuaugaggacgcugauaggaacccugagaggcuacuggcccucucagggugcuccucagaaaagucucagugugugguaauuaucugguuagugaggacuucagcugaccucugaagagugacaggacaguccuccuccuucaggagauggugacccacacccaucaacccaugcugggguuacucuguucuucucauggugccacacaggagcugggccagucuggaggagaaaggaugcuggagccuuacucucaggggaggagcgcucucuuagcucacucuccaagaacuggguggggagucuuucagacagaaccugucuuuggcccugagucucauccuggugacugagccgggcuuauccccguggcuuagcagagcgagcggccauggaagcuuuucuggacugggcuagcaaggcgugaggguuuaagcaugugcccggagagcucuggcaccuguuugauacuucccagguugaugguggcauuucuggugugaauccagccccuggaguauccaggucccgggcuccaucugccaccucacuugagggugccaggccccucaccucuccuacuccaggcccacaucaccuuccagaauaacccccaucaggaacgcggcuaggaucuuuccucccuguugcuuuuccagugaggccucuuuuccccuucauacaagcacuuccgagagagccaaaucgaccgcccucuagguugccauggaaacagagcuuucuuuccucccuccuguuuaccuuggucaggggacugcgacaaaaagcagccugucgcaggaggagaagggagggcgggggagagcggagggagaaucagcuugccuuaaaccagaucauuccgguuuggagugguucucucccccgcagcccuaggccccucuugccacacugggcuguggaaggcagggagggagggaggauccucauccugcgaagcuuuaguggagaagguccuacacccgugguaccccguccuaauuccaaguggaccugucucccucaaggccagaguuuggccuccagugcauccucuggaggugcugccccagggugacugcugugcucagguuggcuccccaccccaggauaaagagaugggagcugaaggccaggccuugcucuguauauguacucuugagugcccuggccaaaguggccucacccuauuuaccaaaaagaucauugucguagccucgaacuuaaaauuucccaacuaacugccuuggagcgcgauuauauaucagugccuucugagcaccgccucuccucgcccuaacuuuccaagucuccugcaguuuuucugguuucuuucguaggcuuccuccccuuccagaagccaccaggagguggugggugcugucccugaaaagcuuucuagcucuuugugcuccucugagccuugagcuaaaguacucuauucucaguaccugauuccucuaaccgguuugcuggguagaagcccugccuccgggugcuaucagccugaauacaagguugugccccgguggcaucccagccgguugcguacccacuagaugcacaguuagcgugg

SEQ ID NO: 2883 - RNA, 30729 nt, Mus musculus
uggaggcaggacuuauuuauugagacugugucuuucaguguggcccugguugucuuggaauucacuguguaggacagguuggccucaaaccacagcccuagcaauagcacugggauuaaaggcauguggcacgagagaggcuuaacuuucaucuuuaaacuuccuccacauaaugcauggaauuauuccaugugggccgcuaggaaaucucuuuggggccaaugcuguccuuggugguguacuugggcaacacccacccaucuugcuugguccucucucuucuuccucacuccaaggaauccaucacgagcccucauucaggguggaaagaaauagaaucacuguuaucuccugagaugcagcuccggccugauauguaaccauccuagacuugguaggaagcuacucagugacccauggcaguguuacugggcccugguugugccuuccuguccuagguggucagacaagauguccuucccugaagccuuccuucgaaagagccugcuaaugcucagacuuugacauauuccagagaagggcagccagccucuguuggguugucgcugcucuggcuacacuccagguugcugaggaaggccugcagaguacaugggauugguccugggguauugguaaacaacuuaacuuucucagcaguacuguggcagguggaguucugaaacacuccagcacuaagaaggccagugugccucacuggcucaccuuccccagaggguguccuauccauaaauggguaucccugaauagcaguauccucagcucaggcugcucaccugcaggccuguguuaagaugagcuacucauccauuuccaaaucuguugguagggaggcugauugccaaaggacacagguuucauuuucuggagaaaacgcuggcuaucuggcaugguuaggacccaggcagcaaguuuaaucagagugagucucacggagggaggaccauguaacuggagcauucccagagacugcagaggaugagcagagaaagucacagcaggaagcggcuacaaccaaagauuugggugcagaaggcccagcuggggccagauuguggagggcuuuaaaugucaggcuuaggaauuuaucaagggaaugaaacaaucaaacagguguuucaggaagauaaauuugaagagaauguacaggaugaauugggaaaucuggaagcauggcaacaauuagaaggcuaugagauuaauuaggccguuacagcaguccugugugaguugauaagcguacaaaugggacuagugguggcagaaauggaaagggacagcugugagggacauuguuaacaaagaauggaugaggucugcugccugauuggacuggggacacagggaacucaaggaaucaagguugacaccacaguugcgagcaugagcaacuggcaguauaacgggcacagaaggggauguuaaacgaccucgaagguuucaggagaugugaauggggucccagaugcagagucuacagauagauacccaacugcacuugucugacagguuccugggugaguucaggagagaugcagugcauauugauuaguuuggggaccaggcugaaauguggugagugaaucugugggacgaaugucucaccaaggagacugcaggggaggaaagcagcaaggcagccuucuggagaaguccaugggugagguuuucuacugcaaagccaagcugaggaagaacgagucugcacacauuucuuugccauucaaauaucagcuugaagaauauauuaguuugagaaaaccaaguaacauagcauuucugucucaguggaaacuagauuauaaacacuuucaguaugcuuuaaaacaaauuugguuuaaguaaaggcugguauugauaaagaaaaagauaaaugucacagugaacguaaucuagauucauggaucugagccaagcaaagaaaaggaacacgugacacacauccuaggaggauuugugguguuaguagauauugacucacuuuaauacaagaaacugcuauauuggaggcuggggaggcagcucagugguacucgguaagcuguacccuggauucaauuccuaguaaugaaaacaaacaaacagaacaaaacaugaugcuauauuugcaccacacuuucuguagaauaaauucaaaugauuucaccaaggcagaauuacuauaauuauuuuauuaaugucuuauauuuaugaaagguuaucacaagguacccuaguuuggccuugaacuaaugauccucccacuucaaccucaugagcagcugagguuccuggcaauuucccaccaugucugugccaauucuguuuaaauacaagauaauaguaaguacagcuagcucaaacacuuguagacauuguuauaggaacucuacagcaaccuauacuaaguaugcaggcaaaacaacuuuucuuuuuacauagucaaguguuuuuacaucuauuuacuacuauacuauauucuuucagaguuauaauaaaagacaggguugguggugucuuaugugcuguuaaagauucuccgguguuuuuagugcagucugugcagcuggauacuuaaauagcacagcaacugauuccauggcaccccgaaucucucucaaaaauuacagguuuaaauuauaacguguccuuaaguuuagcaugguuaaaugauauuuucuuuuaggguaaccaagagcaguuaguuaagugacaguuccuuccuuguggacauuagcuuuuaaacuuaagguuaaccuucugaccuuuugaagaaaaaaacccucaaaccauacaaaaauggacggcacaucccaucuguucacauucaggugauggaagcaaucuuuauaaagacauguucauuacaaaugugacuacuagccgggcguugguggugcacaccuuuggugccagcacucaggaagccgaggcaggcagaucucugugaguuugaggccagucuggucuacagagugaguucuaggacagccaggacuacacagagaaacucugucucgaaaauaacccccaccaaaaaaaugugacuacuaauuacuucauauacauauagauauguauaggucccuaucuauguacacauauagaagaauagauggagagcugauacucuguucuaccuguaaacuagaagcaggaaggcuaucauugggaucuuaaaggagugauaaagugccugcugaugauacacaggcgccagcacacaggcccucgcgcacacgcagugcuaauaaaagcagugaaccguuuuuuucguguccuuagacauuuaacuaaaacccaaaaguuuaauuuuaucagcuaauuuuaaugcaagcauugaccuuucaagaugccaauauuaucaaaucucuuuuaauauuaaaaaaaacaauaggggguuggggagauggcucagcaggauuaauuacuacaucacuuagaaauuaauuucauuucagcuuuaggcugacuuguagaacacuggggaaauauaaagauacaacaaagagaacuagcaagguucaucugagaacuuacacuacuauccaacaaugaaagcagucucugaugguacaggaugaggugcagguucucacugggguuaaaauggagaggcguccuugcccucaccaaaugaagggagcggcacuagcucgcucagagccauccaguguaaugcuuuucuguggacuagaaggugcaggcuuugcuaugcucacaagaagcucccacagcuugucuccuguuaaauuuaacaagucugcaaaacaugcaucuuaugucagaagaggugcgcacucggaggggcucagcuccaacuucuuccagaccaguuaaaagcaaaguccaaauguuuggaauuaaaugaggaacuacucuccaaagauccacaaaauguucacgccagagagcccaagguuaacucuccugcaaaggaaggaaaacaguuuuaguagaauugcuugccgaaguaucuaagggcugauucuaauaaaauuaacaauaggagggacaucuguuuaacugguggcagcugaggugacucagcaaugcagccugucacacagcucagcaggugaguucaaguaaugaugacuacuucaguaacugugcuuaaaaucuauguuuagaauaaauugguuuauggggugaaaaauuaauuuuucaguagauuuagagagcuacaucaaagagagcuaaaaauuuuuuuaguaguauuacacagugccaauuaauuuugucuuuugagacaaguuuucuuuguguggcuugggcuauccuagaacuuucucuguagaccaggcuggccuccaacucacaaagauccaccuaccucugccuccuaaguucuggaauuaaaaagcaugugucaaaaacaaaacaaaacaagaccaaaaacaaaccaugugucaccacugcccagcaucaauuaauuuuuuuaaauagaggguagagauguuaggcuuuggcuugaauagaaaucuacugauuauuagggguuucuugguaagugucuuaauuacuuuucuaucgauguuguaagauaccauuacuaauuuuaggcaugguggcacaugccuuuaaucccagcacuuaggaagcauuaggcaggugaaucucuauuugaggacuacagagugaguuccaggacagucagagcuacacugagaaauccugucuuaaaauaaugaugaugauaaaagauaccaugacuaggguagcuuauaaaagaaagcauuccaaaggguuaagaguccaugaaugugacagcagcagucagucucaacaccagcucucagcaacacagugccuccaacaaggucauaucuccuuauccuucccaaacacuuccaccaauuauucaaacacaugagucuaugggggccauucuguaaguuuguucaucagucauucuauuuuuuuuuuccccgagacaguguuucucuauguagcucuggccguccuggaacucacucuguagaccaggcuggccucaaacucagaaauccgccugccucugccucccaagugugcugggauuaaaagugugcgcuaccacgccccggcuauuagucauacaucuuaaauuaugccauacuauaugugacagaaagacaaaucuauuccagaauaauauaacuguacugaauauaagggaaggaaaaggggcaacagaaccuacaccacccaagucagacacugcaagccuaagcugaagugucugagggccguuagcugcaacucugagguguaguugucuuugggaaauauuaacuauuuaugaacuuugagcuccaggcuuuaucuaaggcacucauacucuaugcuauaagaugguagguuuuguuuguuuguuuaagacagggucuuaaccguggccuguguuggacuggaacucacuauauauauggauagcuucuuaaacucauauucugaauauugggauuacagguauauaccacuacaccuggccuuaauuaucugcuuaaaaagcauuuuuaaagauuuauuuuaauguguguguaugcaugccacauuugcugguccuuguggaggccaggagagggugauggauccccugaaguaggaguuacaggugguugugaaguugcuugguguagaugcugagaaaugaauuuggugggucuucuggaaaaacagcaagugcuuuucaagccagcugaaaaauuaauauguuaaaguauuuuuuuccuuccuugguuaaaagaaauacaaggggggaugaggagguggcacacagacacacauacuucaacauaaauuacauguaaaucauauacuucaacauaaauuacauguaauuuauuuauuuacaauguaaaucacagauuuggaaguuggacaagguaucgaucaccuagcaauuccugagggagaagcaggaagacugggaauucaaggccagugugugauauaugauacauggacuaaaacaccaaacaaaaaaauucuccuaaaacauggaaaagcccacccuggggauauagcucaguagaccacucagcaugagagaagcugagcucacggcucaacacugucaaagacugaccaagcacaguucucacgagcuaaagucucaccauguauuccaagaaguuucaaacccuguggugguggcacacaccuuuaaucccagcagggagaggcaggcugguuucuugaguucaaggacagccaggguuacaagaggaaaaacccuguuuuggaaaaccaaauuaaaccaaaacaucaacaacaaaaaaccccacaaacaaauaaaaccucagccuuucagaagcacccaauuuaaauuucucuguauauaagcauugugccugauguccauguguguacuguguacaugccuagugccuguggaagccagagcaggugucaguccccuggaacuggaguuagauaauugugaaccaccaugggggugcugggaacugaacaagagaccucugcaaaggcauccugggcucucacagcugagccaucuccaguuccaagagugauuuuguauauugacaauacauuuguuguaaauuucauauuccauucuauguauguauacaugcaauuauaaacaaaccuuacuagaaauuuuagaaaaaaaaaaauucuuucuaauacugacaaaugccuaagacacaccauaaaauuaaaaagucagcucaaagagcaguaaguuuggguguaauucauuuuuaaagcaacguguaagauacaaacucauucuucaaagcagucuggauguugaaaaccugacauuggcugacacuugcuggaggugaauggagaggcugaguagaaagaugccuucauuuucuagugugcacuguuuugccauuuaaauauuuuuauauugagcauguguuauuuuugcaauugaaaaauaaugaaaaaccuuagcuuagauacuuuacaaaaugauuuuucccauuuaaucuuucuuauauuacaaaauaugaggcuggguauggcggcaaacauuuuucaucucagcaccugggaggcaagggcagguggucucauaaccaugaguucaaggccagccuggucuacauagugaguucaggauagcaaggguuacacagagaaacccugucucggaaaacaaacaaacaaacaaacaaacaaaugacuaggauuggagagauggcucagugguuaagagcacugacugcucuucuagaggucuugaguucaauucccagaaaccacaugguaaaucugauggucucuucuuacagagucuuuacauacauauguauucauauauauauauucauauacauaaaauaaauaauuuaaacaacaacaacaacaacaaagcaaccaagagcagacaacauaaaaaaagggcagaggggauacauguuucuguguguuuacaacugucugcuuucaucuuuucuauguaauaaagacauuuagguauagaguuugcuuugacucagacagcaccgugcacacacaccaccuucauauuuccagcagacacccacaacaguauucaguauguaagcaguguaugucaccuggaagcagguaacuuuacuucauuuugcccuuuagagucucaguucaggcaagucccguggcacacggaccugggcuguaguggcagcucauucugggacacagcuaaucuccaagcuaugaccagcacguguaaacacaaucuuuuucccagaggcccgccugcccaacagaguggagcagccacacguguccucugcaccaggcacuucccuugaccuuucacuugcuuuagguccuuguuaggacugcuggaccacagaagcuaagucuucagacucccauuuauauauuagcagauuuucucagcuucaggagugguccaauuauuucaaacaguauuugaaauauuaaaacacugaaucaucaauaugacaauagucaaucugaauuuguaaauaauguguuucauuacucaacucauauacaacuucaacagacuauuuuucuuuccaauuaguauuauuuuggcaaggguacagauuagauccuuuggaaauauaaugacuuuguagaaugcuuugcgucuaaaacagaacuccaggggacacaguguaaagccacccugcugucaucucacugacuuuaccaacaggacagugguggcucugaggcacugaugaacuagaacccaucuagacugcuuacaaaccgugugcuguaugugcugccugcgcagaauccuaacccaggaggacuaacuaaacuaagcuaaaguuaauagcaaguaaguacauugaguaguucacuuuaaaaucguuaaguaccuacccaagcauuccugacucuuuggucuuuaugauauaaaggaacaucagcaacguaugaaacauauuauuccugcccuagaaucaagaaaaaaacaaaacuuaguaaguuuugaauuaaaaagauucagucauacacaaauguagaucuuaucagucugcaucccaccaguucaaaauuugacauaauucaaaguuguguucauuugauacacaucaucuauccuuuucuaacaaguggggauccuauggccagagaggauccacggagcauggagcacgcacggagcugaucucggagcaggaaagggcugacacuaaagaaugacuacuaauuguggcgugugaugggaguggaugccagacaaacacaggaagucccuaacuuagacugcagaggcaggaccuggcuuccucaacgcaagaauggaacagaccugaaauaugaacagagguugagagacugggugggguagggugugggucuuacacacucggaaccaaaacaugaugaagcuuuucuuuucuuuuguuuuuuuaagacaaggguuucucuguguagccuuggcuguccuugaacucagaaauccgccugccucugccuuccaagugcugggauuaaaggcgugcgccaccacugcccgauaucaugaagcuuuccugggguugauggauccauauacuacacauaaaacauacucuaucucccaagcacaccacuguaacaaaaguguuaggauucaaacagcuuuuagcuagucuucaaaacacaguccaguaugccuuuaguauuuaaagaacuugguaaaugauuuuaucuguaagaacagccaggcaauguuugccggcucugaaauucaacaaugauuuuuaaguguuagucuauaaaaucccucuauugauagaucaacuuuaugagacuucagguguauaaauuuuacaagguggugcuuuucuuucauuaaaaaaaaaaaaaaaaaagcaacaugggcagccucaggagccuccauggcucaaaauacauaugcaaggacacaguacuauuaauuaaacuggaaagcagcuacuaccucugcuggggaucugauacagaacucagugcaugauucuauguguacggaggagccggacuguaauccuagcacucaggaaacugaggcagaacugaacaucugaagccagcucggcuacaugauaagaccccguugguucccuaccucugcaaacuaaaaaccaacaaaaacaaauugcagucaaugcaaaauuucucaguaaagaugcugauaaaaaaaaaauugcaaagcucaccaauaaagcuucuuugcaaccaagaaccaccugcacggacaugugaccugucaggugacuucucacaugaagucauuuggucauauuuucuaacagccuuggaaauguucuaugccucagaauucaauuauuagaaauuugggcuaaagaaaugauccaaaauacagauggcuguguggaucaagauggacauuuggcagugcuugccaugaaaaagcucagccguccaaguguucaaaaggagaauaugguuggagaaauuaugcuguuaagaauuuuuauggccuuuaauauuuuuauaaaagauuuuuaaagaugaggaaaauuaugucuuaaaguucguuauuauaauguuauauaaauaacaugauuucaacccuuagaaagauauagaaagagcuggagauagggguauacaucuuuaaucccagcauucaagaggcagaagcaaaaacaaaucaauagauucaauuuuaaaaaucccaucaaagugccauucugauguucccuaguaacacgugcuuuagggacagagaggcagcucagugguagagcacuugcccaccaugcaugagguuccgaguucaaccccaaaacugaaaaggaagaaauaccuuuggaagauuguagacaugccgcugauagauuagcucauaauguggaggguugacagcacucugauaaauacaaaacacauuuucauucguaacaucugugaagaaaaugugacauguuaaaaacuaaucuuuuagggaauuucaggcaaaaguuucaacauguucuuuuagaguuagaaccugguuuauuuggcgucugaacgaagugcugagaagugaauguuuuuccaucaggguacuuaggguguggagguaaucuggaaucaagguaggugcaaaacacaugcaugaugaucugaaaacaauacaacaaccauucaaaguuagcaugacaaucuagcacaggcacagaucuuugaaaagaucuguacuuacaauuaccuuuauaaagguaagacauuuacuuaaauuacaaaacauuuagugugcugaugaaguaaggcucgacuuauauuucacacaaucuacuccagggcugguguguagccaagugcacugugauugccaccaccuuccuaaaaaauaacucacucaagcugggcaguaguggcacacaccuuaagucucagcacugggaaggcagaggcagggagaaucucugaguucagggccagcuuggucuacagagugaguuccaggacagccaaaauuaaacacagaaacccugucuugaaagaaaacaaacaaacaaggcuggagagauggcucugcaguuaagagcacugacugacuguucuucggaaggucccgaguucaaaucccagcaaccacaugguggcucacaaccaucuguaauagggaucugaugcccucuucuggagugucuuaagacagcuauaguauacuuacauauaacaaauaaauaaauaaaccuuaaaaaagaaaacaaacucacucaaaauugaaaaaaaaaucugccaucuuaucaacuugaucuuguaaugggaaguuuuaaagagaagcauuuaaaguguguguguguuucaggguuauacccagagucucacacauucuaggcaaaugcucuauuacuuagccuuuuuuuuuuuuuuuucauuuugauauaaggugucaacaaguucuuuaggcuggccuugaaggaaacuugaaauccucugcucagcuuucugaguaguugggauuacaggccuacacuugaccugacuccuuacuuucuguuaagauggaaaguuugcauccauacaggugucagcaucacuaagaaaaacugcauauacucaauucucaauuuaaauaucaacuucaaaaguuaauuuucaugcaaauaguuaauacaaaaauaauacaauuuucaaaaacauaaacuuuaauacuguuugauuugcuaaauuaugaugguagcagucuuuccuaaaguaauaaucccacauaagaaagaaugugucauaauauucuuugcuacaucacuuaucacauaaaaacaaacucuuucccauuaccacuucaucagucuuuuagguccaauaaagaacaauuaaacaaugaugcguaauaaucaaaaacugcuuaaauaucauacaagcaaaaaggggagcaggacacggcaccaugcacacaggguuccugcagccaugcugaggaacuucaaagaguaggaccacuuaaggaagcagacagacagucuuuccagugcugggcaagacacuggugauacuuuaaucacuuccuucuuacuucuuccuacguuuuucuaacacuuuauaaugggaaaauaaaaccauguaaguauaauaacaaaucuaccaggcuaaaagcuaacuaagaccuuacagcagaaucagugggcaggucuguaucccauuugcguccuuugaagucuccaccucuguuccaucugaaugaacucauacagccccccugagaaaguucuguguaagaaaaguaaaaauuaaaaugcuacagaccaaaagaaaacaaacaaaaacaaaacaagaaaagaaagccggaagauuacaguaagaaaaauauucuguuggaaaaccuuaucagaauauuaaaaaaagaaagauaaaaagaaaggaaggcaggaaagaaaaggaugaacaaggaaacuguaacuuaaaggaaacauuaauuuaucauaauacauggcaguauuugaauccugauucaaacaaacaauauuuaaaacaggauuauguauuuccugagaugguagggcauuuaaaacaacaaaugugaggugugguagcugacuguggucaguaugugcuaauagcaugguuaguuaacauuguagaaagcuauguuuuacaaauacguuaagaaaacauuacagaugaacuaacucaacaacugaaagaccaucccacaauggagcuuuaaugaaggagcuucacaaacugcccggcucugacucucagcaacauguaggacuugcuugcaaucaaacagaccgaaagcagccugggaaugacaaguaggggagguccuggagagaacucugaugugaaggcuguggguuuuuuuuuguuuuguuuuuugaggugggggcacugaacaggcaaacuaggcacaugcucuaccccugaguuccugagcucaucuaguguugugugcuugcuuggaauucucuuaugugacaaguuuauacaaaguugugaaagaccacuuauucuuaaaacugaaucaauaacacagacuguaauacuuuccauguaaaaauguaugaaaaauuugaauacugaaauacuauuuuaagaaucugcuuuaacaaagaagcauuuuacagucuguccaaaugaacaauaagucuaauuuuaugaacuguccugauagaacgguacacugaagagaguacaugggccagcucaagaggcucaucuuccugauuccaggccaaucuccucagaucacaucucuccccaaauucuaagcacauaauagaaaccacaaauuaaauagaaauuacgaaaauuacaagaaucagauuagcauacugauauuacagagaauaccacaguggcacucagcucuugguaguguuaggagcagaaaaugaguccagccuauuuaacucauuuaaauuucuuacacagaauaaaagaauuaaaaauuucaaggauacucuuuugacaguucuuagugugucaacuagaggacugacaaguuguucaaguauaagccuuaauuaacccauacuuaaauauauacuugcaaaauauaagaccauaauuacauuuuuacuuuuuucaaaauauguuuuuccuuguuaucuuucauuuacaaaaauccuaauguugcaaaagagcuuucauuuuuccucuucaaaucaaguuaccuuugauucuuucaaacaaguacuccugauuuggugugaggucuaaauacugcacaauugcauucagaguuggaaugagaggagcucugaccagggcagcuugcuucaagcugguaacacucgccucuguuagaacacaaagagcacagauuacucaucagccuccacugaacugcccccuugccucgccugcuuucagauagcugcuccucagagccuucagcaucuuacacaagucugcagugccuucccuaacacucuagcucagguuucaccugccaagcacaaaaaaggaguaacucuuccuacacuucuauuuuuuuccaccauuccuguuuaucucauuuauuagaaagaaagcucaguggaagcaggggcuuuagucaucguugugcaguguuauaccacaccaaugccuagaauagcaccuagcuuauugcagguacucaauauuuguucaaagaauaaaggaaagcaauaauuaaucuuuuuaaaaaagauuuauaguuuaaagauguauuuuuauuuuauguguaugaauaccuugccugcaugcauaucuguguaccacauauauaccuggugccugugaaggccagaagaugcuaucagauccucuggaacuagcuaccuuuacauuuacauuuacauuuacauuuaguuauauuugguuguaagcuguguguagguaacaggcauucagccugaguccucugaaagagcagccagugcuuuuaauuaaccacuaggccaacuuuccagccccuggguauuuguuuguuuguuuuuugcuuguuuuauuacuuuuuuugggguggugauggugguuucgagauaggguuucucuguguagcucuggcuguccuggaacucacucuguagaccagucuggccuccaacucagaaauccgccugccucugucucccgagugcuggcauuaaaggcgugcgccaccacgcccggcuuguuuuauuacuuuuaccccaguauuucugugucuguguguaauguucacaugagugcaggugaccauggagacccaaaguguccgagcuccuggagauggauuugcaggugguuugugaguguugggaacugaacucaaguacccugccggagcacuaugugacaguaacuagugaaccaucuuccaagccagaaauaaccuugcaguauauacuucacaucauuucauguaagguggcuacauuuucucacuuucuccuagacacacacacaaacaaacucucucucucuuucucucucucucucauacgcacacccacacacaccucucuuuuaaaaaaaggcauccaaauucauguuggcaaaacuaauauauagaaauauguagaaaacauuaaagguauaaaagacauaccacagcuuucaaaauaagcuguauuaaaagcuacccacuguaccaggguaacuagauuuaugauagugauuuccuuuagaguaugaaaaauaaacaugcaaaaaaauuaagaggaaaaaaggcagccuaagcauauaagcagcaucuggugugagaagggauuauuccaauacagaagcaacagcaugaacuggcacaagccuuuugaagggaauacauacugaaaaccuuauucacagcaacauuaguuauaggaaguaauccaaaugccaaccaacuggugauagguaaauacaauguguaagauucauucugagcauuagcugggcauaaaaaaauaaaguacuuggaugaaacuuaaaagcauaugccaaguuuaggaaaccagucacacggaccacaaauggagucaucacuagcaucacuaacauggaacagcaccagcaggccugcugcagagagagacucagaaaggaacuggcacaaggcuggggaacaauauggaaaggagagcgauagcuaaaggguguggggugaugacaugcucuaaaauuagccaugcggaugguucaagcacaccuuuggacuauccacuuucaaauacagcugcuacaucugaaacaacugagaaccaucaccaucauuuucuucuuuaccggaagagagcaaaggauguuccacagccccuugcaggaugcuucccacuuaacugaccuacugaaaguaacucccgcgcacgcacggcucugccucacauaccuccuauuuguagcucuggacagcccauccuucucaucugggugcugacagacucaaucucuugcacaagcggcaccaauauugucucacugauccacuagggaagaaugaagaauaacuuuuguaguuaucauccuaaaguauuucucaagucaucauuuccugcuuccaggcaccuuugucuuauccuugacugacugugucagaaaccacagugagaaagaacacagguagcagcagugugaagcugagcccaggcgugcugcagagcacacaucagcuuacguccuuacaccagaucugcugcuuauuugaagaaaauguugaauuuuaaguuagacguuacacuuuucauuuuuucuuugaaaauuucauuuuucaagaugggcauaguggcucgugcguauaaucuggguacuugggagauggaggcaggaagacuaucacaagucugcggucaacuggucuauacaucaaguaucaugccagcuggagcuacauuguaagacccugccuccaaacaaaacacuuucuauaauuguacucuuggccgaaaggaaacauaaucuucagccuacauguacucaguaguaccauaccaccugugcugguuuauaaucaguagagcaguuuucaaacuaagguaacucauuaacucacuguaggcuuguccaugcccuaacuguagacagucagaucugcuuaaaaccaguuuguaaauauuauaguauuaccuuuaacgauuaggaauuucaaauuccuuuuuccauggcaaguaucaaacuaaucugcgggagugaagagaaucucugcuauguguguuuuuacuguucuguguuugcagugacucugacuacuaccuuuguuccuaagcuucugguuaacuugagaggaugaaaagauguuucagaugaaauacuaacccacaauuaucuauaaaauuuugaaugaaaaaaaccuuugaaaacuaaaagcucuucuauguauauauauuuuuguuuuuuuguuuguuuguuuuuuuguuuuucaagacaggguuucucuguguagcccuggcuguccuggaacucauuuuguagaccaggcuggccucgaacucagaaaucugccugccucugccucccgagugcugggauuaaaggugugugccaccacaccugauuauuuucauuuuaauucuguguucaugcacacgugcacacgugaguacaggugaucacgcaggccagaggcacuagaaugcccggggcugcaguuguagugacuguacugccuaccauggguucgggagcaccguguucacagccgcccccugaagccugagaagagcuaacaacucuuaacugcuaccacgucagucuugcucguaaccacagugugacaaugugcagcuccaaagacacccugucacuuuucuucugucacaugcaaauaaucugccagcuacucuuuggcuauaacgaaacugccuaguuaaaaagagauacgggccucauccccagaaauucugccugagaaucauggacucaaaauacuguauuucuuuuacuuuuuaaaucuugaaauaauggcccagguuauagcccaagcuagucuugaacuuucacauuuugcuucaggcuucuuaccauguauuuuaggcaugugccccaugccuggcuaguuacccuuccuucuugauaccuuacguaaaguauacuaauggaauacauuugucuaagccauggaggagaaccugggacucacggacccuaugagagugagagaagcagcagacugagaggcugaggcccuaccaucuguguggaagaacugacacagacaggaagaggacgcuuuucuaggagauagagagacugcugcacaaauacucucuaucuuuauaagucgcgucaaacacacaaguguuuucugaagaccaucuucuugucucccuuacaauucuagguacacaauacacugacagaaaauauuuuugggaaauaaaauggaaacaucuuagaauguuccuuuacuuucucuaacuacacugaugaaauguggaaagcuauacauaaucccaagaaaacugucaucucuacccuauauaugcaccauuauuuuuaauaauaacuaauuuaaacauucuuaugaauuaccucaguugauaguuugauauaguucaaugacuggcacgaaacacaacuuaacauuuuguuuuuuaagauuuauauauuuuuauuuuguguguggguguguguaugacugccaguauguauuauaugugugucuagagcccauggaggucagaagaggacauuagauuuccuggaacuauaguuaaaagugguugugaguuacccugugggugcugggaauugaacccagauccucuggaagagcaaccaaugcucuuaaccgcugagucaccucuccacccuacaacuuacauuucuaaacuuggcuguccaugaauccaugugaucgagaagcugucuauucauagucacucuugcccagaccuguuuaaaaaacaaaaacaaaacaaaaaacccuucagaaacacuaauauucauuuaacuaccauuuaguaaauguuuuuauuacuaacucauggauguuguuauuguacaaauauaucuuuaaaaguucuuuauguagguaggguuuguauguguguauguguuuugcucuuaaguacaaaguaaaaauauaaaacugcauaugauauuaaauaaaugaaguacagauucccaaauguauaaauuuugaauguaacggucuaguacaugguaaguacaauagauacuugaacauuuauuauuuuuuauuuugguguagugcaagcgucaaccacagugccuguguaugcuacacagguaaguacucugccacugaguuacacgcccagccuuugagagccuuuuuucuaaugaucauggcaugguauuuuaggcagggcagauuauuuaacucugcaucauacaguguaaacauuucaagcaaaagcgaguucacuaugaaugccaaauguuacuaaccauuaaaagacuagcgagaugaagucaaaauauauuaaaucacuuuuauuuccccuuuaccucuucugcagcuugcuuagaaaugagaucggcuucaucuuuguuagcacauggggccugugaucuacaggcaagcugauacugaaacuucuuuaagguuugugcauaaucacccacagaacgacuguaauuccagaagguagggcugguagaaggagagguggaaucugggcucccugaaauugaauugaaacuguuuuaguccuuacaguauuuauauauauauauauauaucaguaauaauucagagaugcugggcaucuaggaacuaggcaaccccugacaaaacucagggaaucagaagacaagcacccuccaacuguauucuaggaauuagaagacaagcaccccccaacuauacucaagcagucagaagacaagaaucccugccuccuucccacacuggacucaaggagucagaagauacaaccuagaagcaucuccccuggccucaacauugucuucucuuuggagauuauuaguuccuuguguuaaaaauuaacaagaacauauucugagcaguaucaacuuaagaggcucaagcaguacgaaugguugggagugucuauuuuuguuguaaaauuaaacuuguuuuauuaagacuuuuacuaauucagggaaaaacaaauguuuggacguuccucugaauggagcaccagcaacacucuguuaaaaagccuuuuucaacuuaaggcuauacaaauugaauuuuacaugguagcugguaguaauuccuggguugauuaaaaccuucuguggaaacauaagacaauggugucuaggagcccauguccaucagugcccccuucaagacuuacggcccuuaggacuaguuaguuuguauucccaaagagaagaugaacucuuguagggugaggaugcuuucucuucuaccagcauguagcauggcuaaacaaacacgcucucgauaaugaguacacauaugaagaacugcaucuuagaguaugagaaacaaggucuccauccagccugcucagaauagacaaaacugcuaaaacugagaaucaugcuuacuagcaauguaaaaaucaacacuacaaaaguuuagguauuuauuuaguguccaagaauuacagauaauugaacuguuggaccaacuuugaaaaagugggcucagcaucacugacgaaggaaaaaaaggauugaaaaaaaaaaucuuaaaaaaaaaaaaaaucaaguagauuugagaaaagcuaaacuuuagaguccaaaguaacuaaaaacaacugagcugagagauaacaagguuguucuuuucagaagauugucagaucacuaaacacgaagagcucacaaggaagucucucuuuguaaccaucuuugcauugaugcauuugggcaagcucucugguggauuacugcaagcaggaaggcuggaagcaggaaaucaaaggaaaccacuauggaggaagcugcuugcaaucacggugaccacgugauacaauuuccucucaccagacccaugcagcaugcaucuccuaagcuaaugcacagagacauacaacuaagcuaccagaaaacacuuggaguucaugaugacaaaacaacuggacagauccaauuuucccaauaggcugaucucuuuaauaaacaugccacacacacacacacacacacacacacauucuagguuaaagaaggcaaaagaaaugcaacuaaauggagcaacccacaucagauaagaaaaaguaaguuccacaggucaucacugggucaacugucuaauaauaugucugaguuccagugguauugcaauuaaaaaaaucauccagaaguuguaaggggaaacaucccguccucagggacaugugaacuaucaagagaugaagugucacaagggcuacaccuuguuaaaugacucccugugagccaguguguagcuucucacuccuggaaauugaguugugaauauggaauuggaaucaucuauaugaauuauuugcuagcuggauguuugaagaaccuaaaauaugaugccuaaguagcaacagcaugcacaguacuuagaaauuaacuucuaaauaccaucuccucuaaaaagaaaagaaaaggaaacaaaacuuaaaaaaccaacaacccagucucaggaaaaccagagcaacuucagagcuagccagggagaguacaggauggggcuuuuuauuuuguauaccuagaaagugaggggguggggcaagaaugacaggcaaaaaugggaaagguggggcagagauggauaagacaauguucaaagaaagauaccaagaauacagacaccauuucuuuuucucucuuuuuuuuuucagacaggaucucaccuuguagcccuaagcuaucuugaacucacuauauagaccagacuagccuauaacccagagaccugccugccucuaccucuggaguacucagauuaaaggcaugugcuauuaaacccauugacguaguacuagggaagcugagguaaguggaucccuggggcagcugcccugccagcuuaauguaacugccauguuucaggccagugagaguccacaucaaaaauuacaaaagugaacagcacuggaggaaggacauuuaaggcuuagcauaugaacacauguacaaugggcauaaauacacgcacaaauuccuacacacaaauguaugggggaaaauauagaugggaugauacaauuaaaaaguccccaaacagacaggcuuauaauucuaacacucaagagacugagucaggaaccauaaguuugaagauugcuugagugacauaauaaauucuaagccagccugaauuuaauagaaugacucugucuuaaaaacacaaagauuaaaaaaaaguccccauuagaacacagcaauaauuuugaaaagaauuuuaaacuaauguuaaaagcagcauuaaaauuuauaauggauauuuacauagccugagaguagguuugcaaaaaaauuauuaauuuaugcagaauauuuaaauuacuuaaagcuuacgaacacagcagaguaguuaaauguauagaaauagacaaagacagagagaccagaauuuggaguccauguucuuuucaaugugucagaaccauuuauacaaaauugaccauagagccuccaagcaagccuaagauuaaaaagccuuccccacagagaaagaaaagaagccccaaacauugauagagaugagaaucucuaaccgcagcacaauuaacuuaggaggaaauaaagauaauaacuagguuuugucaagcuugacaaugaaaagcaacagcaauaacacuuacaaacaucgauaacaauacuucuaaaugugaaagaaaagauaaaaaggaaaugaaaaauaucugaaaaucauaaaagauauguacuaguuguucuuugugcuacucuauaauuuucaauacacuucaaauauuucaaaguuucaaaacagaagaaaguaacaagauaauauugauuuguuuccuugacauuuguggcacuugcaggcagaauuaaauuaaaaccccuuagagauuccaagcgacaccgagagccaugcuccaguaccuuggcuuccucgccguggccacgguuuugcaccuaaugugcuuucugugcaaguuuccuggggggaaaucauuacucaguucaauaaccuaauuugguuucaaauaauugacuuuguaauaaucaaauccaccucaaauagauuaagacuugcuaacacuguuucccuagguaaacuauaugcuuuaaggaauuauuaagagacaacuuuuauaauguuauuaaaaaccaaaacaaagccaccuccccccaaaaccaguagcacuuuuagggacaauaauguuuuuugccaacccugccuugcacaucaaucuuccaaaaagacuaguaaagagcuaucguuugaaaagcuugccaucuacugcuucaaaacauacacagccacaauuuggaggcaugcuaucucauaugaaaggacuuuuaaacuuugagcagagaaagacuuaagguugcucaggucuuaaccuccaaaguuuaacaguuaaucaaguauuaauuuaacgauaugaaaaguaacaaccaaaauauguaaauaaaauacgcuacccagcuucacucuaugcuguuucucuuccucacuucuaaggaacguguccaaaguucucaggucugucauguaguccucuuugucagugggugaguuguagaccguggguggagaacgguagcgagcucucaauccacugcucuccacugggcccacagugguaggguauggagaagaaggagacagacuaaagcuggccaacuacacaaaagcaaagaaugggauuuuacuuuaaguucacaugcaaauauuuuuaauguuuuuuaaaauaucugucugucugucuaucuaucuaucuaucuaucuaucuaucuaucuaucuaucuaucucuuuauuuauuuaauguauaaaugaguuacauuguugcugucuuuagacacacuagaagaggacaucagauccuguuacagaugguuguaagccaccaugugguugcugggaauugaacuuaggaccucuggaagagcagucagugcucuuaaccacagaacccucuuuccagcccuauuuuuaauuuuuaaaaguaacuaucucugaaauccuggcacccagaagcuggaggcaagagagcugagcucaagacuagccucugcuacccggacaaugugaggcuagccuggcuacacgagaccugaccuaucuaaaauacaauaguuaaaaaaaaaaaaaaaaagccgggcaugguggcgcacgccuuugaucccagcacucgggaggcagaggcagguggauuucugaguuugaggccagccuggucuacaaagugagcuccaggacagccagagcuauacagagaagcccugucucgaaaaaccaaaaaaaaaaaaaaaaaaaaaaaaagagaauucaacagaggacagcaagaugguuuagcagguaaaggugcuugccauucaaagacacaagccugacaaccugagcaugacccacacuaauagaaguuaucuugagcauuuuuuucauucuuaaaauguauuuagcgggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauaaaauaauaaauaaaucuuuaaaaaaaaaaaaaauguauuuagcgccuuccgugcuugcacacaauuugaguacuauggagauguaggcaagaggauaaggauaagguccaucacccucagcuauacugugaguuugaugguagccugagcaugagucugccuaagucucaaaacuauaaaaaagaaaggaaaggaaaagcugggggcuggagagauggcucagagguuaaagagcacuugcugcgcuuucagagaaccugaguucaauucccagcacccauauggcaggcagcucacaguuagcuguaacuccaguuccaggggauccaauaacccuacacagacaaaagugcaggcaagacaccaauucacaucaaauaaaauauauauuguuuuuagaaaaaggaaagaaguagcaguagcagucuugauuccaauugugcuggaacagauggcugagacgcgagaugcaaacugggacaaacaaggagacuguauacaagaaaguuuuaaaaauuauuucucauucucuuauucuguacauucagauuucuucgaguuuugggcugcugaaacuaauguuaugaauaccacuguacauaaauccuugcuugaacuuuuuguaaccuuaaauaauuguuuuuauuacauuuacggaggguggggcucaugcuugccugcauguggcgcuccuuugcgccacagggcaggugugucggucagagaacagccuuuuuuggcguugguucucuccuucuaccaagugggcccugaugaucaauuagaaccccugggcugguggcaaacaccuuuauguggucagccugugccaggcuuucaucacuuucuuuagggaagacucucaaacugaaaccauuuggccaaagcacauaacccuuuaaaauauguacuuccaucuauuaagugaaaacgucacugugugucauauuucuuucagaaaaggaugggggggucuguuuugguauauguucaucuauuacuacuuuaaacugcuucuucauguuuaagauuuucccucuccuuuuggacugacuuacuuaucauguaugcauguggguacagaugucagagaacaaccuguguaaguuggucucucuucugguuuucaggcagggcuucuguugcuguucugcaugggucucuggcucacucucuagucuugacacaggagugcugggguaacgugugccacugucaccagcuccuuagguggacuagugacugaacucaggucaccagauuuacaaagcaauuuaaaaaauaugaaaaucagggcaggagggacggcucagcagauagaacucuugcuguucuugcagagaucuuugguccccagcauccacauggcauuucacaaccaccuguaacuccagcucuaagggcucggaugcccuauucuagccuccaugggcaccaagcacauauaccugaugcacauacauacacgcaggcacuuauaccuacauacaaaauaaaaaucuucaaaaaaacguauauauucauaaaacuacgguauucuaaguagaaguuaaacaaauuauuuuugaauaguaggaauauaagcaauuuccuucuaccuuauuuucuaauuuuuuuauaaugaucauauauuuuucuuaugaaaaccauuuuaaaaagcaauacucaggaggggaaagaauaugaucaaaauauauuuuuuuuucaaaugaaaggaaaaaaccuauuauuuucuuuaaaaaaaagugacacuaacuugugaguuaugaauucuaacuacacauuucuuaugguauuuaacuuuuacuaaacuaaaaauuguauaacuuaguacuggguaaguagcagcauuuauuuuucauuucagaggaauaucuuguaaaacauuagggacagacugcugcuuucuucuuggcaaucuucucucagccaguaccuagaggucuuugucuaacauggcaguaagggcuucccacggacugcuucucuucugauaccuuucuugcagccuuaugcccuacagaauuuaaauuucuuuucuuuuuuaaaaaaaguuuuugagacaguguuucuguguagcccuggcuguccuggaacucacucuguagaccaggguggccuugagcucaagauaucacuugccucugccuccuaaucgcuaggaugaaaggcaugcgccaccacugccuggccagaauuaaaguuucagccuacacauuuuguuagggacauccuagaaaaauuuagaccagcgcugaugucacuaaggaaaaggauuucuacccaugacacagcaaguguccacacugcagaagcaagccacaugaggaucccaggugugagcucagagcaugugcaugacagaaggguuaaaauucuacaagagaaagugaagccuucacacagacagcuugaaaagggaaaacaugcuucgaagacucauauuacccuucaagccugcugaaaccagcuggugaccacuaugcuuuacuacuccccaaaauguucaugguuaaagaacuccugacugagggacaggaaacuugcuuucuuuucuggcucuucauggaugauuuagacaaucaacuguccuucaguuuccucaccaacuaaaugcaaagucuggacgaucuuagugcaauucccaauucuggaguagcaauaccaggcaaacagaaagagucauuaccuuauuguagccacugacaggcgaguaagucacaccagggcuguaagagccaaggccuccugacgacaggccuugcaguugagggcuauacccagucauacagcugguggcaaacuugggacugguacugggugaacgagaugggcuauaacuuaacacacuuugaccuugaaucgaaggggaagguggagauggagagauuuggguugcugccaaaucacggggagguguagucugcacaacuagaagggaaagaaaauaaauuauuacauaguauuuauuugcuuucuuguuuuuguagacuggguuucucuguguagcccuuacuguccuggaacucacucuguaguucaggcugacuucaaacucuuccugucucugccucccaagugcugggaucaaaggcuaucaauauauauuuaaauugaaacaaaaauuuaaaaauuagguuauguuauguaacucaggcuagccuugaccuuaaacucuuccugccucagucucuugaguauaaauaaaauuaugagagcagauuuaagggcucagcacaguggcacaagcuuuuaauccaaacacucagaagguagaggcaggugcaucugaggccaggccagccugguauauauauauauugaguuccaggacagccaaggcuaaagagacaccaaauaaauaaaaaaauuaaaauuuagaacauaggcaaguuuuaaaaauauaaaauuaaaaacaaaauuaaggaacucaaucccccccugccucccaaggagaaaaaaaacugcagguucuggcuauaaaaucacaggaagcauuauuauacaauuagaacuaacuggcuguuuacuacuucuacaauguuuaaaagaguaaaauauauuugcacaauguuauuugauguuccacucaauucacagaaauaacaaugauaauuguaucagaauuuccuauaaacuggcuuuauguaauagauggccuucuagcucagucuauaaaaagggaaaauagauaaaggacuacccccugcuccccccagcuccccucccccacaauacuuaccagccuguuucaacccuaacagugcuugcuguccggggcuaacuaccagacuuguuggugcuacgguauauuugaaguaucuccaaaaaucaaacaaggcauuaagacugaagagcgaugcaagugcgaguucuagaagaaaccgguaacuuuauuauuaagauauucuccucacuuauuugggggcauguggaggucagaggacaacuuguugguucucuuuuuucaccaugucaguuuuggggaucaaacucaggucacaauguccgguaccaagugccauaauggguaagucaccucuccagcuccaauuuauuauuauuauuauuauaauagauuuauuuauuuauuauauguaaguacacuguagcuguccccagacacuccagaagagggugucagaucuuguuacagaugguuaugagccaccaugugguugcugggaucugaacucaggaccuucagaagagcagucggugcucuuacucacugagccaucucaccaguccccaauuuauuauuuuaaaagcaaaauggucccaguuucauuuugguuggggaauaaaaauugcuucguaguuuagcaaauuaacaucaaaaauuaaaaacuauuuucuucuuccucaaaccagauaccacuuaauuagaguggcagaugcagaggauuuacuggugaguuuucaacuauuacuaauucuuauaacugcacaacacaauucuuacuuucauuuuagucaccaagugaguguuagagagccccuagcuuacuagcgagccaugauucuuacaccuaaagaucccaacucccuuccuuuuccaucugccacacccacucuaauaagacuagaaacaaacucaaaguuauuuuuauguguaugaguguuuugaugacauguauuggaccuccuagaacuggaguugauugagucaccuuggggguaccaggaaccaaaccugguacugugcaaaagucauagugcucuuaaccucugagucaucucucuauuccuggaugauagaaaccccuucaccccaagacaggcuuucucuguauagaccaggcugacuuuaaacucagagaucuaucugccucugccuccugaacgcugugauuaaaggugugugcuaccacuuccaggcucuccagggcucuuuauaucccaaggaugacucugauguaauccugaagcagaggguuuucagguguggcaaaggugaaccuuaccccccucccaugcuuuauuuuucgugguaggacuccuaacuucccaacucgguauuguuuauagcuuugaccuuagagagguggucucaggugccaggcuggccuccaugucugauuccuucucccucccaaguaccgggacuagauauucugccauaccuggcuucuauuuugguguguuuuuguuguuguuuguuuuugagacaggguucugcaauuuaucccaggcuggccucagacuugaaguaauccuucugacucagccuccuacuagaauguucuuuccauaaaagggguuaccucguuccuucacuagacucaugacuuugggaaacugaguaagaacucauuugucugaauaaaagaaugaauacuaagcugaauuaaauuuacaagcaaguuuucauauguaguaaaucuaaauuauaguggaaauuacuuaccgauauaccagaggggccaguaugucacauuauaauauguacugauuaacuuuccaguccugaaaagauuagaaaggcuuuccaguuauuuaaauaaauaaauaacacgcccaccacaaaccaaccaaacacuuaaaaccaaaacaaauauaaaaagccacagugccagccaacaauaguuaaaauuuucacuuaugggcugauuaacuuacauuucaguauauaucauuccagccauggauacauuuaggaguccccaagcuaaaaccacuuuccuaguuucuguuucuuuucucaucuugaugguucugucaauaagggaaggauuggggcuuacgucuccuugcaucuauucaaaggcaaaacaaaaaacaaaaaaacaaaacagccugaaaugaaaagaaacuacucuuaagaaaucaaaaaugucuguuguaaaguaacugcucccccccccaacuuuucucuucuuuaaaauuucuccccaacuuuccccuuuaauauuaguauaugaaacuuuaauauuaguauacacaacccugaaauaucuucuuagguaccacagaaaaaucagcagggaacuugcugguuauuucagagaagcuaaugguuccaauaaauuaaaauguuuugcuacauaauguaaugguuuguuauuaaguucgcaaagaguucuuuugucucugcuucgaguuacuacaucuagaugaagagacaccagauaucaacuuuugucauuacugugucagacccuaaccuugaccauggagugauacaggcuuagcaucuccuuuuggugaugaaauuguaaagcuuuucucacgggguggacggguacuauucacgugaagagucaagagagagacgggaacgggaacacgugcguucaguuuggguuacuaaaacugucaucuccuuugucucgcuaggcucagcucugcaaucacugagagggcagcucccgggagucauauucuagagcacauuagcauccuucccgccuuccugccccgcgccaaaacucuccucggagagcuucccucccuggcuaccucaguacgagcuuuauaauuauccuucaugugucuuucuucccuugcacuacaaguggcaagauuccuagcuacaucauccccuggcugaaccucaggcacaacuuuagguuuggaacucugagggaacagcacggacuccauguccaggaagcacaagacaacccccccaaacgcaccauguucuucagcaggaagccguggacucgcgccacucccuacugcacaugcgcagaggcaagacuaaggcggcggcggcgggcaagccgggcuacaguu

SEQ ID NO: 2884 - RNA, 169354 nt, Mus musculus
  misc_feature (112764)..(162763): n is a, c, g, or u
agacucauugucuucagcacggaaagcuucccuguuaaggacuugucucuuccugagauuuccuaguauccuuaaagguaccacaagccagguccuucucuuuucuuccucuuucccuucucucucuuccuccccugcuguucuuuccugcuugccuuuccuuucuuugucaugaucucucuauuuugccaggauggucucaaccuccugaacgcaaagcauccuucuccuucagccuuccgagaagcugggacagcacucacgugccaccacgcccagauauaucuuucuauugugaauguaguuuuuauuucugugggauucuuccccuccagccugggcugcacacaaagaaaauguacaacuucucauugguagaaaauuuuuaauuucaauuuuaauacauacucaaaacuagagagacaguucuaggaaagcuaaacaugaaaaaagaacaaagaacuuacuagcucacaucccaagaagggaacuuucaggauuuaagucaauccagucaaagucuggacuuguuuguuuguauguguagacaagcaaacuagaaauaaauccuaauguggggaaccuauugauaggaauuuggaacauuuuuuccagauggugguuuuuaucaacguucuucauuuuuaaggcccucauagguuaccucccuuuauuucuuacuacucaaaacaucggccacuagccuuccagucuggggggcuucacacaccauccaacaaaacucuuaagucccacaucccugaggacaccuccuuccccagccucauuaaccucucuuuucucuaaacggcagguucccuaagcugguccucacacuucugauaguccauacuaagaagugcagcaggaacuggagagguagcucagcacuuaaggcugcuugguguucuugcagaggaccugaauuuuacuuccaacacucacuucaggcggcucacaacuaucuuucacuuuagcuucagggaaaucugagaccucuggccucugcaggcaccugcccuugugcacacauguccuucauacauaauuaaaaguaaaauaaaucuuguuuaauaaguauagcgcacacacauacacacacgugcucaugugcacacacacacacacacacacacacacacacacacacacacacacacacacuuuccccagcuucucaggccuuagcuguggauaaggauuguuguaaguugaaagaaaagggaacuugaaaguuggaagaaguucuucagacuuucccuuuccauuguacauauuucauuucauuuuauuucauuucauuucauuucauuucauuucauuucauuuauaauccuuaaauagguaaaucucccauuaaccguauuagacugucaccuuuaaauccuucaauuaaugauuuaacuuuacagaugaaauugagacuuguaagaaaugaagucacuaauguauuagugcguauuuuuccuccuccuccuccuccuccuccuccuccuccuccuccuccuccuccuccuccuucuuuuuaauuuuuuuuuuccgagacaagguuucucuguauagcucuggcuguccuggaacucacuuuguagaccaggcuggucucgaacucagaaauucgccugccucugccucccgagugcugggauuauaaaggugugugccaccacacccagcuguauuuuuccuucuuauguuucagguuucauaauuacuucccuuucucugcccucauugguuaaauaaauuuaauuuuucaagggcaaggaucaucagacuuuacuuaacuccaacaucuauaauacuauuuauuaaucuucucuuguuucuuacacaggaucaagauugagucugggcacacggugugugcuaagaagagaauaauuuauugacuuuugaagccucauagauggugaaucauagaggcacugguuuuaggccuugaugaauacuagcugugaguugguccaguucucagugaauagccaugggcccaaagaaaaauuccaaguaggaagucuucuuugcuaagcuguaaacaccaauuucuacuaacuuugucgugcauagcacccucgauguugugaaucacagaguagagcuuuauuaaguauguuuuaguugacuguuugcagaaacaaaaacaaaaacaaaaacagaguuggauccguauuucauguggcaacaaaaggauucuugccaaaaagaaagcaccggacugcucaaaaugaguauugauggaauaagaaagagcuuuucauauaguucaaggcugacuauaugaccuugcagaagaaccuaagauccugugcagcuuuguaaacacacacacacacacacacacacacacacacacacacacacacacacaaaugguaaaguucuacaauaaagaugaugcaaucguauuaacuguuauauacauacaguaagagaauacaucaaaagggcauagacuuuaagauauuuagacaaagugaacuuaauugaaucuacccaguagguucgggaauauuuuuaaacccuuuagucugaacuuggaggacuagggauguaccucagugguagaacacuugucuggcaagugaggucccuagacucaaucuccagugugggaagagaagagucaagaacuucaaaauacuuuauaauuaggcauuguaacuuccuuccuccucgccuucaaagaaaguggauaucugguggaagacagaaacguaagggaacaauaauucuucacgaguguuugccauuggugacuaauuuuacuacucuaguucuagaagaagaaacuuuuagauguaguugggaaaaugauuugaccauucaucuaaccaaagccaguagggaucagaaauuucauugugaguuccccuagcugucuuuguuuucaugacugaccaauuagcuaucacuggccaaagucagggccauuucaauauggaagacaagcagguagguauuuaaaauaguaguaggauggucuagcugucugaaagaauuuucuugggcauucuacuacagaaaccucuuugagugaucuaaaaaaaaaaaaucaacuuagcagguguccacuuaucucagagaaguccaguaaucucugagucuuaaguuuuccuuuccucaacacgcaagauggauaugaugcaucuauuugaguuaugggcaccuaaguuacuaaccucucgaguuaaguucccaaacuuaaacggagugagucuguggaccugcagaaaugcucaggagucaguaaugcaccuggaugucccacucccuuuucagguuucaagaagucaguggaucaaagccugugggaaaugucucuauuagguuugagaaacaacuaggucaagaugaugaagagguaagaagacaaaacaacagcaacagccuuauaugucccuaugucaucuuuccuugggauugcuuaaacuaucuuacaaguagugggcuuguaaacuuccuauguaaaagcaaaggugaacaaacauuuauauacagagugaaguuaauguauuccauuuuugaaaaaggaacagagaaguugaggcgguaacaaggguauaucaucaacaaaucaagacacaaaacugaaaaccacuuaccauaggaaguauuaaauccuaacucaacuagacggcaaucuauuuuuuuuuuaauguaaaaaaaauuuuuuuuuguuucucuagacuugguuucuguguaggcuuggcuguccugaaacuuauucuguuggccagguuggcuuugaacucaaagaccgauccacuugccucugccuucugagggcuaggaucaaaggcauguaccaccaccaaccagucacuguuuaauugauuuuaaaaguuaccauaugaaguaauguuuaguuuuagauguuuuguuuuguagaacuagaaacuaaacgcaggaccccguguacacccgucaaucacucuaucacugcgcuagcuccguacuccuugucuugguuggguuuuaucgcugccacaaaacaccaugaccaaaaaucgaguuggggaggaaaggguuuguggagcuuacauuuuuagaucauaguccaucacuggaggaagucaggacaggaacucaagcagggcuagaaguuggaggcaggagcugauuucagaggccaugggggaggggugcugcuuacuaguuugcuucaugcggcauguucagcuuguuuucuuacagaacccaggaucaccaccagccagggauggcaccacccacccuaggcuaggcccuuaaccauuggucacuaauugagaaaaugccuuauaguuggaucucguggaggcauuuccucaacugagguuccuuccuaucugaugacucuagcuugugucaaguugacacacaaaaccagccaauauaguccuuucuuuaccuuuuaauauagggacucacaaagauguucaguauaaccuugaacucaacauccuuuggccucugucucugccucugucuccaguagccaagaccauaagccuaagccacuaagucuaccauagaauauaaguuccaaugugacauugaauaugucauauguaugugucaguauaauuuauuccuauguguccaccuccugccacuguuucuccauguuuuguagucuccuuuugcugaccacuuucuuuugucuuaaauagcaccauuuucuguguucauuucacuaauauucuguuauauacuguccuaguuagccuuaacugucaaccugacacagccuggagucaccugagcagguagucucaauugaagaaucacccagaucagauuggccuguaggcauaucuguaguggacuucuuaucuugauuguuaauugauguagaaaggcccaguccacugugggcagcaccaugcccuaaguaaguagccugugcuagaaagcuagcgaagcacaagccugggagcaagccagcaauuccuucauggcuucugcuacagguucuugcucugauuucucucagugauggacuccgacuuggaaguguaagccaaaugaauccuuuccuucccuaaguugccuuugaccagugucuuuuaucauagcaacaaaaaagaaacuagaacacccaccaccaugagaucuuccucucuuugauggucucuuuucuacuuucaucuucccucuucagagcugaugauccaaacacagaauuauguuugucuccuuuuauucugucuuccuggaauacuaagaauguaauuccuggucucugccuccaguguuguccuuacuuucauucauccuuggcuaacccggggcuaaggguuuggagaggagcucuuccuucaucaguccaaauaacagcacccccacaauauaacgauccuaaguacuagacagaaggggcaucaaaaucuaacuuuuucagcgucucuagaagaauuguauuugcagagauauuuggaaaugcaaaauguucucucuucucccuuguccugugcgcgucagcucccagcucaguuggcagaguugccccuggaagacgcuucuuagguuguucuuuuacuauaacugguuuucuccuuaauaguuagccccauguuaugucaccugauaguacuccugugugggggaagaggaaggcugugauuccaccugccuacugcccuucagcuucacgugauaucuugugugugugugucugucugucugucugugugucugugugucuguugugugugucuguauguuuguguuuguaugucagggccuguggggaggcauugugugucugucuuuaucuguguaucagggucuguguuugugucugugucuaugugugagggucugugugucugucuguguguaucagggucuguaugugucugugucuacgugugagggugucugucugucugucugucuguguguaucagggucugugcgugucugugucuaugugugagggucugugugugagggucugugugugugugugucugaagugugagggucucuguguaugucugcaugugagggucuuguggaggugguauaugugucugucuaaggagacaggagaacgucugcaggguuuguuccuugggaaucaugaaccuugucuuuggagacgcucucucacugaucacuaguuagauugagcugacuaggcaaggaacgccaggguuuuaucuguauuugccuucccggagccaggguuacaaucaugugcucugacacacagcuuuuugugagguugcuguggaucucuugcugacguggcaagcaccuuuguggacugaguuaucuccguagucccuguacacggagcuaggcagguccaccuuaccaucuacauccuuuccaucucaggauccugcucuccugucucuagaccuuguucuagaaacgccagaauacaacccaggcagaguagguucuucucaguaaaugcuugcacagcaagcaugaaggaccugaggucagauccccaggucaagguugggaauguggcucaguugguagagugcuugcuuagcaugcacaaagcccuggguuaaauccccaaauccuggauaaaacaggcacgaugucacgugccuggaacccgagagguuccacgugucuggaacucgagaggcagagacaagaagaucagaaguuaacuugggauacagaagacccaauuuuaguucuuuuuaaauguggcagugugggcccauaacccuaguaucuugggggaauuggacagagacaggcaggucccugggguuugcuuuccagccagucuggcugaaucagugagcucuggggugagugagagacacuguguuaaaaauaaggugaagagaaacacacccaauguuugccucuggccaccaccauuaccaccaccuccaccaccaccaccaccaccaccaccaccaccaccaccaccaccaccaucacacacacacacacacacacacacacacacacacacacacacacacacacacacagagagagagagagagagagagagagagagagagaggugugacuugagaccacuaauucuguuccuugucuucagauguaugauacaacugcacaaucgaaauuuguccugaagaaccucagacacuacacagugcauccaaacaugguaggugaaaaacauacccccagagaccucuaagggcaaaucucagcaauggguccauagcccugacuucagagaauccccaguuucugguauugagagacggaaccacuuuggggauacagugcugggacuugguugugaggugggaggauagaagaaauuaggggagauguaauccacacuccuuccucccuucccucucuagucuuccuagucagagaaaagcaagcucuguggugacugucccuuccccacccacaccugcagugacucacugugcuucgugacugauguucucuuuuaacaggauccagagcuuguuaguaaugugugugccuggaaagagaugcauggugggcaugagaggaaagcugagccgcuccccucugccucagagacaggcagagaaaggccagucaggcugagccccauacagcuccuauugugcaaggaagcugaaugauggcucccuccccuucccuccccuccccucucuucucuucccugucuucuucucucuuuucuccucuuuucugcccucuccucccuuccucucuucccuuccccuuccuuuuuuccuuccuucauuucuuucuucccuuuuuuucuuucuuuuugugaaugaccuuaguuaucuuguucuguuacuauggaaaccccucugcugcauuuccccuaagccccuaguuuauuugcagcucuaaaugaagguuguaacagagagcucccaaaaguuucaaaucaacaaauuuaaaggcagguuugguuggguucuauucagccucucagccuauccuguagagagagagaaaaaaauuagccaacugauuccucagucugucuggaaaucuuucucucuccucaggccaaauacuaugagccuuugaagcccacuaaacugcagagauuccugacucaaaagaagaaaaugaauaguuucauguuaaaggugacagaauaugaucaggauaugacguuacugcucaugacuaacaacccaccgcccugcuccaucagucaggaaaaggauggugcuccaauauacuuccccccggaguuucaguuaaagguaaagaugcccaagaaagucuccuagcagccuauguauggaccagauggaggcagggguuggaguaaacacagagagagccaaauuaaccuagagaaggguuacuaggaggcuccuuaggcccaggccacauacuccaugaaaccaaaacugcugaguuugaagucagcagggucuacauagcaagacacugcugucuuaaaacaauacauaaaaaauaauuucucaacaucuucaguaagcuagaaaccagaacaaggccaugaagaugacuguaggacaaauucuauccugaagaaccuuggcaucaaauaaucaacaaacgauccacaauagaacaauucuacuguaccaggacgugugaacaauccaaaaacacuuaaaguauagaaauuacauacgccagagaagaaucuagagaggaaaagagaguuaucaaggaggcgacucacuauggcagaaugggagaacuguuccugagggacaucggaagacuaaguuagggauacaagaaagagaggcaggagauuaaagggugugaucagauuuguguuuuagaaggaacaucugcagguugaaggaagaugcauuaguuguagaagagacaaaagccagaaauaugaauugugauguuacuuuaauaguugagacgagcaaugaugaaaaucugaacuaccaucaaaauagcagaggaagggaagaaaguuaauuuaagggauauuuggggaucaggagcugaggaaaacguugacagccuagagagugaacccaaucucccaggaagaaauuaaauaaauuugcaguacagaugaaagagucuuauagagacuagagucuugaaaugggguagcccagugacugauccuuagaacaaacggugagcugggaguuggaacuuuuuuagucacuaggugaaggaugccaaaaugaaaaaaaagaacucauggguucauugucuguggccucagaaucugugcccugccacaguagcuucaagugcuuaucgugauagugggucuaacaugcuucugagaaagaaacaaauguagccagggcuguucucuuuaacacaaagaaggaaaagaaaagcaagcaugcaaccuaagugcacggagagaguucuuuccaaagcuaucccuugugagcccgauuguccucccgaggaugugguccugguggcacuuuaguagugggcaguacuaaggaccagauucuaaaggcuggaaaggcucuuuaauacuccuuccccuacucuuuuugguccuggauuacauauaagaagaguauuccuuacugugccugggcacagugcagaguauaguaggcaagcugagcaaugugcacaucaacaguugcugcucucaucccucccugaugccucugguuguugcccugucuccuaugagagugccuaaaaggcguuguuucauacacuauaaccacaucucuacuccuaguauggaccagauaucagauccagugaaacaaaauuccuaggccaguaacugaccugugguauaaagugguaucucuccaaacccaaacaagcuaaaacuaaaccaaucacucuacuaaccaccaaaucccugaguaaaucacagauuuuuuuuuucucucaaacuucuagcacuugaauuagaaaacauaaagauuagggugaugggaaggaaaauugaaaggucauacagggugacguccuggaagaaucaagccauggaaagaggggccaggcauguaccaguugaaggcacagggaaggguggaaacaggaguggggggaggagauagauauaguucuauagauuguaucucucuguauguauguauauauguuuguuguuuguugcaaaagggcaaaggggcuacagaaguuucagaguuugagaagaaggagggagggagggcgggagggggaaagaggagaguggaggaggaagaagagacaggaagaacacagaagggacuuguuagugaugugguaugcuuaagacaagauggcaauucucuacucgugccaccuuggcuucuaaauaacguccaguuccugcuuauuuuauuugcuuuuaaauguuaauaaaaaacaaaaggagaaaaaaaagucuuuauuuucugugaggagauguaagaugauauauuauuuuagcuagcccauauaaaagacacaaaauccugguauuguacuucccagccacauaucccuuguuagaugugaugggccagaagcacaugcccaaagugaaauggacccugaggacagacugacggagaggaaauggcccaggcgagacucaaacaagucccaagggacacauggcuaagaaguaaguuagaaugacucaaacucugcccaaucuagguuuacagccggcaaauaaaauaccaggauuuuaugucuuuuguacagguuaggucaaauaauauaagucacuuuacaacgagagagagaaagagagagagagagagagagagagggagagagagagaggcguguggagguuggggggacaaccugcuggggucagcucucuccuuccaucauguaggcccuggggauagaacucagaucaucaggcaacaagccccuuuuucuaccuuuacuacagagccaucucgacaccccuuuuguuuuguuuguuuguuuguuuguuuguuuguuuguuuguuguccccagacccaguucugcuaagguuucugcuguuuuuaauggcagggucauuagcuacaugcuagugcuuugguugugcuauuucauuaagucaccuauuaaauaauuggcguaagguucuauaucuucagacuaaaacagcucaaagagaaggaauucagaacggaaaugcaaucguccaguggugauaccaaguauuuuuuaaaaagauuuucgagucaggaaaguaaaagcuuaauaugucaauugauagcuuggucaucaguucaacaaacauuucucuucuccuaugugccagauccuaugaaggacugaggauauaucagugaauauucuaaagucuuuacuuuacugaaguguaagucuaaugauuuaaacucucuaugcagacugcaaagaagcaaccaugcagaucguuuauaaugugacaggugcuuuggaaaaaaaaaucagaaaggggaaauagaaugugagugggagguuuagauaguguaauuuagggaggugcucagcagagguuauggcuauucaauagacauuucaaaggagucaggggacguaucaugugauugcugcucccagcauccugggucucauuuuacauagccucccguuaggaaaacauuacuuguaacuuucucuaguaagauaaaucacaagaagaaggcaauucaaacugagucaggugacaaauaguuuaaaauauugacacuguguaucucagggaaaacagaaccuagguggaaccugguggguuuuuuuuuuuuuuuuaauugagugugcuguguaagaggcacuggcuucauucugcuggaacuauuuuggaaaaaaagcuacaaggagacauguguuagcugauuaaagaugaagcuuguucuuagcaucguugccauuaugauuaguguguguguuccauggagaaggcagagcaggcacggagguauuagaaugugugcaagucagaagacaguuuuguggaauuaguuuuagguuuggaacucacguuuccagccuuggacagcaaucaccuuuaccugcugagccagcuuaccugucuuuuagguugguguugcuuuguuuuuagguauaagacaacuggaucacuugacaggaaaauucuggaugggaugugagagccagggggccagucagacuggaugacuuuuaagagucugaaagcuuuugauuaugugaccuuuaggaaugguaaaauuaugacaucauaaaaccguucauucuauggccuuuccauagcagaaaaaaaaaagaaagaaagaaagaaagaaagaaagaaagaaagaaagaaagaaagaaagagagagagagaaagaacauagcagauaaggcagcugucuccaagaaaggaaggaagguagaguuccauggguuggcuucccgauuuaccccuaaauauuuggucuuccgagcaagucacagauugggucuguuguaagugugcugugucagagacagacaggcacaccugugucuuuaccuaaugucagaauucauuaaguaaccauaaacucacaaaccacuuugcuugcuuugguuggcugcaauuugccaagcagucuuguauucccuugauagcuggcugcuggcaaacacagauuguuuuauuacaaucuuaacuacuaauaaaaacucucaacuuugugcacauugugugucacguggugacuccauccacccauccauccaucuacccacccacaaaugugaagauuucggaauggcuagaaaaggaucuagaagcuucagaguuugagaaguuuggagagaccuuaucggaguguuguacccuucaguuuuaggaguaaguuauuugucagucugcuucaggguuggugcucaacagaaggugguuucuacaugggcuacaaaauacagaauccuccuucuccacacuugcucuuaaaaugcagcuuaaagcuccuuuguuaaauggugucacccaaggaaagaacagcuaaaaagucaccauuuuacacaauauggaguaacucagagcagggcacagcuuuucugccauaaacucuuccaaacccaggaacaacuucugccauuaauuuucaggagcccauggcuaaggaguccagucaguuacuccggaaacugacccaguuuggggaaagguaccugaggauaaaaugggucucuccccacuuccucucuuuguggucuuugugauuucuuuuucucugguagguuggguuugccauuuuaacuuuucacauuccauugugauuuaggccaggaacucagcuccauuuuucaacuucuagagacucaguuuccuuucccuuucaugcuuuuuuuuuuuuuuccauccucaggaaacucuccaucggugcaaacccaacaagaaugacuucuuucccacaaugucucagaaaaagaaguuaaaaccagagcugaagccagucuucccuaugaaacggcuagaugauccuaccuucaagggacaacaaugguuuaggugaagugcuagcucuuaucgggccuguuguuuucuguucucucccuuguguauauugcugaauaauuuagcaagcacaaauagaagcucagggagacuugggauaagguuaguuggaagagaaugugcuggagaaguuuccccaugcagugugguuguaaagaugucagaacacauaagacguccuuuguguuccaugacauaaguuuuguccuuagcaguagggccucaccaucagguaugggagacacaguaggacugaggcacaaugugaacucauagagaccauggcagcuuagacaagaucuucccagguucaagacagaagggucccagaacugagagggagaagcagacaccagguucugguuucauaaucaaggaacgaucugcaauugguaccugcuggcaaagggaaaauuguuuugguuuguuuuguuuuguuuuucaauggagucucauuaacuauaucaaccacauuucaggguaggccccaugcccaggaauuguugaccaacacaacaaaacaaauuuaauggcauuuuuguggacuuuuuaaccucucccucccucucucccuccuucccuuccuuccucucuacguuccuuuuauucuuuuuucuuucuuucauuauuucuguuuuuuguuuguuuguuuguuuugagauaugcuuucucuguauagcccuggcuaccuggaagucauucuuuagaccaggcuggccuugaacucacagagauccaccugccucugccuccugagugcuuggauuaaaagcaugcacuagcaugucuagcuugcuuuuaauuuuuguggguuuuuugcggguuucuuguuuuuugguuuuuguuuuuaauucuuuucuuggagacagaaggaaagaaaauagaaaguuggaugugugggaucagggaagaauuaggggaggaaaaucacuuucaaauauauuuuuuguaugaaaauguuuuauuuuuaauuugguuuuuaaagacaguuuuuuuguuuuguuuuuuuccuguguagccuugguuguccuggaacucacacuguagaccaggauagccacauacucagagauaugcuccccaagugcugggauuaaagguguacacuacgacugcuuggcuugugugaaaauguuuuauugaaacauuuuuucaauaaaaaauaagaaaaaauccauauaagauauggcuuccaaacacguccuauaucaucacuuauaugcuaauaaaagaaacacagcuaugcaaaacuaaaguuuuccacugacaauaaucucaagagagaaggaaaauguauuuaaagaucugugauuuuuguuuuuauguuuuguuuugguuuuuauauguaggagugcucugucugcauguacaucugcaugucagaagagggcaucagaccccauuauagaugguucccaaccaccaugugguugcugggaauugaacucaggaccucuggaaaagcgcucuuaaccgcugaaucucuccagcccuaagggucuguauuuuuuaagauauagaaaaauaaaagugugagguaaggaccagaggaacgaaugcuaugaggauacaaauaaaaaggaggucuuuuuaaagcuggggagaugacucaauaacuugcucacugcgcacacuugaggaccuacguuugaucuccagcauccauguuaaaaagccagguggugcggugcaaacccuuucugccagcaccgggagagagaaugauucuuggagauucugggccggacagucucgaaaaccccagcgucagugagaagcccuaucucaaaaaaaaaaaaaaaaaaaaaaaaaaagcuggagaguauaugaggaagacgcccaaaacauguauguggccucuacacuugcauacacauaugugcaugugugauagaugcaugcacucaugggaacaaauacuuauuuuagcaaauauuaaaagguuuuauuugaaacuauucauaggagauuuuuauuuccuacugagaagacaggauuuuggaauuggcuacaagguuugcaguguguuaagcucucaaacccuacccuccaucuuuuuuuuaaccaacaaccccaacuuucuaguuauuguccuuucuucuuccuuggggucucugaggcuauagaugacuuuuaggugccacucaccugcagcccuagaccaaccaaguauauacuuuuuugguuaagguuuucuaccgacaaugauuucaacaucgaagggaaguauucugaaaucuaugcuuuaaggaaacagaaaaaaauguauccuaaccucaucuuugcuccagccucccagagagagacaaagaaacaugguaaggucuccuguaucuuuugugguagguucaggcacuaauuuuccuagaaggaaguuaagauggugcuagacuauuuuaauacucaaauuucaagaagguucaagaaguauaggguuuccugcccuguaucaucuaacacuuugauaguuuuugccauaaugauagauucucaaggcuaaaagcaaacaaacaaacaaacaccccucaaacuaaauuugcuauaaucuaccguaauugcugacaacaugauuuugauauuuagguacauauagguugaaauguuuaucugugcauaaccuucauauuuugugggaaauugcuuuaaagggccaaagcuuaaguguguacauuguaagcuaaaugcaguggcucaugccuuuaaucccagcccuugagaggcagaggcaggcagaucucaggaguuugagaccauccugguuuacauagugucuugaaacaucaccaccauaaaaaguaugugagucucagaggcccacaagucucucugggaugacgugagacggggguaagggagagcugggaccaggacauguagaaggucuagugugugucucauuugauaacacccaugggggccucugcauuagacucuuacuaaacaccaaaggaccaacaggcuagaccaagaaaggccucguauauuauauaaacaugggcuuagauuuucuacauuauguaguuggccucacugaaggguuccagggugucaaaugcacaacuguaguuuagacacacacugaugggucuuuacacugcacagccaucgcuuuagcauaaggcagucauuuccuagcgguauagguuauaucuacccuuccacuggcuccuuuccuuuucucuguuccuccuauugcuaccccuuccauccuaucccuaccuaugcuucuccuugauuccccauauacaacuaagaccaaucuaaagagagggaaaaaaaaaaccaaucaaaccaaaaaaaccccuagaucaaugugggaaacagcugaggcagcagagcgauccaucucgcuuaaaagagcucagucucaccucagccccaguuuauucacucuuccacauguuccucucacauuaccuguuuugagcaaucgccaggcuucaugucccuguccuuaccuaacucuuaauggcuauaguccaagggagaagagggccucuucuccaaagcuuguuucauuuucagccaaagauuguagaagaggaaacaucuauuucuuucaugagaaauuucacaugaugaauauuggucggacuuuauauaagucaaaugagguagcuagaaucauuaguauaguauuuacauuuuaaaauuagguuuacucauuuuauuuuauguaugagugguuugcuuguguguauauccgcuuaccacuuacggcgcccacagagaucagaggagagggcaucggaucaccuggaacuagaguuacugaugguuugucagccaccacgugagugcugggaauugaacucagguccucugcaagagcaauaaauucucuuaauuacugggccaucucuccagucccuagcauaguauuuuuaaucgggauggaguaacauuuuaaguggcaccauuacuaagguuugggcacauuauucagcggaaucuauauaugaugggaauuuuuucuuuuucuuuuuguuuuuucaagacaagguuucucuguauagcccuggcuguucuggaauuugcuguguagaccaggcuggucuugaacucagagaucugccuucugggauuaaaagcgugugugcuaucaugcccaguuugaaauuuuucuuaaggguauguagcauaaucuagguaggaccuuuucuaagcccugucaggaugagauagaucuucauguauaaaguaauaugucagccuucagcucuagugucauuuauggcgacuacauaugcccucuccaaauaugagugcuuuacuuuuguaccuaaaaugaacagacaguuauggugcauuuccucaacaauaacaaagcugccaggguguuuuacuaguggugccauuucuaagcuaacaucucugucccccaaaugaugcccuaucauuugugugugugugugugugugugugugugugugugagagagagagagagagagagagagagagagggagagagagagagagagagagagagagagaucugaguagaaguugucaaguuugguuagaagguugcccaagaggcaaaccacgcccucaacggaggaaggacugucauuaagaucuuaaaguagucaacgcccuaagaacaggugaagcuggaaagaccuucuagaaaugugaugucuucgaugcccaaggcauuaaaagcguguuuuucauacucugagacgaggacaaaaaaaaaaaaaaaaaaagagaaaacauuuggaaaagcacugagacacaugaguaucccuuaaauuacuugaguguuaugcagauugaaucauuugaaaauggugaaagccaagaaaacuacacugguuugggugaagaaggaaucauaagaaguugggaauggcaguccccaaaucuacccucuuggaaaguuaaauuaagaccagcuuuucggucuccucaaauggaucacaucacgccuuccuuuuaguacgcuucuagugcucucagagucgcacauucaacguguccuaugcuuugucguaguuuccaugaagucagagagugaaacaccaacuucgcaaguauuuugggaaccccugacauuuucaaagcuccuagaagagaagccuacaagaagugugccaggggagagcuucuuucgccauggaagggcccagcaguggauugucaaagaugcggcugucauuuggugaagacaaagacuuaaagccccacuccucacucuccaagaacugagggggccuggagaagucacuaaccaaauaaaguucccuguuuguugucucagaccuggcuugcagaguuugugaagcggggcguggugagccuccgggcagauucuggccacgcccccgugcggcagugggcggagcagggggcgugccugcgucccuagggggcaagggcggccgcggaggcccgaggggggcgggccuuggccccgagugacggcccgccggcccaaccggugcgagaacccagggccugccuuccugcagcgucuuccgcucgccggcugcggcgccugggacgguugcggugggucugggcgcugggaagccguccaagaugauuaaaaaauucgacaagaaggacgaggagucugguacgcgcggcgcuccggacgcccacucucaggcgcaaggguuuccccccuucccucgcccgcagccaccugcucuggggggcggccgcagcggcggggucugcccgaagccccucccccggcgccggggccuccccucgggccgcgcgcuccuggccgggagucgccucgagcgcucggcggcuccgccccggcgcguccccgccccccgcgcccgccccccgaucgagccccuccgagccggcccuccguggggcccugucggggggcgaggaggugcgcgcgcaagucucgguacccugggguugcuggugggguuaggccccagggcgagcacccccuguuuugggagcuggggucgaccgggccaggguugcguguuuauggacucugaagggccuugauucuccuguucccagggguuaagacugcccggugggacacagcucauugaaugcucaggcauccagaagugacuugcguguugauaccugucuguggugcagugcaaguggggaagaugccaagccucuucaaaaaaaaaaaaaaaaaucuucagcucuucagugguagcugcucucacaagugugguggaagguuggguuaguggaccuucauggccucauccugcauggccuuuacaucugugacucucugcgaaacuguuccuuucugcuucaguaaaugugugaaacacauaaaauagggcuugcuuuuagggaaauccauaguguccugucaucucauuacucuugguggugguggaaaccgacacauuuguuaacauccaugggaugggggagggggaagcagggaaugaaggcacucauuuuggauaggguuccuauaucaggagaaguccaagauaucucaguauggcaaugacagaauuugaaccagaaucaaaauuacuucauccaacuucuuugcauauuaguaauaguuguccuugugacuuccaagggaucauucuguuuaggugagauuuccaagcaugcaauauccuccuuuagaaaagucuuuguaguccagcuauugaagaccuucucuuuuucuuauacuauagguagugguuccaauccuuuccagcauuuggagaagagugcugucuugcaggagguauggcuuggauguguacagugccuuaucaauucuguuugagaauaaugggcaaagaaccuaggaaguacaaaagucaggacagccaaaaaaacagugaaggaccguagacccaccugacagucugaauaucggucuucccccacauuugaucaaaacuagaaaucccuuuuuuauuucuauauuaaaagugacaacggaguguagcagugcagagauuguggaguagaggacaagggagaggcugggacuauagaaacguacagacauauagacucugucgugugcugggggauuuuaaugacaugucaggagugguaagugcaagguuauuagaagagcuuacagauauuaaacucgaggcauucauauguagacagagacucuggucaagucuuuaaaguugaaguugucaaccuaaaggaauaaaauauagccaggaaagcagauaaugucugguaauuuauuguacgucauacuaccuugagagcauagacaaccugcauuacuuggauauuguacuaacauauuguuaaugcuacuaaagaugauuugauauccucugugauagaacauacacaauauacagcauacuguuuugcauauuucuguaggcacgcauauucaacgaaacgcccaucaauccaagaagaugcuugcauaucuugacaaagauucuuuacuuacucaaccagguaaacuauucugauuuccuucgauuuguguauuaagauagaaauauauaaccuacagugaagaacuuacugaaaagcagaauuguuuaaaaaagaaaaucauguaauuugaaaauccacagugugugauuagaacaauaaugugugaaaguucuuuaauacaaggacugagccuauauuccuuguuuaaauucaugagguauuagaccaacuaaacauguacauuucaauagauauguugauuugaauucaacaaauacuacuuagaacauacuuguuacauguauuuauuuuuaguauuuuuuaaaaagauuuauuuauuuauuuuauguguaugcauguuuuaccugcauguauguaugugcacaccaugugugugcucuugguucacagaggucagaagagggcaucaggucaccugagacuagaguuacuuggaaccacucuguggguucugggaaucaaaccuggguccucuguagaguaacaaguguuuguaacugcugugccaacagcagcuugcauguauuuugagauccuuugaaaauacaauguaaaguuagaauauauuucaagauuuuuuuuugcuuauuuauuuggcaugauagugaaauguugaaauuuuugucuuaauguucagguuuuauauuaguaucaguuauuacacuaauacugucaauaugauucuagacaaguaauuuaaccauuaugugccucaugauguaaaugagguuauaauaccaauguuuuaagcuuuauaguuaagugaaauacuagcuauaaacaguuaucauagugcuaggcauauuuguauucagaaauacuuuccauuguaacucagugaguuuuacugcauaccuguugugucuuaugaacuguucuagguacuagaguuauaacagacaaaaccaaaaacauauauuuaaaaaauucuguguucuauuauugcuauuaauuuuccuauuugcuuuugccucaaacuguaaauacaaucucaaaaacauuuagaaccuuagaaaauagaauuuuauuucauagacaauauauguaucucuauagguauuuauauauauaccuuuauauauauuguguaucuggauuauuuauauguaaugcuaaauguguuauacuuuccaacuuaaauucuaagaaagcauuuagcuuuuuuaccuuugcuuauuaacuuugugugugcuuacaucaguguauguggcagucaguucucuuucugucauguagaaccugggaauugaacucaagacuucagguuugaugacaagugucaagugucuuuauccccugagcgguccccaucacuaccucaucaggaguuuuuuucuuuaucguuuuauuugauaauuaaaguuuuguuguuuuacaaauaaaguuuaauuauauuuuuaaaaccccuaauuuagaguuuuaauaaaauuuuguuguuugcaaauugaaacuugagaaacaaaagacaugucuucuugagcagcagagcugugguggcauguuaguuaguucaggacgucugagcggaaaccgguuugacuuaacucugcagagcagcuucuguacugugucagaaguggccaguuccacugugcucgcagaaucugcaguagggaaaguugauuugaagcagucagagucaggguuggccaauaccucuuuguuggagcaacuaauguugaaacaauuaccuugagaaggagauugcccaggacagcauaaacuuggucaagcagaaagguuugggaguguucauuugucuccuucccugguccuugguagaucauugugagaaaagaaaacaaacaaacaacaacccaaaacacuucaaaauuucuacagagccacagguucugaauuguaagucuaaauuuguaacuuaagauuguucguauauaaagaauugcacaggcuucuggguauuuguuaaguuucacauuaaaaaaggucucuuauugauaagcaaguuggacacugauuuaaauaguuguaaacucuucuuauacauuauccuucauccuaaaccuaagucaguuuuuuaaauuuaaauuuauuauuauuauuuuuuuacuuauucacuuuacaucccgcucacuguuucccccgcccagucaccaccucugacaauccuuccuccuucccucuccccuucuccacuguggggauggggcccccuuggguauuuccccucacccuggcacuucaagucucugccaggcuaggcacuuucucucccacugaggccagacaaggcagcccagcuaguagaacauaucccucauccaggcaacagcuuuugggauagccccagcuccaguuguucaggacccacaugaaagucaagcugcacaucuguacauaugaccagggagacuuagauccagccuguguauguucuaugguuggugguucagacucucagagcccaaagugagcccaggguccagguuaguugacucuguuggucuuucuguggaguuucuaucucccucuggacccacaauccuuccuccuauucuucuguaagaauuuccaagcuccuuggaaauccuugggaccgaggguguugaugccccaguguacaggaaugccgggguggguggguaggggagcaccuucauagaggcaggaggaggggggaugggauaggggguuuccucaggggagaccuggaaaggggaaaacauuugaaauguaaauaaaagaucuaauaaaaaaaaaagaaaaaagaaaaaaaaaagaagaagaaaagaaaacagguuaaaauacuucuucaaagggcuuggaaauaaaauaaguaaaguuaaagaaaaaaaaaaagcauucccaagcucuauccacuguuuggcugugggugucugcaccugucugagucagcugcuguguggagccucucagagcacugugugcuccugucuguaagcagaacagaaugucauuaauagugucagggauuggugcuugcccaugggaugggucucaaguuaggccuguuauucuuuggccauucccucagucucugcucccuccucugugccugcauuacuucuagacaggauaacuucuggguugaaaguuuuguggguggguuggugacucucuugcuccacugggguuccugucugucuauaggaguggcgucuucagguucaguaucucugauguagugagucacagauacgaucauccccauugauucuuagcugccuccuugucccaggccauguuaaaacuuuuuuuuuuuaaucaaaauucuuauacucuuggcaaauagauguaagacuacuuguauuuuauguaaaagaaagcccaauacuuuauauaggauuacuuuaguggaagaaguaagugucgaaaugguaauauuuuaagaaguuuuugacuagacauuuuugaaaauuauugacuaaguuuucuaggcgcgcacugccacaucagcagcuuuagcguguuuggagcuuuuacugcgggaaaguguccuguucccccaagaguucucugaagggacugcauucugacaaggccuuuaaguaaucuguuauucacauuaaauguuguacgaucccaaucauacuucuaagaguuuaaagaguguagggccaguguuuggggaucuguagcagcccuugaaacaaaaacaaggggaaucuagcuccuccucuuuugucuugaaccccgucuugcuauauagucuuggauuccucacaagcaguccuuuucaguuuucucucuaugaagaaccuguccugcaugggacauggccaggcauuagacuggaaaugcaccaggugcagguucugcuuguagguugugugaccuuaucaugcaaugcagauuggaaauucuacuuacuauuuuugccuccugguauauccuuaaaggaaauauaagcacuuucuguuaaaaauguagacaccacaauuccagaacuucuaugaguggugugcuauuuugaauuauuuuaaauaacaagucucuaaauggcccugaggucuuuuuuuuuccccugcagguuucuaaauugaaaacagaaaaguugccaggaggcagaauguuuauaaagagacuuccuccugaauucaaaugauuuuugaaucaaaugagaaauaaagagaaaauucuuaauaucuauauuucuuaguuuaaaaaaauucuuuuaaauuuuacuuagggugaacacuucggaacuauggaagcuacagaagccuucuuugcaaugacucgauuguuucaaucuaaugauguaagucuuuuuuuacucuuuuauggugaaacaauuuauuuuccucaggguacguagacuguuccaaauucaagaggguugcuuaaaauguuuaaaauuacuuuaaaaucauuuaucuuuauaaaaguuaucaaugcuuuuaaaacaaugugugaacauggacgaaguauauaguauaaagcuguuucugaagucacuggggaaaaggucauacauaccuccagguccgcaucugccaguuccuagugaagguuuuagugggccuggauugcuggcccaugggcuggcaguugagaagagcuggacuuggagugggggcucagcaagccugucaucagcgccuguguagcugccucucauuauccuuggccaccucacugcuucggguguaauagcugcugcuuuccuucuguuuccccaauguggcauauuucuucucagcccagguuuaauacagaaacauacggggaguugaagucuguaauacauagcacaggcuauauuuuguguccaguucucgggacucucugggauuugagucugccuguaugucuagauaacgaaggcaucuauucuuuaggcgccuauaagacuuaauauaugcucaggcagagggagagcagucacccccaaagaugacuuuuauugacaaaagauucuuggcagaaugugggguuucagguaccuucauuagaaucugcccaucuguccccaccucagucuucagacccucuuccuuccagucuaguucuccgggguaugacuugaguuuguuuuuaauuaaacuuccugcaggauaugcuuucccaguuuugugaucccauggccaugggaaaagcuuucuguuauaaagcaguuagagagaaucucuggcucuuuccuagacuuucagcuguccauucaaaccuguuaaauucaucauuauuuuuuuaagaauaaaaaguugcauguauaugugugauguucaugugcaugcauguuguggagccuguguggcagucagaggacugcuuguaggacucuggucucucuccaccacgaugguccugguguuugaacucaggccuuuaauauugguagcaagugccuaucuacugaaccaucuuguuggcuccuaaacaaguuauuuuuagcaucuuaaguuuuaacaaccuaauucuuauuagaauguacucugguaacaacugcuuauuuacccaaagcucugcccucuguaggucuuugcagaugauaauguaaauauuuaugcucuuuaauacuguugacuacuuagguuccccuaguccagaagaagugguuucacauuccucgccuucagggcgugcuuccuuuuaaugacuuucuauacugacaguucaggaaucagagaagcagagccaugugaguauugugccauuagguauuucuuuuaggaauuagacuaaaaaaguaggcaucucaaguuguuggaguagggccuacagacuugguguuauaaaagucaggcaaagguuauauguggauccaguuuugcagucagguaccugguguuagaccacagaugggguuagcaaauggcuauaggauuaauggguuaugagugcugacaggauacacaggguugucggaguugcaugggggcugucacugauagaggcugugacauuacauugagucucucucaucaugaauuaagguagguaauaugguguaaagggcauaaccuuucagaccagguagugcacugaaagaaggugguguuaauagcuaaaaaggcaucgaggaauagcugcuucuuugucugggggccaugagaaagaaaacaaccaccauuuagaaaguugcagggcaauccuuggggaaaauuucaauuagauggaaggauaggaacauuuacggaagggugaaaaugcuaagagauuuuccugaugaacagucauagaauguggcacugcguguguguguguguguguguguguguguguguguguguguguguguguguguguguguguauguguguaaggauggaaaauagaauuguucauaauccuuuuuaauaaagucuguagaaucuguacugauaguuaucauuuugauauggcuaaauuauauauucuuguauucuuuagaguuuugucuagaggcuuauaccuuagcaauaaagauauucuuggaacaagcuuuuugauuuguggacugauuuuccccuauuaauuuuugucuuccaaaguaacuuggggaaaauagaaugagcugaggauauugcuuaguugguagagugcuugacuugcaugcauaaggcccugaguuuuaauauacagaccucccuaagcuaggcaggaugguaugcaucuguaaucacuugggagguagaggcaagaugaucagaaguuuaaggcuauucuuggcuaccuggugaguucaagucuacccccugucacaagugagacucauugaaaaugugaagcaagagaauaagaaaauaagaacaagagaaaagaagcuaagaaagacaaacacacagauuuguguaaccacuauauauaaaugaagaauacaauguuuacagaaaguugcugcagaacuggggaaaaccagacaagucauuguaaagaacaaaaucaugcagaguguuguugagcuauaguuuuagcucuacugcagcaguguaaggaaugaguugugacaucaguaggaaaggaggugggaaaagaagaguccuauuguauaaauuacucucauugauguuaagaaccacauuucuguuuuguuuccaguguaaagggcuggguuugccccgcuaucauaaauacuagggaccagacaaaagagcagcucucagacaguguacccaguaugcaaggggugggaucugaagaagggaagcaagcaagaugaccccuggaauuguaccguuagcugcccagaggcagucuacagacauagggaaggucggaugaagcugggaaagccaagaaaguuugaauguuuagggaggaucccagagaaaaaggagaaaagugagcaugaaacucaguguacuuaaagauagugcuagaaacagucugaaaugagcugaagaagaaaggcaacaaaaugaagaacacuaugacauauaagauaauauuuucagaguuucuggcaguuauccuaaauugcuucaugaacuuaucaaaaucuaauauucaucuuuaucuuuuuccugcuuaugggaaauuugauacucuuagacacucuuaccguauauaugaauauguaaacagagacauguuuuauauauauauauauauauauauauguauauauauauauguauauauguauauauuucuguguauuuuuauauguagagaaauacaucuuuuuagcuuuuuuucuuucauucaaauuugucucugcuacuuuuuccuucuuacuuuucaguccuugauauauauguuccuccccuuucccccucccucguguuaaaucagacugaaaaucauuguuuucuucucuuuccuuauuugacucaguggugucaagcaggcucucucuauagcauacacucugagucuaaugugugugaguuucuguacuuaaaauacacugagcauacuuggaaagaggcuggacagacagaaggagccuggggucuguaaguaaagcagagaugcagcugaggagauucgggcuggaaccuuaucauuguuaccaucucacuuuggauccugguguucaucuggaaaauuuugauaacuuaaaauggaagcugauuauccaguaccaagucauuuuaggacaaacauuggcauuuacuaaguggaggggagucuuaguuaggguuucuauuccuguagagaaauaccaugcccacggcaacucugauaaaggagaccauuuaauugaggcugacuuacagguucaaagguuuuguccauuaucagcaucccaggaaacauggcagcaugcagguuugaugcuggagaagggacugacaguuccauguauugauccguaggcagcaggaaggccacaccucauaauagugcuauaaccugugagccuaugggaaccaguuacauucagacuaccacaagggaaaaacauaguuagcauauuucugcauacacauuuguaaaaaaucuugaaaaaaaauuucugagacaagucuuuaucccuuuaaacaauuauaucuuuuuagaagaguaauuggauuuuuaagguuuugcuuuuauguuuuuucaagcauuuguguuuaagaaacaguauauuuuaaauauuuuuuacccauauacuuuaauagguuuuaagagguggauaucuguaacacacuuucauacuuagcggaauugacaguaaccuguuaccaucuguaaacacacuuucauacuuagcggaauugacaguaaccuguuaccaucuguaaacacacuuucauacuuagcggaauugacaguaaccuguuaccgucuguaacacacuuucauacuuagcggaauugacaguaaccuguuaccaucuguaaacacacuuucauacuuagcggaauugacaguaaccuguuaccgucuguaaacacacuuuuauacuuagcggaauugacaguaaccuguuaccgucuguaacacacuuucauacuuaguggaauugacaauaaccuguuaccgucuguaacacacuugcauacuuagcggaauugacaauaaccuguuaccaucuguaaacauacuuucauacuuaguggaauugacaguaaccuguuaccgucuguaacacacuugcauacuuaguggaauugacaguaaccuguuaccgucuguaacacacuuucauacuuagcggaauugacaauaaccuguuaccaucuguaaacauacuuucauacuuaguggaauugacaguaaccuguuaccaucuguaacacacuuucauacuuagcggaauugacaguaaccuguuaccgucuguaacuugcagcaaacgcugaggcggaugugcuaccucaccaucaaggaaauggccaccaucucugaggaugugaucauugucacaagcagguaugugagcagucagagcuaaggacacaagacguacuaguuauggaauauuuguucuguuuuuguugagugccaauaagaauuuauuggauuaccauaucuuaaaucauucuuuucuuaaaacacuguugucauauauaauauugguuacucucuugaauggauauuucuuuuugacugccaauaaagauuuguaagaauguuauuucguaaaccauucuuuuguaaaacacaguugucaucauauaaaaacuugcugaaagggguuacaaaggauaaagauugugucuuuuuuuuuuaaaguuuauaaaaaggcugaggcagguggauuucugaguucgaggccagccuggucuauaaagugaguuccaggacagccagggcuacacagagaaaccaugucucgaaaaacaaaaacaaaaaaaaguuuauaaaaauaggggcuggagagauggcugaugugguuaagagcacuuccugcuguuguguaggacauggguucaguucccaucauucauauugugguuccuaaccaugugcaacuguaguuaucacggaucuaacaccuucuucuggccccuguggacaccaggcccacacaucaccccccccacacacacacacaccccugcaaacaaacaaacauauacauaaaguaaaauucuccuuuuuuccccuguuuuuuggagacaggguuucuuuguauaauagccccuggcugucuugaaaccugcuuuguaaaucaggcuggccuugaacccacggaaauccaccugcuucuauggcccaagugcugggauuaaagacaugagucaccauacuaggcaaaaaaaaacaucuuuuaaguucauaaaaauaaauauaaauaaaagcaaaacugaagaguaacuguuuacugaaauaagguguuaguacaacaaauaaaaagauuaucauuuuacauauaaagaacuuuuaugcuuaaaaaguuucuuagggauacuucacaaaguaaccagucuaaagaucuaagaaucuuuacauagucacugucacuaauaaccaaaagaagugaauuaaagauuucagcuuggaguguaguguuuacacaugaggucaucaaaggcaaagcagcagcaguaacugccugcagggcugaugcucugguaugcagagguuagaaaaugggcuuuuggagcgcacuuaagcugcauuuauuaaugaauuucauccucaguaauacauccugaaauauuuaucuguuguaugucugucauuguuaaaauuacuuaauuaggaaugcaguagucacauaggaaauauuucaagcucuugggauuauuuuugaaaaauauucaauaauaugaaaaauuccuuaguacauguaaugcuagguagaaguugaauucaaucuguauauccuauauagucugacuuuaaagaacuauuuuauguauauguauguaacaauaugucgguaaauacacuauauuaauaguaguuuaucuuuggcuacuuagaauuauggcuaauauuuuguuuaaauguuugguaauuucuaaguaucuuagaaugaaauaauauaauuuaaaugaaauucuguauaauuuauaauaaaaugcaucauuuuacacuuuaauaguugucauauaagaaauuaaguauaauccauuuaaugaauauaguuuucauaaaacaaacuacauuuugaaggaagauguuuauguuuaguuauguuuaguacaguuucgauuaaagcuucuaguuggaaauaucagaaaagcagauguagacagugauuuaaccaagaugaaacuguacuucccucguguaacuguaagucuggaggcacagccuagcugguguugcugcaaccauuuuacaguagcaggacuaguagcacuuggauucuuuuguauguacuccaucauugcgaaauagcugcuugaauuacuggcagugucccaugcucaagcaggagagcuacugaaaaggggccgaggggugccaguaccaucugugucuuucaucaggagugcagaagcauuuccucaggcaauuuuuagauuucauuugacacaucuagauuauauggcuauccuuaggagaccagaaaguaaguauuuagcuuuuauagucuaaguacuaggggcaggcaagggagaagggauugaaaauuaguguggugccugccacaaacaagaaauagaaagcauucaguuacauuuuuugauucccuaaauucuugcgaaguuaaagacaaauaaugguauuuguuuaaaugguuaauacuucccucugagccuuauuggauauaauuaggguuuacuucuaguguucuuaagugauuaguaggugcgguaagcugcauaauucccccugaugaugcccaugucugaauucccagggccuuugaauaugauacauucuauggcaaaaggcaguaaaagcugauaggaguauucugguuuauuuauguaguccuuuaaaagguuaagcauucuuaaaauugaggagagggcuagagagagauggcucaacaguaaagaauacuuguugcuuuuccagauaacccagguuugguuuccagcaccaacacugaguagcuuacaacuaucuguaacucuagcucuaggggauccaacacccucuucugguauccucaugccauucaaacacacacacacacacacacacacacacacacacacacacuaauaaaaacaugucuuuauaaaaaugcaagcgggagacagaagaagagugucagucaagagauaugaucccagcuaagucagagaugcuguuaaagauuugaaaauaaaaagguccugauucucagagcacaggugaccucugaaguugggacuaaugaggaaauggauucauccugccuucacuuucuguugcuaaaacaaugccuggggccagguucuuuaaaaaguagggagguuuguuuaguucauuuguggcuaaaaguuuaagacuuguaucuugguuuguuguggugcuaugauaaaguaccccgacaagagcagccuaagggagaaugguuuguucugacucacaguuucagacaguuauagucugucucaguggggagauauggcugcaggcagggaaggcaugguggcaggagcugggggcuggcugauuaccuuucgcccacauucaggaagcugcuagugaaaaggaaaugggcuggcauauaaggccuuaagggcugcugcucccagugacccacuucuuugucaaggcuucaccuccuaaagguucuauaacuuacuuaaaucuacuaacagugagagagcaaguguucaaacacauacgugaaccaacguaggacaugucuuauucagaguacuauugaguagcuccgucucuuugaccuuugcugagggcuccauggauuauaauauaauccagcaucacaaugggaauguauagaagauugggugguaagaccagaaaucagagggauuuagcaagccaguauuucugggguuuguuguuauuguuguuuuauaacaacuugauuucacagaaauagccauguccucagagaacuuuuaauaaucacuugugggggcaugcccccagugacuuaaguaccuuuuacugggucccacuugacucaggcuccaccaucuccauacuggcauucuggacacuaagcuuccagcauccggaccuuuucaggucauacucaaauccuggaaccccuguagcuuuaaaaauacaggccucaaaaaucccaauuuuaguccaguaagaccuauuuuggacauuagcucauuaacuguaaacuacaauauaaaaaugaauguuacucuaccccuuuaacuuugagcuauuuuguuauagcaauaguaaaguagaaaaaguaauacagauuagguacguagauauaugaguuauugcuauaacagaaauccaaaaguaguuuugaaacuuugaagguagguuaggaaaacucuagaucagugguucucaaauugugggucauggcuccuuuuggggucauuuaagaccauuggaaaacacagcuacauuacaauucauaacaguagcaaaauuacaguuauaaaacagcaacaaaaauaauuuuaugguuggggucaucacaacaugagaaacuguauaaaagggucacagcauuagauagguugagaaucacugccccagacuguuaguagaaacuuggaucucaaucaauguguaagacucagaaguuaaaggagcaggacagaaaaaaaaucaccuuaaagaauauccaaaaucaccaugaauagauuguuaguagaaacauaggucuuaaagaugcugauagugaggaaucauuggaagaaugaagaagcuggaaaauguaggagggggagugguuuuacuauaguggcaggaagcuuagcaagcuauguucugugcuuaugugagaaguauggcuuauaauacaugaacuuagauuuuaacugaugagauuuccaagcaguguugaagauugauucugauuucuuuuuauguguuuaguacacuuugccccuucuuagaauugggaacaaaacacccauggaaggaguuacaaagacaaaguuuggagcugugacgaaaggauggaccaucuagagacugccauauccagggauccaucccauaaucagcuuccaaaugcugacaccauugcauacacuagcaagauuuugcugaaaggacccagauagagcugucucuugugaaacuaugccggggccuagcaaacacagaaauggaugcucacagucagcuauuggauggaucacagggcccccaauggaggagcuagagaaagugcccaaggagcuaaagggaucugcaacccuauagguggaacaacauuaugaacuaaccaguacccccggagcucuugacucuagcugcauauguaucaaaagauggccuagucggccaucacuggaaagagaggcccauuggacuuguaaacuuuauaugccccaguacaggggaacgccagggccaaaaggugggaguggguggguaggggagugugggggaggguaugggggacuuuugggauagcauuggaaauauaaaugaggaaaauaccuaauaaaaaaauuuuuuuuaaaaauugaaaguaggcaaauugagaagagaccuguuuaaaaagaaaccaguuuucuuuagguaggauuugggagguaaagacaggagaaucgggaguucaaggcauuuuugacaacauaguuaacuugaggccagucagggcuacaugagauccugucucaaaaacaaccgccacaaaccugaagaaauaauaacaacaaaacaccaaaguuaggacuugauaauucuuugucugucuaaagggcauagggugcuaacacuaagauagagucacugucaugaaagugugcuacugagaaacagugaaaggagucagugaugaaaaauuagaucaaaaggucagaggcuucauuuggacacuaaagaggucacccaugaggcucaugauucccuuagcacuuaagcagaagcugaaaauagagaugaguuuaucaaggccagaucuguaguugagccucugucuaaaagcagcgagucuguacuuauaugguagacccacaagaugcuugaguauauuaugccagcagaagcacuaugacuuugacuugaagguauacagagaggauggagugagagaagcuuucaacacuugugaguucagcauguagcaauaggcuaauaugucaguucaauuuugaggacauacuagcuguacuuuaugaucaaguggaaguggcuggcuucaugggcagaucuaaagagugacacugaaaacuauuuagauuucugcuuaagcacuuuuccuggcuagauuuuaaaguuguuuagggccuuucuuagucuuuuccuguuacugugauaaaauacccugaaaaggcaacuuaagggaaaaauggguuauuugacuuccaauaacauuauugcuaggauaucaaagcaacagggauuugaaugagcuggucacuuaauuuuaaaguucacaguuguagguuauaguucaauaggacaagaaagucacagcagaaggagccugagagaacuggugacauuauauccacagagaagcaaacaacaaugaacaaauuuaugcauaguauucagugugguuuuuuuguuuuugguuuugguuuugguuuuuggcuuuugguuuuugguuauuucuauacagcccaagauuucuugccuagggaaugguguuacccucagugggaagguccaaaauaaucccccacagacuuacccaaaggucccucuuccagguuguucuagguuuugacaaguugauaauuuacauuagcccucacagagccaaugacuuuuuucuuuccauuuucucuauuuuuaaauagacacaucuguacuuguuuguuauacuguggcauucuuacauuuuguuuuuguccacagguccagagauagggaggauagcugcaucaggaaugaaaagagucucauucaaaucuaauuugaugauuugauaauaagauuuagacguuagaauuggugaaauugugaugagauuuuagauugacuuggugcuguaauauguuaauacuguauacaugauccuacagucuggagauaccuugggauggggugaauguauuuuucagaugaaauggaugcagcuuucauggcacaaugauuuugugucaugaucucauggcauaaugaucacuauguuggacuuuaaauucuacagaacuguaagaauauagauauguacuguuaugccucuaauucugguaaucuguuacagucagacuagaaaacaaauagugcagauagccagccauucuauacacauagacaguguguuaaagggcaggaaaaccugaaggcagauacuucauaaauaugaauuaguaauaaguauauggaacuguuacuaucagggaaauguaaacuaaaaucucaauauguuauuaugucauaggauaguuaaaaacauggcaauacaaaaaacacaaacaaaacaauaacaaaacuuuaguauagaguauguaggacaauugaaaauuucauguacugugguacaacuguaacugcuuuagaaaacaauuucuuauaaaguuaaaucuauaauaacccuguggccaguaauacuucuagauacuuacccacagaaaaugaaaauauaugccuacauacaaaacuguguaagaauuuuguagcaacuuugugauaggucuagaccacagacaauccaagugcauguggcuagaagaauggauaaacagugugacuuacucaugcaguuggugugcugcacagcuaccagaaggaacaaaucggugauucagacagcagcacacaugaaccucuaaaacuacacguuagaacaacaacaaccaaaacccaaacccaauccaaaacaaaacaaaacaaaacaaaaaccccuacaaagaacgguuuuacuuuuuuaaauugcaaggacagucuaaagucauuuguguuaguagaagcuacaagucuaguggcuuggaugacugcauaaaaaugagcauaaggagcuuucugugggcauacaaauauucagucguuuaacuugguguuuacauguuuaccaugcuugccaaaacucaucuaaguggacacucagauuguuuugguuuauaaaguuacagcucagcuaaagaggaacuuaaugagauuuuguaacggcuuaaaguaggucagguagaccacgucuggugaugcuguuguaugugaaagccuaugucugaagaauguggaggauuuggggguugaguucuaaagaauauccuucaucugaaccuugggaguaguguauguguggcaggggugaugguaaaccuccauuacugaucuuagcagauuuagaaacaccuaaaagacuagugacacacaacuugaaugugucuaggaaguuguuuccugagaugcuuaaauaaggaauauccacccagaauguggguagugccauccuacaggcuggaggcccagacugaaugaaaaagguuuccagaaagucagcagaaugcugucauuuuccaucuuuuugcuucuuggcccaucaugacuucaacuguucugcuauauucuguccaccacugcuauauccuguccaccacugugggcagaauccucugaaaccaugagcuaaaauaaauccuguugguuucuaugaaacauuuaguuacagcaaugaagaaagagaaguaagaaaggguggguaucaguuugugguaaguuaacaucucuagucuccauaaauaaguaguucauaaauagugauuuguuguaguuuguaaucaugcaaaaauuuugaauuguuagaguuaacauauggauuuuguuugggagaugaaaauaguuuuagaaaacuaagucuuuccauguacuugaugaagaacauucaaaucugagccaguuugucugggugaaugucucaguuguccuugugacuaguuugagaaguggcugugagggacauggucagucuuuucugugguaaaaugcugcugucauagcucuucacuagcauuuucauuucaaauucaaaaaaugaauuuccagcugguauuugaaguccuacaaucuuugggucugagaaacucuauaguccuaauuaccucccaucucuacuccaaucuguacuucagaagugcuuacucaucagccuguggucaagggagcacuugaauccugggaguucaagucagugcaguucuguuggccaaaugccuaaugcuauuugauaccauguauccuuuuacauguuucuucucugccuacaauugucuuguuuccuuuuuugcauaguucagacacuuaguauuuugcuauugauuucccuauucuccuugacaguuuagcaauuucaguuguucuuaaagaacuguuuuguauguauacucuaguauuuaauauguuguucagcacacacuugucuaaguauuucucugaccucugcaccauuagaauauugagaacaagagucaugucuuacauuguugauacuguuaaaacuggaacauuaucucccauuuauagaaauucaguauaggcauguugcagagcguaaacagcauaaucuacuuuaaauaagggcagugaaauucucagcauaauuuaucuuccucucuguuuugggaaagucauaugguagggagggugaaagggguguuuugauggauguugagaacccuuucugugucugccuuucuuuauuuucuccuaccuaguauguauucccuuuucaaaugaaguuguggagacucuugaagagaggugcuaaaaugcuaccacaucauaagcauccuuuccaagccugacgaacaacagugacuagaaaugaaggccagggacugugaauuguagccaagaugaaguaaggggacuguagucugucuuucccaguggcacaacaagaaaguucaguaaaaauacaaaagaaacuacugaggccuccaaaaaauaguuaauagcaaguaaauuggggagagaaagcauuacuuaauaaaugacuacuaaaugagcagcaagcgucaugcguucugucccuuagacucugggcugaauuaggacuggaucaagugggauccagggagaugucuaccucuggcuugagcacagguugaagaagaagggccauggaggaccuguaaacugcagagcacagggaagaauuuguguugcuuuuuuccucuucuaguuuuuucaugaggacagcuccaaugauagaacaacuauacuaugguguguaauugguauuauagacaccuaaaaccccgagaaaaaagaugucacuggaaagggugcuccuggugagugacgaucagggcgaauacacuuacugucauuacuagcaacauccugcuuagucuuccguggcccccaaagcucauguauuugaaugcuuagccaccagagaguggcacuauuugaaaggguuaauaggauuaggagguguggcauuguugaagagugucagugggaaugggcuuugagguuucaaaagcccaugccaaguccagaaucucucucuuucaccuuuuggaucaaguuguagcucuuagcaacugcuguagugccugccuaugugcaacuauucuuccugcuguaaugguaauggauuaaaccucugaaacuguaagugagcacccaaaugcuuuuguugauaauaguugucuuggucauggugucacagcaauagaacagugacuaagacaauagcuaaaacaugcugagcaaaaagaacaauacuggugguaucuacaguacuuaauuucaaacacuaguacagagucacaguaguaaagagcagcaugauaccagcacaaauauagauagacagaagccccguaaguaacccauacaucucuuucuaagugauucuugaaaaagaugcuaaaggcuugcuuugggaaaaagccuuuuugacaacugaaagccuuuuugacaacuggugccuuauuuuguauagaaauaaacuaaaaauagaucacaaauuuaaguaugagauccuaaacuuugaaacuacuaaaagaaaacauuggucuggaugaagauuucccaaauagcacucuaguagcccagaaaacagaagcgagaguugagaagcaggaccaugccaaauucaguaagcuucacagcgaggaaaccauggaaugaagacacagucuacagagugggagaaaagcuuugcagggaacgaucugucugucagcaguuaaugucuacaauauguaaagaucagaaaaacaacaugaaaaaaaaagucaaauccaaccaaagaagggcaaugauaagaaaagaccccuuccguaaauucuguuuuuauaaaggcagaaauuuuauuucuacaggaaaagcacugcaguucauaguccacaguacucucagaucugagccacuauguuugaggcagcguuguugacaugaaugcucugugucgugcaagggcauguauuuuaugcucagaaccaaaguuucaguaaagucacaucaugcaacauggaugagcacugccagaacacacuaacuuuguucugaucuccacauaugcacuguaacauacuugaaucuucauuucugcauauccccccaauaucaugcacacauugcacacaugcaaaugcacauuucacugaagugcuauaaaggcaaucucaaauacacagaagcugaaguaauucucuucuaguauauuaacauauaaauaaagagguuuuuuuuuucagucagaauaaaguaaugaaaauguggaucuacauaaaggaauaggauauuggaaguaacuaaaaacacugugaaaaaacaagagaaggguuugaccuuggucugucugcauugaugaaacauagcauacuguauaacauugccaccuauuuuauggcaaagcagugugaauauauauguggguaaugguugucauaauuuauuuugccaaggagcaagcagcccaauggaguggugggaugcccacugagcaguauuaaguuagagacgguucccuguuagguuaaagacugucccucuaggacagcauuucucaaucuauggaucauaaccucuuucuuugggggcgacauacaagauauucugcaugucagauauuuacauuaugauucauaacauaauagcaaaauuacaguuaugaaguaacagugaaauaauguuaugguuggggucaucacagcaugaggaacuguauuaaaggguucguuccagcauuagcaagguugagaagcacugcucuaggaagcaguguacagugguauguggaugaugcuguuugaguuccaaugcaaucaugugaagaagagaagauuugaggagauauuaguuagcuugccuaagagaccaaugccguuugaaaaaaagcuuccuagcgcugccuuucucucuucaggccuuugaccauugaaaccaccuagagaguaccaguuuuuaaagacuaggcccucaccacacauuacauuuacuagccugaucuuggacuucccauccuccagacuguaagcaaaugaguuucuauucauuacaaauuaacuugaucuaaaauauuucuucauaucagcagaaauagacugaggcggcacucucuucccauuugugauguuggagagagauccucauuaguugagggauaaaaggcagaaacauuuaacuaauuggcuuuugguuccuguugacuguccucagcacagaaguaccgucacacuuuucuauacccagcacgagaaguugccuaccagggacaccccacacucccgcaucuaugaaggccugggacagggaguaaaguauauagugcaucaggaguaaugauggcugcugggccacuuugaagccagcaucuuagugaagguaaaguagccugguccacuuauagaggauaaugagcugaucuugauucuguguaguggcagcagaucccauugucguucagauuuguguuggccacuugaguacauucuggugcuuuuaugccuauggcagugguguuuggaaauaguccaaccaggguguauccaacaaagagcucauauccuguggaauauagauuugagucgcauucuggaaagauaacaggacuggaugagauaacaagacuggaugaaguauauacaaagaucgggggaguaauagaauagcauagaaagaaaugauggccaucaguuacagccuuagaauaaguuguagacacgaggauuucauacuguguuuugcucagucuucuguguucaggcuuugguugaaauaguauguaguuaccauccugaaccuucaguaguagauuagacuuaauagagauauguagauugaaggauguauauacauccugcauuagaugcuucuucugagccauguggcauaguuucaggcuucuuugauuguagcugugguauagugagcaauuguguguaggauucagcucacuuuauuuauauugccuuauuucuggcuuauguauuuuguuuccuauccagugggauuauauauaacuuauaucucuaugccccagaaaugugggagaauugauuaaagcuaauguuuagccagaugcucuaggauguauugcaaaaggcuucuuagacgacugcuuuguuaucuguguugcgauuccugauuaaaaggaaggagguaagauguaccguaguucacuguuucagaggcuccaggccauggacacuuggcucucgugcuuuuggucucuuaccuggugaagcagaucauuauucuggugagcugguagugcagguggaccauuugaggaaacaggagacaaaaagcagcagagaaaaaaguuggggacaaaauauacccuucaaagcagugaacugccucuucagccaggcuuuccugccaagguuuccaacaccucucaaugauggcaucauacuacaaauccauuaggagaucaaaaagcccacuagcuggccaccaaguccuuaacacaugagcccuuugggauaacacuucauaucccaaccauacaguugcucauuaaauaacuaguugcaaacuggagaacaucucuuuauacuaauuuugccuacugaccugcugucuuuccugugcuucaguucuuuagcacauucccauauaagccuuuuggagcaaaucuuuucuacacacagggaaaauaagacaguuauaaagcaugacuuaggaaacugugggucauggcuaaaaccuuugcuuaaucuuugaaaauaaaauuuuauuuuaauauagcuauacccguuuguaauacauuauguaugacugcuuuuaggccaugaaagauuugaguaguguugaggagaaguauagacuacaaaauucuaaaacauuuacuaauugauacuuuucauaaacaacaaaaaagccaauuccuaaugaugcuguagcaaaugacugcaaaccugcuaacuuagaacagcaggcaggcuugguggcuuaaaaacagcauagauugcucauuuuacaaaucaaggugggaagaguuuguuauacaaauauguggaccugaguuugaauccccagaaccaaugugguagauuagcauuagugaaaugggaagcagagacuagagaauuccuggaaagcccaugggcuagcuagucuggcauacggagcaguaaaacaacaaaguacuucaaacaagguggaaggcagagaccaauaucuuggguuuuccucugacguccacaugcuugcuguaguaugcaugugaucacacuuacacauaugaauguaugcaugcacacuuaccauauacaaaaacauacaaacacauauauuauauuaacacaugcaaaacaucucugaaaagcaauuuuagugggcuggagucagaggugugcccagggcuagcucuuuuuggccacugaaggaaguuugcuugccuucucuagcuucuggaggcugccugcaucuuuuuguuucauaugucauugucacaucuucuacauccuguaucagugucuuaguuaggguuuuacugcugugaacagacaccaugaccaaggcaagucuuauaaaaacaacauuuaauuggggcuggcuuacagguucagcgguucaguccauuaucaccaaagugggagcauggcaguauccaggcaggcauggcucaggcagaacugagaguuccacgucuucauccaaaggcugcuaguggaagacugacuuccaggcaacuagggugagaguauuaagcccacacccacagugacacaccuacuccaaccaggucacaccuccaaauggugccacucccugguccaagaauauacaaaccaucacaaucagucuccuguuucacucugguaaguauacuugugauuguauuacagcccacuuauaauaucuuauuuuauauggcaaaguccuuuguagaugugauuuuuuuuuuuagaaagcauuuuccaaguugugcuguuuuauuuuuuuuccuccaauuuuauuagguauuuacuucauuuacauuucaaaugcuauccugaaaguccccuauacccucugccuaccccauauucugguagcauccuaucuuaaagucuuuaauaaaaucacaucuacaagccagggccuggcaaacacagaaguggaugcucacagucagcuauuggauggaacacagggcccccaguggaggagcuagagaagguacccaaggagcugacagggucugcaacccuauagguggaacaacaauaugaacuaaccaguaccccccagagcucauaucucuagcugcauauguagcagaagauggccuagucggucaucauugggaagagaggccccuuggucuuguaaacuuuauaugccccaguacaggggaaugccagggccaagaagugggaguggguggguaggggagcagggguggggaggguauaggggacuuuugggauugcguucgaaauguaaaugcaguaaauaccuaauaaaaaauuggaggaaaaaauaaauaaaacagcacaacuuggaaaaugcuuucuaaaaaauaaaaaaaucuacaaaggacuuugccauguaaaauaagauuauagguucuagagaauagcaccugaauauauuugacacuuugcauuuagcugaucagucuuuccucuaauccucccaaguuacaucugccauacaugugaaauacauuuucccucuuacaauaguuuccaaagacuaaaacauggugucaacucuagcucagaaauccuagcugucaucauuuaaauugucaagagcuggagaaauggcucagugguuuagaacaccaacugcucuucuagucauccugaauucaauucccagcaaccacaugguggcucacaaccaucugugaugggaucugauguccucuucuggugugucugaagacagcuacagugugcucauauacauaaauauacaaaaaaauuaaaucuuuuuaaaaaauaaauaaauugucaaaauguaguauggacaaguuucugggcaaauucucuccugguaaagacuaguaugcuuccugcugucauaaguccacagaaaugugcuccuagauagaguggaggggugggcagagaaucgggcaacacgcauucucuacuguaaagggagaaauguauuuuuuuuagaaaaaggaauugauaaugcuaaacaacuauauagacuuuguuuaagcucaagccccuaccaccuguguguauucugcuuugauguuuuuguguuaguguaguggaauugaguagcugugaggaggucucaacagcuugcaaagccuaaaguauuucuuagauuguccuuguuagaguguaugcugguugacaguaugagucuuugucuuuugcucauuagcauguccaagucucuagaauaguacuugcuauauaauaaauacuuauuguaauguagaacaaaaaguaaagauuaaaguaauuuaauagaagugaaggggcaaaccuuuaauauggcugaguuaaccccaguuuauugauaaacaaaauauucagcgauaaaauauagaaaaauuuucuugguuuaugaagaaauaaauuuacaacuuaaaauagcauaguucauucaaacaaaaauuguaacagaaugaccaauggaaaaaaugcaucuuggauagauuauauuguugagaaaaaaaaacaaagagugcuagucccuuaaauauagguguaguggugugugccugcaaaugcaauccuagcaccugguacuauaagaagaggauuauaaauuccaagucagcuuaagcaguauaguaaguuccagcaccauacuacacaguaaauauggagggugcgaguggggacagacucaggggacagagacagauaaugacuccagagacugaccacuugaccaagucugguuuuagccauucaugaugguuugaagugucagaaagaaugggggcagcgucuacaaagcuauaagaaaaaguaugaggagauccaagaacaguuuacaaauuguuaaguacguuguuuuucaacuucagggacaauacucagacuuuaaaacuugaaagaucuuaaagaucauaacaucaaugagcuuuucuuacaauuaaaaguuuaaauuacaguaaucuuaaaguuaagagugaauucuauaauauguuguagaaaaugcauuagcagugaacacugaguuuuuuuuauaaaaguaaguauaaaccacucuaggaauuauuguuagaaauugaauauaaauauuauauauaguuauaaauauuuuugugauaaugcaaaaaugugauacaaaaauugaggagagauaagcaagcagacaaaagagauauguuuuauaaguuaauuuuuuuaaucuacgauaauauggcaacuacaaagaaagcuaaaguuaaaauagaaaucuuccacauuucagaaagcacaacacuuagcagagccugguaacuauagcccuguuugguaagguagggagggaauagcuugucuaagccuacuaaaauuauaggaacauuaacugagguaaaguuuaagacucaguucuuuagucccaccuuuguguuguaagugcucaguaaccaugcagacccuacaguugcuauggucaaugauaaaaaacaucccaucaccuccaaaaaaaauuuuuuuuuggagagcauuggauuauaaggaacaaagaaaguauucaaaauaaaguugcuacagaaaaugauuggauacaauuaacucuacauguagucuguuaaaagagguacagauuagagagagcauacagucagguguggugcacauugguaaucuuagcacuuaggaaguauaggcaagaggauugcagagucaaggucauccugggcuauauagaagaaucugucucaaaacaccccaacagcagaaguaauggacaaaaaacaaaaccccaacaaacuaugcuagauauugugauguaagaaaaauacaaaguaaaauugaauguagaagaauacacaaggggcuggugagauggcucaguggguaagagcacccgacuguucuuccgaagguccagaguucaaaucccagcaaccacaugguggcucacaaccauccguaacgagaucugacucccucuucuggagugugugaagacagcuacaguguauuuacauaaaauaauaaauaaaucuuaaaaaaaaaaaaagaagaauacacaaaaacacacaagccagcucugaaagagcuuaggccaugcuguuaaugcuaggaaaguaguuccuauggaaaaaaaaauguuuuaaaugagacaaaagaaguacuuuuugaccaugaaaaaugaggacagaaugguagugaauuauguaaucaguuaauaggugaucaaaagccuaaaacacaauaaaugcaaauagaaccaaauauuaucaguuucauuauacaaagaagauuuaaacacauacugauuuugaauagugauuauuaugauuaauauuuauuaaaacuacaccuuuauaauaaaaaagucaccuuuacauguguuuguggaauuauuuuaaaauauucugcaugcguuuaggcccugaaaacauuuaauuucagaaaauggaaauauaauagaaauuauaugguguaaucagauuguaaauuuauuuagaaaacaaaagugaauaaagcugugcucaaaacauuucauaaucauuagccuguaaguuauauaguaguuggauguuuucuguaguugacaauaguuuguggauguccuugaaagucuauagagaaucaagaguacgcccuacaguaucagaagacagucagaaaaauguucacaccccagaacuucuccagcagcugcugcuccaauugcccaucaaguacuggacuacacucaguuaaccaggcacugcucuguggcagcugugcugggcacagcagcagcuuuugacuccagaccuuaugguccuuugcauugccuauuaauaacuucaaaucugccugguucugucuguucucugccuguaguuuaggaaccuugaaucaguucucuagucagaaauggacagcagugauagggcucuggucacaauaguauucagugcucuaccuggaguguccaguucaggaagcccugugaacuaaguguucuauuuauaaaauuagggggaaaaugcaaauaaacaagaaagaaauuaauaaagauaaaacagaaacuauaagaauauaauauagaaagcuuaacuacaagccaaagagcuaauuuuuuaaaagacugaaauaaacuuaauucagaaaaagaaauauuguacaaaauuagaacagaagagaaauaauaagacauaguuaagaaguaaaauaauuauugugggaauauuuuauaaacuuuaaugcaaauaaguuugggauauguuugaaagugauguucugccaggguugggggauacccaggaagcccccaccugcucagaggagaaggggagagggggaugugggaaggauugugagagagggugacugggagggggggagugaaagggauguaaagugaauaaguaauaaauaaacaaauaaauaagaaagugacuuucuaugaaaauauauauuaacaaaauugucuccagaagagauagaaaacuuaaaaggacccuaaacuguagaaaucaauucuuaaaagaguguuuguuuguuuauuuguaugaaacaaggucucacuguauaguccugguuggcuggucuaaaacccauuuuguagaucaggcuggccuugaaacucagaucugccaacuccuaggauuaaagacauuugccaccaccuccacuuuuacuuaaaacuuauauaaaaacuauauuguagccauggacguaaaauauauuuccaguccuagcauuuggaaagcuaagaaacaaagauugugaauuuaacacuagccuagacuauacaaugagauuauaauaaacuauaauauuucauaucugcagaauaguacuucauauuuuaaaggaagcaucuuaaauuuuuaaauaaaauuuaucacaauaaggaaauuucaucaauuuuuaaauuauguauguauuuaugugggugugcauauacaugugauagcacacuaugguggucagaggacaacuuucugaaauuaguuccuucuacuauaugguucccaggcuuugucuuaggucaucccuuaucaguucuucaacacacagaauucccuccguguagugccuuggguuaauauuuaaaaacaaaguccacaugauuauauguccaaaagguacuugucaaaauucaugccuguuuaaaaaacacccaacccugagaaacagaaaaaggugaagagugcauuaccaaguaagguaugucauaaacuuaaggcuagggguguagcucagugguacaguguguuuaggguccucgccugguccuguaaguggcagcauggcaguuuaucuaauggaaagcaauaaacaggaucaaaugcuuaauacugccauuuuuucagagucauaacuuacacaguuacaugguaagaagaaauagaguauuguuuugaaaaggaaguaccgaggaucuaaaaugauucuuguuuuacuauucaauaaaacaggaaaggucaaaauccagggguuagcauuuuaauaaaucuugcaaaaaaaaaaaccaaccuuccuuacuagaaaauuccaguuaucuccaguuaagugguguugaaaacucgguaggugagaagacaaauauuauauuaauuaccaucuucuaauaucuagaaacuucauuaaauuaauuacuuuacaguguaaaaaggauaagccguuaacucucaguuuuucauacuuuuugcucuggcuguccuaacacaaugagccaguuguggcccuuuuagauagaugaggggagcugagaaaggcagaggaagcagggagugugagggccagucugggaguaguguaguuccuagaggacuugggaagggaggauaagaggcuaguuaaccuuuucaaaguaugaugugaaauugucuagcucaguucauaugcaucugccuaguucuaaagccugcuagaaagaagucauuggugguugucagguuuuggaaccugugacugagagggaaguaagagggaauaaaugaacuuauuauuuguuaauuuuauauaaaaaguuuuucuagucugauagcuuuuuaggauuuggggacuguauuagucaggguucucuagagucacagaacuuauggauagucucuagauaguaaaggaauuuauugaugacuuacagucggcagcccaauucccaacaauuguucagucgcagcugugaauggaaguccaaggaucuagcaguuacucagucucacgcagcaagcaggcgaaggagcaagggcucgagcuagacucccuucuuccaauguccuuauauugucuccagcaaaagguguagcccagauuaaagguguguuccaccacaccuuuaaucccagaugaaaggcauagcccagauuaaagguguguuccuuaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacagggaccuuagggcuuucuauaauauugccaucaucaucaucaccaccacuaucgccaucacuauuauuguuuauuaaauguauuuaaaauuauguauguuuucauuuguuuaugugguuuaguuuuaguuuuucauucuauugguauaugccuuccaugaagcaaaaaacuugguuauguucaccacucuauuuaauuauuaggguuuacacuuauagaauucaccacaaguaguuuuugaacuaguagaggcaguaaggucauuaugaagacagggaauugguuagaaguggacucuaggaagagaacauuuugauuaaaaucaugcuaaucaauuugucuuucuuaagucugaccaaggacaugacuggaaaggaagauguauaccgaggcccagccaucagggcucucugcagaaucacagauguaaguucucuguucagugcauugcuaaaggacacacuaacuguggauuuaugcuuagguguauuucugaggucucaaucuucucaaggguuaucuuuuuuuuuuuuuuuuuuuuuuuugagacaggaucuuuaacuugcaauauagcucagaccagccuugaauucacaauccuucugucucagccuucugagugcuagaauuaaaggcagguaucaccauacuaggcuuacggaucagacuggaaauuuuauaaaucuagauccuagaagaaauaguaugaacagcuuaauuuauuuugcuaccuuguuauuguguugugguuuucuuuuugguguuaaauuuuuaguuaauacuuagcaaauucuuuuuaaucugaauauugguccuaguauguuuacacauuuuaucugccaccacccuucugggacaaaaagcuuuucucguguuaaguuuacaagaaccuuccuuccagacgauucugugucgagggguugcuguaguaggauaauacauauuuaauuuccuauguaucggaagauaaugagacauuuuauuugauguguagaauuaaggugugugacaugugccuuacauagagaagcauuuaagcaucuuuaagauuucaaaaggaguauccgcccuugccgcagacccucugggucccugugucugcguggaacggggucucuugaugcgggugggcaaagcgugaaugaaugacagacagacgcacacaggagaguuuguguggaaucugaauguaauuuuucaaaucgaacaucagacuuuuuaugcagaagacaauaaggaaguugggugacauacccgcaagguacaaaugagguaaccggaugcuuaaugacucuuacacagaacagaggaaaugaaaacacaaagacuggcagaaacugggcaauaaaauaacugagacagagucagcccuaucuaaggucagcuauagucucagaagccaggugugagaacuuuucacuccuagggcaagggcuuucacacccaagucaugguucuaacuagggaguuccguucuagcuaaccaucucaugaauaaugcaauacucuaaaaccacagcccgaucuacuuccuaaaccauuguaaauuccuguauauggguguaacucagcuauaguucuaaauaucuauuuugguuucuccuauggucagaaacuucuuucuuccuuagugaugguagauuccugugaagggcagugaccuaacuuuuacucaaagugauaguguaauaccaggggcaguacugaauuccaagcccaaggucuugcuaaggacgaacuaggacuguuggaacacuggcggacggcuuuagcuaugucagaauucaaucuuaaaaggcacuuaugauaggaaaauauugaaagagagcacguggauccauacacuagacuaacucgggaauggaacgcaggaaugaaaaaucacuguauggguagggaaugcuagacuccaggaggagagcuuccuugaaacucuuuugccucaugagugacuuuuaagccucucagcuuguccaguugacucgaccagagagcguagcauuucucccuuccuuuuuuuaauuuucagccaaaguuccaggaugucccgccuugucguagcuacagaccucaggagcacucuaaagaugaguggaagcacaacgauuacuaguaaaacaaugccaaaaauaauaacaaguaggaauauauauugaacccaauccaggggguucaaugcacuuagguuguuuuucaaaucucuagccaauuggaacuuccuuuucuuuuucuuuauuuuuggggaaagaagagucuucauuugcucagguuagccucuguuugcacucauguguguguuugugugugugugugugugugugugugugugugugcguguagcuuuuucuaaauuauuugaauucugcucucuagaauaugauuacuauguauaaaaucuucauuacaaaaugaauauuuauacagaacauaucuauauccauuuuuguacauuauuuugcaugaaugguuuuuaacagcauuuucuuuuuaaugcuauuagggaacaauguugcaagccguugaaagguacaugaagcaggccauuguggauaaaguauccaguguagccagcucagcgcuggucucuuccuuaguaagugauuaggccacucuuuguucuuaugugcgcuaguggcuaguuuaaaaauaacuuacuacucuuguccucuuauaagaggaacaguuaaaaauauguguauauccuguuacuuuguccaaacacgcagcaguuauaaugggcaguaaaaaugugacuguucaaguuuagaaacuuuggggccugaagauacugaguaggagaagaguaauggacaguggagaaacaggggcuaguguuaaguuccuccucugugcucagauguuuaccuccagccucuuuguucucagcuucccuugguuucuaguaucuaucuguguccuuuaaagucuuccuuauuaccucugaauuucaagaagugaccuuuuuguuucagaaauagcuuuucuuucuccuuucaucaaaacaaaaacuuuucuuuuuuuuaaagauuauauaugugaguacacugucacugcuucagauauaccagaagagagcauuagaucacauuaaagaugguugugagcccccauguuguugcugggaauugaacucaggaccucugcaagagcagcagucagugcucuuaaccacugaaccaucuauccagcccccaaaauguauucuuuaaaaucuuaacacauucauuugauuaaaaucaguaaauaugggacuauagauugcuugguuagugaaaugcuugccaguaagcaugaggacauagucucagaacccacauaaaaaaacuuguaugguggcacauguaaucucagcucuggggagguggagacaggcagauuccuguagcucaccagcuagucagccuagacaguugcaggccccagauccaagugagagaucgugcuucaaaaaacaaguuugaucccuagccucucucuauauagcacaugugugugcgggcacacacaugcacacaccaccaccaccaccaccaccaccauaccacaccacaccuaugaacaaguauacuuacucacacauccauacaaaucauuagagcagacugccugauucuagaaugucauggaacagguuuuagaucaaggaauaugcuuguuucuuuuucaguggaaccuggaagucaagcuaauguuaacauuccuuaagagucauucuguuugaugcuucucuucuuucccuuuuguggcuuucuuuuccuugucucuuccagcucacaaauguguagaugucuauuacuauacaaagagauauuaaagaaaaaaauuucaguuuauaguugccuuagaauauagacaauguagacuuaaaaagcagcaguauuucaauguuugggaaauaucuuuaguaauuuuugcaagaaauuuaacuugcauuucuagugucuagugaucaugcauuauguauucccccauuuuucuuaauuuagcacaugaugaagauaagcuaugaugugguuaaacgauggauaaaugaagcccaagaagcugcaucaagugacaauaucauggugcagguacugucuuugauaucaucuuaugugucaggacaaaguagugauuauccagcaguaaaggcaaacuuuugacauauuaauccacuuacuaguacauauuaucaaguaagguaucuuacaaacuauuauuacuuccauuggcuuucuauuugguagaagauaaaugaccuccaguaggaauggucaagaaaaaaaaaucccuuuuuaguaguagauagaaaugcuuauuccaaagggauuaacaaugcauuuuggacuuuuauuugaaagacaauuuguguaaaagaaaacuuaguuucuuagucuugauaauaaauaauguaaaaaauaaucagccaaucuugcuauauaacauauugaacaaaucuuuuaggaagagcuuaugauauuuauuaagcuauuaucaaaaggaauauaaucaaaagucuaauugguaauuuaugugaaaucucuguauguguuugaaaaaguauuguuuauaucuucuuacauuagcguauuuaauaaugugagaaacaaucauuuccucuugagacaucugcuggucuaauucugaccaguguacuuccauacaagggguugaugaugacacucuccuagccuacauuaggagacuuauccuguauuaagguggugacacuugaaggcauguacuuguagucccagcacucaggagccugggguaucuauguaaguuagaucugagggugugagccauuuuuaaacucacuagaucuaucuuuagguuguauacagccccuuucuuacuggcuacucugaauuuacaacuucuggaguaaauuacacacacucuuuuuuuuuuuucuuagugauccugguguucguuucauauaaaaagauacuguauuuugucuguuugacuuagauaucuuuuuuuuugaaaagucuuuugucuaguucuaugcaguugucuuuccuguaggugaccugcugucuuccuaagcucauguggcacucuuucuucuucuuaguaccaugcacuaggagugcucuaucaccuuaggaagaaugaucggcuugcugucuccaagauguuaaauaaguuuaccaaaucuggucucaaaucacaguuugcauacuguaugcugauucgaauugcuagucgcuuacugaaagaaagcgaggaugggugaguauccuaagcugaguugguuucgauuuacaaguuaauauuuccuuagaauuuauuuuuguuuaugaauauuuuuaggguagcacugacuuuacagacaaguuuaauguuuuccagauuacaaagaaauugacagcugagcaugauggcgcacgccuuuaaucccagcacucaggaggcagacgcaggcagaucucuugaguucgaggccugccuggucuacagagugaguuccaggacauucaggacuauguagaaacccuaucucaaacaaaugaacaaacaaacaaauaaaacuaaaaagaaauuaaggauucuaaguaacacaguauuguuuuaccuuuauauaugcucauauauguaaugauuauugauaacauaguuaugaauggguaccagagguaaaaugcuguaggcccuaaguuauacagauaauugaauaugauaaucaggagggacauuaaaaaucaucuuguauaucuuauauaagagaauguagaaauacuaaauugaauaauuugccuaagaucacuguguaagugugaguuacaugugaacuuagcagcaauaccuuggcaguccuagaggcugggaggagacaggaagaggauagggaucuuucaagguauauacacuuggagcaaagaagaaacauccucacccuaaauggcuuauggcuuucccuuuucaauuuauagacaggaucucuccagguuggccucucuugccucagucucccaagugcuggaauuguagguaugcacuacuaccuggccaguaaugguuuaauuuuaaaauagauuucucauuggaucuggaaagcuguagaguuaacaccaaaaucucuaaacuaguugagugccaaaguccugccaagaaagccaguguagucugucugcaguucaguuaugacugucagagagcugaauuugauuaaaaccaaagcagaacugaacccuagguuagcuacuggcuucucauaacagaaagaacuugcuauuuucuuguuuuaaguauuguuuuauguuagucuguacuauauuuuuauaagcaguguuuagcagaaaaucaaaaaagucaaaguggcaagaagaaugugacuuuacugaaggaaaaaguauuaguaaaagcagauuuacugaugauccauguguuggaguuaauuagcagugacuuuaauaacaguuucaccauaggguaccuuuucuaauuaugguagaugcacuuuuucauggaagugcuuuucgguaguugaaagugacuuuucagcucuuaaaacuuuuggaaccaggucuaguaaucugaugguuucccauucuuuuaacugaaaugguuaugcuauuagauaugauauccaugguuagaauuuuguccugcggguaaauagcuuuuguuaaacagcaaaacaucuuuacuuuaacaacuuaacaucucuagaacuuaguuuccuuaacugugaaguaauuuaucugucagaauuauuguaauaauuuaagucauaugcaagaacaguaaaguggauaaauuacuaaagaacaaaaguauuuuaauuuuacauacaaaccuuuuguaaccaccuaaacaccaaguugauaguuuuauguggcagugauuguucaaacaucugguuacacaagcaucuggcuacagauacgucagcguaaauacauacuucacacucuucccauauuuauuacccuuguguucuaugauagacacagcacacauaaauacuuacccuaaauaaggaauccauggcaaccaaaguacagauaccaccaaaguuccaacuuggugaacaagugaguuuuauaggacugugggugggagguuauuuacaggagaagaaaugacucaaggcagcauccuuaggcccaccucagcaugggcgacaacucacaaaagcuggaaacguagcauacagcacaggcuguaggaagcucagcagguuggaaaguguccuuuucaugugacucuggucuaaaucucuucuagacagcucugcuggcuucugcugcuuucaggcagcugguuggucucagagucuuuuuaguagcuuuuuccucugagagucuucucuauagcucagauuguuugagucuuggcaucucuguuccuguuacuuaauuugggacagaaggggccuagagaaucuggucaguuuuaggaacuuccuagagcuauuucgaguuauuuuccuuucuucuuaaggagcuucccugcaggauggauugcuucuauauuggaggagauuguugcacaacauuccaucucuuccuuugucucuuacauacuucccauccccucuucuacaaucaucucugaaccuuggagacagugucuuuguuaggcuuucuauugcugugaagagacaccgugaccagggcaacuuuuauaaaggaagauauuuaauuuagggcugguuuacagcucagagguuuaguccaauaucgucacggugagaaacauggcggcaugcacacagacaugguacuggaaaagaaaccgagagugcuacaucuugauccacaggcagcagaagugaaagugacacuaggccuaguuugaacaacugagaccucaaagcccacacuuccucuaacaaggccacacuuccuaaucuugccacccccuauaggccaagcauucaaacauaugaguguguggggccacuccuauucagaccaucacagggugacuauauaguucuacugugacugagaaauaggccgcugugccacaguuacuuguucucaggagcuucgucagcgguuauguugaggcugacaacagcagugaucugugggcauaaauacacauuuagaaggcagugugaugggcauaucacauccaucauaaaaaaaaaaaaaauuccucaucgggaccugugaccucaguagucacagguuucugucuuggcuuauguaucagaugugaacucccucuucugaagugggccuuaaaucaguuggagggcuguucuaacccacaguagccaagccacuauuguacaaguaggcacauccugcccagcauaugguauuucaacuccuagggucuauagcuagaaaugaaaaauuauuuuaguaaguucauuacuauuaauuacuaggaaaagagauuagagaacuugaugauagcucagugaaaauuaccuaaacugaaauauaggaagaaaaauaaagggaaaaaugaauagaaaacuugaagccuagggaaacacaucauagucuaauguaucuguagugugacucagaaagagagaaaaggaaaugggacaaaguauuugaagagaucaaaggucagcugcugauaccaggaggcuagugagcuccggugaaugagaagugugaagcacauguacacuagccuugugugucaugucgcuaaagccagaaagaaaggaaccacagaaugcacagcauacuagagucaaggagauagaaggaagaauagcaguugcugugaugagugggucauuaucauugucagcuuaacuggauauagaguuaccuaggagacacaccucuggauaugucugugcgguuguuucuaaagaagaucuagccugaaugugggcucagguucccaguuggaaagaaagguaagaaggagaaugugaccauugauccuucucugcuuucugacuugggagagaaggucacagcugccugauacuccugcugccacagcugaggccauuuucacucuugugcucaaacugugagccagagugaagccgucuuuguuuuuguuuuuugauuuuuuugucauaagaaguaggcaauaagaaaaacaacuaauagagaaaacugauuccaaaaugugccgcuguugcuaggaccaucuggccauguauucuagguucuuuggaacuguugcuuguuugaggcagggucuuccuuuauaguccugguugucuuaaaacucuguagaccaggcugaccuugaaaucagagcuccccugcuucugcuuccugagcagauguucaggugugcgccacugugccagcuagaacuacuugugggagaaaucuggaagaauuugggccugugggauggagaagcccuggaaugcuauaaacagagauauguugucagauauauaaaagaccagaagcugauagaaaugugaaacagugaaauccugguaaacacggugucaaugaauaaagacuguugggaauuagaccagaggccagucauauuacacucugcaaaaaagaaaaaaaauuuuuuugacuccucucugucuuguccugagaacucgagugaggcugaauucagaaauaaaguuuuuggcagaggaaauguuaagacaagcgcaagguaaggcugacagcuuuuuauucacaucuacauggagagaagagaaauucuugagaacugugcauuagccugccuuugcugcuccuucccgagugugucuaucucugcuguuuuuacucuucucuguugaugucacacuuagcccucguuggcuuuccagcaugggcucaguacaggugacuuucuagagagcuaaggccuucagagcugaacugagacguugaggcauccaauuucaugaacugagcagcuacuaccuucucugcuucugcaguguacacaugaccauuguuggacugucugguuccuagcauccauucuauaauacauauauucucuauagguuccuuuccuccagagaaccaugccuaauauagguagacuuuuaagugugucuuauguauguugaaauuaauucccauaggacauacaaaaagauugaaguaggauguaguaguuuauguguauaaauccuaguacugaagaggcugaagcaagaggauugccacuaguuugaggcuagucugggcuucauagugaguuucagguuauucuggccuacagaguaagauacuguccccaaauaauucauaugcaugugcauacacauauguguauauaaauaaaauaauagaaauaaaacuugggccgagcaaugguggugcacgccguuaaucccagaacuugggaagcagaggcagauggagcucugcgaguuccaggcuagccuggucugcagagugaguuccaggacagccaggggucuacagagaaauccugucucaaaaaaaaaaaaaaaaaaaaaaaaaacaaaacaaaacagaaaaaguaaaaggaggagaaggagaaauaauaaaagcuuagcagcuucauuaacugugauguauagagauggagccuuugcgaaaugguuaggacuagauaaaaucauccaugugaagccccugugguucaacacugaugccuugucaaggagagagugccaucccugaggauacagauuccacaagcgcuaaccugacucuugcugugccuuaggacucucacccuguauucugaccaguguauagugagacccuaccauaaaaggcuguaucuauuguaguuaaaccaagaaauuaccaguguuucuagauaaaggauuaguauccaaaaucaguuugcuuuuuuuuucagacaacccauaaaugagauagaauuuuuaaaaagcauaggaaugaauuugucaaaaauuauaugcaucucuacucagaaaauuacaaaauauuauuuaguguuacuugaaaaaaaucaguauauauuauguuuuuauacugaaauauuucaauauuauaacaaugucacuucuuuuuaaauugaccucuguauuccaugagucuguagcaaaaacccucaacuuauaaaugccaaacagaaaugcauauucacugugaaaagacauguacaggaaggcuuaaucuuaagauggagcaauccaaauaugcaucagugcuaagaucuaaaaauaaauuaugguauguucauguaaauaaugaacaauuacucuugagugcagccacauggauaauucugacugagaggucauagauaaaagaauacauucugggccagaucuuagguucagucugcaacauuacaaaaaaacaacaaacacaacacacagacacagaggggguuaguuuggguggggagaaguugagauggggucucacuauguaucacagccuaaccugggacucacaaugacccuccuaccucagucucuugagggugacuucugggauuauagguauaugcuaucaugcuuggcucacuaauauuuauuucagaccuauauggauauagauaauauuaaaaguuaagauaguacuggaaguuuagcucagcaacaaaguacuugucuagcauucaugaagcccuggguuuaaguuuaguacuauuagaaaaaaaagaauaguaauuaucuuugagguaguguuugugagguagccugaaggugcuuauggaguuuuugaaauacuuauuuuucuuaucauuuugaucuuauaauaauccccuuaagaauuauaaaauuaucaauauuucauaauaaauuauucuagaaccuaccagaguaagaaaacauuaaaccauagauguuuucccaaacaaucucucuggcuuuuuuuuuuuucccucuuacuuucucuuuauguuuggagauagggucucauguugguccagauuguccuuguguucaccgugcagccaaagcuggcugugaacuguugacucuuccucccaaagacucauagucaugacacaucaugcucugcuagcuacuagguguuuggggucuuucuugcaguugcagucagaauaaugguuugugcugcagucaucuuggaagcuaaaauuuuuguuucuacaguauuuuaccgguauucuguuggcagagauaucucaguuucuugccaugugugccugccucuucauagcguugcuugagugucuugauagcauugacuuucuucagaacaagagagaaaagugcaugauauuuuucuggccuaaucuuggagaaacaugauaauguuucuguuugauagaaagaccauccagaguuaaagaagcagacagaaggaugcaagaaucauugggggaugcugucagauuugacugcuauguuagugguggacagccauaacaaaauacuucauucaaacuaaaggcuugugugacauguucacugccauguagccacaguagcuaacucauaagcuuccugauagucuccagucucuccugccuaucuugcuuuaggaacaccagaaucacugaggucugcuacugugacuggcucuaaauguguucuagggauccauauucagguucuugcucuuauauagcaagugcuuuacacaccaagucaucuuccaucccacaaguugauauuucuaagucagaaguuuugugagauguguguguuucuuaugugugaaugcaugugcauugaagguaaaauauguacauaugggggucagaaauuuacaucagauaucuuccuugacaauuuccacuuauuuacugagacagaaucucuugcugaacccaaagcucacugauuggacuaguuagccagcuucccagggguauuggcucaguguccugagcaccuggauuccaggccagcugauacucccauacagcuuuuauggagguauuagggauccaaauuuuggccuucacacaugaugccaagcacuucaucccugagcuaucuccuuagcuuccaaaccauuaaaaaaaaccuuuuaaaauauaauaaauucugugauuugaggggauugcaacauaauaaauuaugguuagaaugugauauuagaauugaaaguaugcucuuuuuguuuggggagaaaauuauaguuaaacuuugaccaaaaaaauguauugguuaguaauuuuuuuaauccauuuucugauuuugcaauagaguacuaggaacuaaauagauuauaaaugauaguuuauuuggcucauuguuugggaacuggcauguggaagagcaugucaccaacaucuggcaagguuuuuugugcuacauuguaacaagacagaggugcuaugucaugagccccaaguccauuugagaaaggagaagaggaaaaggaaacaaaaaucuuccuuuuguaaaucucuucuuuguuaacaaacagccuuuuaauguggcagggcaaggucugcauugacuagaugaagacuuuaaaguuuuaacuuuuaacacuuuuauauuugagccuaaauuucccauucaugaguucuggugaauauguucgaacuauaguaguaauuaagaguagaaauugaagccgggcagugguggcacacaccuuuaaucccagcacuugggaggcagaggcagguggauuucugaguucgaggccagccuggucuacagagugaguuccaggacagccagggcuacaaagagaaauccugucuuugaaaaaaaaaaaaacaaaaaaccuaaaacaaaacaaaacaaacaaacaaacaaaaaccaaaaaaaaaaaaguggaaauugaauaaaaauuucuuggacuuuuaaaagcaaaagaugguacaaggauaugacugaagguuguuaauaggaaauauaauuaaagugaugcauauaagcaggagacagaaaauaauuagauggaagugucaaguguauuaaauagcuguugcuguucagagaacugaccucagacuuauugcauaaagcagguauuuauuucacaguuaccaugaucagugaucuagugucagcauagcugugugguucugaugugaguacuuugugaguauacaggcauguuggccaggccugcagccaucuggcacugagaguccacuuuauacuuuacucacauuuuguuggcaagccuuacuguguuccuggcuauuggccagaugcuucacuuucccaccuuugggagcuuuuuauuuggcgucagucaaaugucuacuuagcaugacaacuaccuucuccccaaagcaggugugucagggagcgaaccuaacuugggaacugcaguuucaaaaccucaucucagaaguguugugcugucacuccucuuaaaucuuccugguuagagugaacagucuuggcaauaaugucugaggaaacuacucaggguuggaauauucagcaguauuuauuaagcccaucuucauggacuucuuguacacaaacuacauaauuuaucauaauaaaucuguuacauauuguacuagcugguuuugugugucaacuugacacaggcuggguuaucacagaaaaaggagcuucaguuggggaaaugccuccaugagauccagcuguggggcauuuucucaauuagugaucaagcagggagggccccuuguggcuggaaccaucccugggcugguagucuugguucuauaagagagcaggcugaacaagccaggggaggcaagccaguaaguaacaucccuccauggccucugcaucaacuccugcuuccugaccugcuugaguuccagccugacuuccuuuggugaugaacagcaguguggaaguguaagccgaauaaacccuuucuaccacaacuugcuucuuggucaugauguuugugcaggaauagaaacccugacuaagacaccuauugaaagagguucaaauugaacaaacaguaagaauuauaauugaucucuaugucaauauuuacaaaauugaccucauauuuggaaugccacauccaauuauuuuauuuuaauuaagaaagauaaggaaauacagaaaaugaaaaaacuuaguuuuauguguauaggacugagagauaugcuugcauacauuaagaaauaguguauuauuucuagugcccccaacaugcuuuaugcauaucacuugauuauaucuguugauguccagaagaacaacuaauguaucuaaagugcucauugguguuuuuuucuucuuuacucucucucuacccauuucuaaauacugaagccauucuaucuuguucuuagaguuuguugauagacuccuguugcaguuugcgccucguuuuuuucacauagaauuuuauugucagaaucacacuugguuuguuuauagcuauucauuuagacauauuuccugcauaauuucccaguugauucuucuaagaguaaacaucuggauuguguucugguuuuggcacugaugaauaagucugcagugaauagcuuccuugucucacacuguucuugucuucauccauuuuuguugcaauaaaaaugcagaugguccucaguuuaugauaguuugaguuggaauuuuuuaaauuuauuguagugugacgacaauaugcaugggguaaacuccccccccacccaucaugucuauaguagguguugauaaugaacagcaacagcaguaguuagccauagcucuggguaguuugaggcuagaaaaccacacuccagguaugauacgcugcuaugaacgagaauguuugguagauaggcauaaaagcaguuuugaguuauauuguuuucauugaaagaaucugaggagaaggagaagaaucugucggagggccagaagucucaaucuggaccucgagaucuuucaaacacuggaccaccaaacagacagcauacaccagcugauaugaggccccuaauacacauacaguacaggacuuccaggucuguguucauucagagaugaugccccuaacccucaagagacuagaagccccagggaguuuagaggucugguggggugggggugcgugggaggauccacguggauaaggggugaguggggaggaggugugggauguggagcagucugagggugaauggggaggggcagggaaugaaauauggaguguaaaaagugaauuacaaauaaaauuaaauucaaaaaauggguuuauuagaacauaucacauuguaaguaccaucuuuaucuaaaaccaagaaacuuuuucuaagaaauguuggauuuggcucaauuuuagagguugggaaggcaagagcaugcuucuggcauuugcucagcaucuggaaaaccugguugucucaccuggugagacagcaaggguguuacuugaggugucuucucuuauagcguuccucauguuguuaaguggcccaacccccaugaugccaucuaauccgaauuagcccccaaaggcuucucuauaaauagcauuagcauauggauuugagggucaaguuuuugaugcaugcacuucugaggaacacauucaaaccacagcagucuccaucccuauuuuuaauauuuaagcauauacuucuuuacaguauauauagaaguauaggguuaccauauauaccucugcauuuuauagauuacaccagacucuaguuuuccaaaauagcugcuucagucauauuccauguaaagauguacaccacuauugcccagcuauaggaauucuuaauauaaaauaauaguucuggauugauuuauaaguauaagauacagauacuuuuccccacacuuuauugacuguugauuuucugauacuuugcugaacagaaagaacuacuuaaauauaagacauaauuaauuuuaucaggcuuuaucaaaagaauauuguuuuuguugucuugucugaaccccaaguuuacaaauauauauuuuuugugauauuucaagcauuauaguuuuaauuuucauguuuuggguccauauccuaccaaugaauuuguuuucuagauaugauauaaagucacaacuuaauuuuuccccucuucuaaaagcuaguagacucagugucauuuguugaaaugagucuauagcagcugcuauauaauaucagcuuuauugucaacuagauuuccuuacaugcuuuggucuguuucugagccccuguuucccuauuguaucaauuguuggcucaguugugcaauggagccacuacgauacugauuuuuuuuaauuuauaagucuuuuuuuuuuuaauuggauauucucuuuauuuaccuuucaaauguuauccccuuuccuggcugccccaccucccgagaaacccucaucccauccaccucgcccugcuuccaugaggguguuccagcacccauccucucacucuugccuccccauccucccauuccccggcuauggggcaucaagccuucacaggaccaagggccucuucucccauugaugcccgacaaggccauccucugcuacauauguggcuggagccauggguaccuccauguguacucauugguugguaauguagucccugggagcucugugggggucugguugguuauuguuguucuucuuaugggguuggaaccccccucaguccuucaguccuuucucuaacuccuccauuggggaccccaugcucaguccaaugguuggcugagagcauccaccucuguauuuguuaggcacuggcagagccucucaggagagagcuauaucagacuccugucagcaugcacuuuuuagcauucacaauaguaucagcauuuguugauuguauaugggauggaucuccagguggggcagucucuggauggccuuuccuucagucucugcuccacacuuugucucaauauuugcucccaugaguacuuuguuguuccccuucuaagaaggacuggagcacccacacuuuggucuuccuucuucuugagcuucauaugaucugugaguuguaucuugguuauuuggagcuuuugggcuaauauccacuuaucagugaguauauaccauguguguucuuuugugauuggguuaccucacucaggaugauauuuucuaguucuauccauuugccuaagaauuucaugaauuaauuguuuauaauagcugaguaguacugcauuguguaaauauaccacauuuucuguauccauuccccuguagagggacaucuggguucuuuccagcuccuggcuauuauaaauaaggcugcuaugaacauaguggagcaugugaccuuauuacaugucggagcaucuucuggguauaugccgaggagugguauagcuggguccucagguaguacuauguccaauauucugaggaaccgccaaacugauuucuagagugguuguacaagcuugcaaucccaccagcaauggaggaguguuccucuuucuccacauccuugccagcaucugcugucaccugaguuuuugaucuuagccauucugacuggugugaaguagaaucucaggguuguuuugauuugcauuucccugaugacuaaggaugucgaacauuucuuuaggugcuuucucagccauuugaguuuccucaguugagaauucuuuguuuaacucuguaucccauuuuguaauaggguuauuugauucucuggagucuuaacuucuugaguucuuuguauauauuggauauuagcccucuaucggauauaggguugguaaagaucuuuucccaaucuguugguugccuuuuuguccuauugacaguguccuuugcguuacagaagcugugcaauuuuaugaggccccauuugucuauuguugaucuuagagcauaagccauugguguucuguucaggaauguuuccccugugcacauguguucgaggcucuacuccacuuuguccuuuuuaguuuccaggguaucuggguuuauguggagguccuugauccacuugagcuuuguacgaggagaugagaauggguugauuugcauuuucuacaugcugaccuccaguugaaccagcaccauuuauuaaaaugcuguccuuuuuucacugaaugguuuuagcuucuuugucagagaucaaguaaccauauguguauggguucauuucugggucucagauucuauuccauugaucuuccugucugucucuguaccaauaccaugcaguuuuuaucacugaugcucuguaauacagcuugggaucagggauggugauuucucccagagguucuuuuauuguugagaauaguuuuugcuauccuggguuuuuuguuacuccaaaugaauuugcaaauuucucuuucuagcucuaugaaaaauugauuuggaauuuugauggggauugcauugaaucuguagauuguuuucggcaagauggccauuuuuacuauauuacucuugcuaaucugugagcaugggagaucuuuccaucuucugagaucuucuuugauuucuuucuucagagacuugaaguuuuugucauacagaucuuucacuuucuugguuauagucacaccaagguauguaauauuauuugugacuauugugaagggugucauuucccuaauuucuuuuucagcccguuuauccuuugaguagaugaagacuacugauuuguuuaaguuaauuuuauguccagccacuuuguugaaguugauuaucagcuuuaggaguucucugguggaauuuuuguggucacuuaaguguaugaucauaucaucugcaaauagugacauuuuaacuuccuccuuuccagucuguaucccuuugaccuccuauuguugucuaauugcuccagcuagaauuucuaguacuauauugaauggauagggagagugggcagccuugucuagucccugauuuuagugggauugcuucaaguuucucuccauuuaguuugauguugacuacuggauuucuguauauugcuuuuacuauguuuagguaugggccuugaauuccugaucuuuccaagacuuuuaacaugaagggaugcuaaaguuugucaaaugcuuuuucaguaucugauaaauugaucaugugggguuuuuuguuguuguuguuguuugaguuuguuuauguaguggauuacguugauggauuucuguauauugaaccaucccugcaucccugggaugaagccuacuugaucguggugaaugaucguuuugauguguuuuuggauuugguuggcaagaauuuuauuauuuuugcaucaauguucauaagggagauugguaugaaauuaguuuucuuuguuuggucuuugugugguuuagguauaagcauaacuguggcuucauagaaugaauuggguaguguucguucuguuucuauuuugugggauaauuugaagaguauugguauuaggucuuauuuaaaagucugauagaauucuccacuaaacccaucugguccuggaccuuuuugcuugggagacuauuaaugacugcuucuacuucuuuagggguuaugggacuguucagaugguuuaucuucuccuguuuuaacuuuggcaccugguaugugucuagaaaauugucuauuucauccaaauuuuccaauuuaguugaguauaaacuuuuguauuagaaucuggugaucuuuuuggauuuccccaguuuccauuguuaugucucccuuuucauucuugguuuuauuaauuuggauacuuucucugugcccucuagugagucuggcuaaggguuuaucuauguuguugauuuucucaaagaaccaguuccugguuuuguugauucuuuguauaguucuuuuuguuucuacuugguugauuucgccccugaguuugauuauuugcugcccucuacuccucuuggguauauuuacaucuuuuuguucuagagcuuucaggugugcugucaagcugcuaguguaagcucucuccaguuucuuuuuggaggcacucagagcuaugaguuuuccucuuaggaaugcuuucauugugucccauaaguuuggguauguuguggcuucguuuucauuaaacucuaaaaugucuuuaauuucuuucuuuauuucuuccuugaucaaguuaucauugaguagaguguuguucaguuuccauguguauguggacuuucuguuauuuauguuguuauuggagaucagccuuaguccguggugaucugauagaaugcaugggaauauuucaauauucuuguaucuguggaggccuguuuugugaccuauuuggucaauuuuugagaagguaccaugaggugcugagaagaagguauauucuuuuguuuuaggauaaaauguucuauaguuaucuguuaaauccgauuguuucauaacuacuguuucacuguguuucuguucaguuucuguuuccaugaucugacauugaugagagugggguguugaagucucccacuauuauugugugcagugcuaugugugcuuugagcuuuaguaaaguuucuuuaaugaauguggaugcccuugcauuuggagcauagauguucaaaauugagaguuuaucuugguaaauuuuaccuuugaugaguauuaagugucccuccuuaucuuuuuugauaacuuuagguugaaaguugauuuuauaugauauuagaauugccacuccagcuuguuucuugggacuauuugcuuggaaaauuguuuuccagccuuuuacucugagguaauaucugccuuugucacugaggugcguuuccuguaugcagcaaaauguuggguccuguuuacauauccagucuguuagccugugucuuuuuauuauggaauugaguccauuauuguuaagagguauuaaggaaaagugauuguugcuuccuguuauuuuuguuguucaagguggaauuauguuuguuuggcuaucuucuuuuagguuuguugaaagauaacuuuuuugcuuuauuuaggguguaguuucccuccuuguguugguguuuuccaucuauuauccuuuguagcgcuggauuugugggaagauauuguguaaauuugguuuugucauggaauaucuuguuuuaucugucuauggcaauugagaguuucgcuguuuaaggccuguaugauaucuggccaggaucuucucgcuuucauagucucuggugagaagucugguguaauucugauaggucugccuuuauauguuacuugaucuuuuucccuuacugcuuuuaauauucuuuuuuuuuuuucaucuuuggcgggagguaccauauuuaauaauaguuguuuaauucuuuguaauuuuuuuauuacaugcuacagugauuuuuguuauuuuucacagaaucauauuuuuucuuuuuuuauuagauauuuucuuuauuuacauuucaaaugcaaucccgaaaguucccuauacccaccccaccccccugcucccuuaaccacccacucccacuucuuggcccuagcauuccccuguacuggggcauauaaaguuugcaagacuaaggggccucucuucccaaugauggcugacuaggccaucuuuugcuacauaugcagcuagagacacgagcucuggggguacugguuaguucauauuguuguuccaccuauagaguugcugaccccuucagcuccuuggguacuuucucuagcuccuccauugggggcccuguguuccauccuauagacugugagcauccacuucuguauuugccaggcacuggcauagccucacuugagauagcuauauuaggguccuuucagcaaaaucuugcagguauaugcaguagugucuggguuugguggcugauuaugggauggauccccacgugggguaggcucuggaugguccauccuuuugucuuagcuccaaacuuugucucuguaacuccuuccauggauuaauauucuuucuuuguuuaauguauuugguguuuugauuauuaugugauaggagaaauuucuuuucugguccagucuauuuggaguucuguaggcuucuuguauguucaugggcaucucuuucuuuagguuagggaaguuuucuucuauaauuuuguugaagauauuuacugccccuugaaauugguaaucuucacugucuuuuauaucuguuauccuuagguuuggucuuuucauuauguccuggauuuccuggauguuuuggguuaggagcuuuuugcaguuugcauuuucuuugacaguuggaucauuguuuucuaugauaccuuuugcaccugagauucucucuucuaucucuuguauucuguuguugaugcaucuaugacuccucaucucuuuccuagguuuucuaacuccaggguugucuccguuugugauuucuuuauuuuucuacuuccauuuuuagaucuggaugauuuuguucauuuccuucaccuguuugauuguguuuuccuguaauucuuuaagggauuuuuguauuuccucuuuaaggucuucuaccuguuuaccuguguucuccuguauuucuuuaagggaguuauuuauguccuucuuaaaauucucugucaucaucaugagaagugauuuuuagaucagaaucuugcuuuucuggugugaugguguauauaguacuugcuauggugggagaauuggguucugaugaugccaaguaaccuugguuucuguuucuuauauucuuagucuuuacuccugauuaucacaaguacuaccuucccuauaucugacaagagccuguccugccugcaauccugguugugucagaacuccucagaguccugcuaucucugugauccugugauuccaggguccuguaguccugagauucugggugugucagaguuccugggagucaagcugccucugggacccugagauccuggugugaccaagcuccugggauccuauggcucuggguguguuagagcaccugggauuugagccuccucugggugcugugggacuggcugcaggguuugcgcucaagauaaacuggacaggcuggaagguacccgagccacuggucgggugggucuccugcaucccuggauccugcuggucccaguuacuccuggugguguuguaacagauguuguguccuauucaccccugaucuuacgauccugggcaugcuagagugccugagauuggugccuccucugggugcugugggacucuacaguagucccaggucauggguucagagcucgccuuaacacuccucacugcacccagcaguaucacauagaguaugacacaccaagcacucaagacuccucagcuauagccaccauacugauuuuuaguaacauuauaguaauguagguauaugcuagaggcaaaucuucuguuguucugcaugagagguuuaggguccuuauuucugucugcuccuguauaaucugaacaaggguuacuuaucuuuccucucauuggaguuuguuuauucuuaugagacuuaagucaaggccauuguaacaaucaggaauucuaaccuugucuauuaaucagauuuucaucacugagacacuuaucugaaaacaaaagaagaaagauuuaucuuggcuugugguuucaaaaguugaaucugugguuguguggcuccauugcuucugggcccaugcaugguaagacagaggauucugguagagcacauuugauggggaaaacuagcucaguucauggugaugguagccaaacauacaaggaggggccaggacaagguacaccuuucaaaggcuugcuucugcugagugacuuucucuaacggugcaauccauuuuuguaguccauugacuaugaacucaaggggugaaucgacugaugagaguccccucaugauccaguccuuucucaguaucuaugcauaaagcaugagccuucccaugauccuucugugggaauauuuacuuccaaaucacagcaucuauacauucuuacucguaaauguuuuaacuuuaauaugcagccaacaaaguauuguacaaaauauuuaguuauaagauauccuaaagcauuuuaucaugaaugaauucgaucccuaugucuucaucuuuuaaaauacugcuucaagggaacaaaaccaugguaaaguguaugugaagauuagcauaauuucuguaaagaaaauaacccaaugauuauagucgcuuguugugcguguguguguguguguguguguguguguaggcuguguauguguguucauagugcauauguaugugguugcaugcgcagauauguaugcacauggaagcaauagauuaacuucauacagguuguauucauuuuaacuuuuuuuuuagaugggaucuuucaguggcuuggagcuuacaaauuagucuggacuguuggaaguguaagauaagauaaaucuuuccuccccaaguugcuuuuggucaguguuuuaucacagcaguauucaguaggauauuagacacuuuuuuagggcuacuggguguaagucuuucugcuaauuucuugagugauauuuugaauaguagaauugaugaaggauaauauuaaauguagaaauugcauuuaauuuauucacuauuaaaauacaagcuaggugugauugcucauucuuguaaugccagaacucaggcagaagaggcaagggggagugcaagcuugaggcugucguggacuacagagugagaccuuguuuuaaaagcuaccucccccaaaagaaauaaaagacuuuuguaguguuguuauaugagagcauguaguuaaguacuauuguaaguuguacaguucauagaaaucagucuuagugguugaagaaaauugaaagcaguuaauuuggguaccacuuaggaauagaaauaaagauccauauaaaagaauauuauaaaugcuuaaaagaacacaaucuagguuuaccagcuuuauagaguauugugauaguagagcaguuuguuuggacugaugauauggcuuagugaauaaaagcacugcaagccauguaagccuuucaguucaguuuccagaacccauaauggagagagagggccaacucuagacguuguucucugaccucugaccuccacacaugcacauacacguucauuccuucuccccccacaauaugcaugcacauuaauaauaauaaauaacuguuguuguuguuguuuguuuuuugguuuuucaagacaggguuucucugugcagcccuggcuguccuggaacucacuuuguagaccaggcuggcuucgaacucaaaaaucugccugccucugccucccaaguccugggauuaaaggcgugcgccaccaccgcccggccaauaaauuauuuauuuauuuauuuauuuauuuauuuauuuauuuauuuauuuauuuauuuaaugcauaugaccacacuaccauugcucucuucagacacaccagaagagggcaccagacccuauuguggaugguugugagccacuaugugguugcugggaauugaacucaggaccuuuggaagagcaguuggugcucuuaaccacugagccaccucuccagcucaguaaauaacuuuuuaaaaaguuuguuucauuagcucuuguaacuuuuaguaaaugaauauuaauauuuuuguuuagaacaauuaggcuuccuucucagcauuguuauauauaaaauuauuuuaauauuuuaaauuuugaccaacuaauguaauauguuuguuuauuaggugccuaggaccuaauuaauaggccuggucauuuuauagccuaggacugccugggauuccuagcaauuuuccugccucugucuuucaugugcuggauuauagaugugaccaacugugcucagcucaauauuaggugguguuuagcaguuuuuuugacauuaauuuacagauuuuaaaauucacacacuaagcauacacuuguagaauuuaacaauaaacgaacgcagcucuacaaccaggagcacaaucugucuuuagaauguuuccaucaccuucuaaagccgcuuagacucuuaccuuagucccugugccccucagcccuugagcugccuuuugccuguguagauguuuccugauaauggcaucauaauccugcuguuuucauugagccugauauuuacugguuuacuugauugcaguaggauuuaucaaucgauggucauuuggguugcuuauuuauuucuauuaugaauaaaugauacuauugauaggcaaguacaaaucuuuguaugaacauauauuuucuauuuucaugggaagauucuuuuaaauggaauauguggacuacuugcugugucuaauuuuaaaaggagcugcagauuauuuuacaaaguuccauaaauuuacaugccugugaggacaccaguguugucuucauuggugugugauguugucugcugauuccuuccucuuucagguugcucgacuauguauccaguauuuugucucugcuuucugagugcuggaccugugugccuggugugucuguugagcaguuacugucuuuaauagccauucuaguagcuauaugggagccccuucacccccuacccucgcuccuaguuucccuuucuuaauuacuagucauuacuuuguuuucagugcugugucugcuuuacugcucucuucccauuuuguuaguguuaucaagcuaagucauuccaaucucuugcccaccaucaaauagaguuguugugcuugaaagacuuccuuacccauucuccauucuuuuuuuuuucugauaacucagauaacagaguuugacaauuucauaagaaaccuacagacaaguaugucucuuguuguacccucaaaauguuaacaaauacuuuuauauagaacuuuuacauguugcuugucuuuguuuccuuauuuuaacauauugaugaaguuuguuuuauccccuuucuaagagauugugcuuuggagcuguguccaauagcugccuaguucaagagcacagugguuccucaauaugcucuuuuaguagcaugauauuaauaguucuaguuugcaaccuuuaagacuaucauccauucugaguaaaguucuguauaugcucauauaauggaauaaauacauucauuuaagaaaauaccaauuuucccagugccaguuaguaaaaacucuuuucuccuuuaaauugucucuucuuugggaagucagcugaccaugugaugaaacucccaguuuuuuucaguugucaugaugcuccagguuuauaggaagauuugaaucuggaaaauguguuuuuggaguucauugcuuauccauaugcauuuuagaacaagcuuuggauuacuacaguaaaaccugcuggcauuuugguaggauuugcacuguccagaauaauagguauauuuuaaaucaauucauaugggaguauugccaucuugauaauaaguaguuuuauagcauggacagggucuauuucuucauuuaaaguccucaaaaagauuuuauaguuuucaauuuaaaauugugauaauuuuauucaauuaauuuuuaaaguauuuaauuugugugcauauagaagucagaggggacaacucacaugaguugugcucacguucuaccauauggauccugggaaauaacacucagacuugacagcgaguaccuuagccaccccuucccccaugucucccuggccccuucgcucagucuuaggcuguugugaauggaauuguuucaucacuuucacuucuggacugaacuauaguuguuuuuauguuaaucuuauaguuuauaaacuuguaugcugcuagcuagugcaugcuacucccucuuccuuuccucccucuaccccugcccugugcucucuugauuucucuacuucucucuuguucucugcauccauauacuacuuuggauuuucuguguauaauaucauaucacuugugaacaaauauggcuucacuucuuuguuucuagacuaaccccuguguuuuguguugugcuuuuuuuuuucacuaccucaagccuuuagugugauagugaguagaaauggugaaagaaggcuucuuugacuacaguuuugcaggaaacccauuaagcaugauguagaucuuuaaaggucugcuuuauccggagaggcucugccagugccugauucagaggugaaugcucacagccauccauugaacugagcacaggguccccaauggagaagcuagagaaaggacccaaggagcugaagggguuugcagcccuauaggaggaacaacaaugugaacuaaccaguacccccccagagcucccagggacuaaaccaucaaccaaaaaguacucaaggagggacucagccacauaucuagcagaagauggccuuguuggacauaaaugagaggagaggcucuuggccuuguaaagguucgaugccccaguauagggggaugccaggauagggaagcgggaguggguggguuagugggcgggggugugugugaugggauaagaggguuuucagaggggaaaugaggaaaggggauacaauuugaaauguaaauaaagaaaauaucuaauaaaaaaugaaaaaaaaauagacugaaaauaaaccagauuuacccaaagggagggggaaaaaaaaauccaguugaggugguacccuccagcccuguuguuuguuuuaauguuguuuuuguuguuuguaauaauuaauguauauuaauaugcuauauaacauuugaucuauuauguuguucugcuucugagaacaaucugcucaguucauuuacucuuaaauuuuucagcucuuuaucuuaguuauucaugcccuaucugaugaauagcuaacaacgcuugucucccauccugcagaucuuuucaguuugcuguugccuuuguugugcaggagcuuaauuugauguuugauguucaucaggccuaccuguuauuuccugagguguuggagucuuacucagaaaguuugugcuuguccccauaucuugaaauguuucuacuuuauuuugauaguuucaaaguuucaggucuuauauuaaggucuuuagugaauuugaaguugacuuuugugcagggugaaagguaaagauuguauuucauucuuugucacaugcauauccaguuuccuagcagccugugugggugaggccaucuuuucuccaguaggcacuuuagcacuuuugucaacaaaccauuuccuauagguuuucuaguuuacuggaagauaauucuucagaauacuucuuagugagccucuggauuucagugaauguuuguuguaauauuccuucacccccuuuaccucuaauguuauuaauuugagucuuucuuuuggucacuuugucuaagcauuugucagucuuguucaucuguucaaaaaagcaacaguuggccuggugguggugguggugguggcgcacgucuuuaaucccagcacucgggaggcagagacaggcagauuucugaguuugaggccagccucgucuacaaaguaaguuccaggacagccagggcuacacagagaaacccugccuugaaaaaccuaaauaaauaaauaaauaaauaaauaaauaaauaaauaaaaaaaaaaaauauaaauaaaaauaaaauaagaagaaauaauagagcaagguagaauuuaauaaaaugaagaccguaagaggaucagugaaacuguugcuuuuuuauuuuuuuguuuuuguuuguuuucuuuuuuguguuguuguuguuguuguuguuguuugagacaggguuucucuguguagcccuggcuguccuggaacucacucuuguagaccaggcuggccuugaacucagaaauccaccugccucugccucccaagugcugggauuaaaggcgugcaccaccacugccuggcuccuuauuucauuuuuaucuacuaauuuuguuuggcuuguucuguuuuguuuuguuuuguuuuuuucuaagacuuagagguacaucacuaagagaugaucaaaguguucucuugccuuguuaaugcguacacuaagcacaacaagcuuaccucuuuugucuuugcuguauacaaaaaaaucuaaugaagugugguuuuuuucacuuguuucuagaauuucuuugcuuuuuaaaaaccauauauauauauauauauauauauauauauauauauauauauaguaaacaucauuugcauauucaauccucauguguuuuaaguggcgccuauaguuucuugugauacaucacgauugcugccaccucucccagucacccccuuccacaccccucccccauucucaucugagaggguagaggccccccugaauaucccccuacccuggcacaucaagucucugggagucuaggcacauccucucccacugaggccagacaagguaccccagcuagaagaacauaucaucccacagacagguaacauugaaaaagaauucagaacuaugucuaccuuuguuaagcacagacuauaagcuaguuggaugggacccugcccugaacuuagcauuucuaccacaacugagucuaacuuugcuuuguccuaggcugauccugaacucaggaaucuaucugccuuuguuagcauaaacaaaaaaucuuagcuggguggaaucuccugugaucacugcucccuaaaucucucucucuucuuccuuagcaauugucuaacuacucgguucguggcauagcugcuuuuguuccuuuauauucaugaagccccucauguaauucauauaguauccuuauuuuugcauagguaagaaauuauauauuuucaaacucauguauuuagagcucuuuccuauaaccuuaagggcuguccugaaaguccuagaguuuaccauuuugcugagacauaggcacacccucgacuccuggacuccugcuguuucuaauuaucaccgagucacucacauucacaggggggagucugaauuauguacauuauuauacaaacauuccuuguagccacagcagccaaggacacucuuggagguucacaccaggggcccugucccaggggcaggaaccaugucacuguccccaccaaggccuggcagggcucagucacugcuccauccucugucccugcauuucuuguagacaggauaaauuuugguuagaaaguuuugucaguagguuggugucccuaucacuccacugggguuccugccuggcuacaugaaguggccucuugaaguuccauaucccaaugcugugagucacagcuaagcucaccccauugauucucgggguccuccccuauccucggucucuggcaggcccuugagauaccccaccaccaccaguugcagauuuccauucauuccauucaccuccuauuccuccccauacuugauccugaauucccccuacaccauuccucuccccagccccccucccacccaguucucuuccucuaucuaccuccuacaacuauuuuuguuccccuuucuaagugagauucaagcauucuuacuuggaccuuccuucuuauuuagcuucuuugggucuguggaguguaguagcauguuuaucuuguauuuuauggcuaauauccacuuuauaaaugaguacaugccauauauguccuuuggaucuggguuaccucacucaggaugauauucucaaauuccauccauuuuccugcagaauucauuauuuuuaauagcuaaauaguauucuauuguguagauggaccacauuuucuuuauccauucuuuaguugagggacaucuagauuguuuccaguuucuggcuauuacaaacaaagcugcuaguugaacaaguguucccgugguauaguagggcaucuuguaaguauaugccuaagagugauauaccugggucuuaagauagaauauuuccuguuuucugagaaacugccacauugauuuccaacgugguuguacaagucugcacucugaccagcaauggaggaguguuccucuugcuccacagcuucccuagcauguacuauuguaagagcccgaaaauuccugaaggaagaccccagacucagauaguaugcaaaacaaagagaguuuauucugcagaaacaaccagcaugagcccagacaaagguccgcaggccuucuaauaggaaauuggggaaacucucuagaaggauuagguaaucuaaaauuucauuggugggugcuagggcaucacagguggucaguggccugucuacauuccuacaucaugaauuuucaaccaugugaagaaauaggacuguccccacagauggccuguucugagauaagauauuucuccauuuugugguuauccccaggcuguuuuuugggagaggguuuuaugaucuuguucuggauuuuauggucuauuccuagagcuggugucuuaugaccuaguuucugggacuuauggucuauuccugaagcuggucccuuacggccucuuuuaaaaaucauuaaauuaaaaagcugguccuuaaauggagacaaauaggauacuuaaguggggacaaaugggguuuauauuguccuuucacuaucacuugaguuuuugaucuuagccauucugccaugugagauggaaucucagaguuguuuuaauuugcauuucccuaaugacuaaggacuucgaacauuucuuuaagugcuucgcagcuauuugagaggccucuguuguucauucucuguucaguucuguaccccauuuuuuaauuggguuauguggguuguuggagucuaacuucuuguguuuuuaaugaaauagacaauuuucuaaacagauaacacuuaccaaaguuaaaucaaggucagguaaacaaaaaguuauuuuucaaagguguauuuuauuuauacguauguggguauauaugugcacauguauguccaagugcacauagaauccagaagaagcugcuguaucuuuugggacuggaauuggaaauguuuaugaacuauuugacaugaacuugaccacugagccauuucucuagccccuaagaaauauucauauucucauucauauucucuuucuuucuguguuuguuaaaacuuguuuuauuaucuaaaaugcgaucuacuuugaagaaauuuucauagacugcugagaagaguauguauucuauagauggaaaugucaguuaaauccauuuauuuuuacagugcaauugaacuccaacuuucuucugggggaugggguugggacaggcugaaugacauagcuguccguucucucuauguagcccuggcuguccuuggaagucauuauguagaccaggcuggccucaacucaacagagaucuaccugcuucugccucccaagugcaugcaacaccacacucagcuggagugagauuuuuaaaguaaguguccauuguuguuauguguggacuugucuaaucccuucaugucuaguuguguuuugugaaauuagguacauuggcuuuugauagcuacauauuuauaaucaugauagauucuuaaugguuaucucuuuauuaauaugacaugacugucuuuauuucuacgguuaaauuugacuuaaagucugcuuugucagguaugaguauagcuauucuagcuuguuuuuaaauucuacuuacuugaaauauaauuuuccauuuuuucucuuucaguuuuugccaguaaguuucuucuagacagcaaacaguuggaucuugcuuuuuaaucaauucagcugaccuauguuccaaguuaauucuuuaaauuuaauacuauugagagagauaugcuaacuuuucccaucuuuaugcgcuugcugguuuacagagcuaauuguguguggcuccuucuauucuccacuguuuauucuuuuaaugagacuuguucuuucuugugcuuucauguuuguguauguuucuuccucugcuguauguaguauuucuuuaagaauauucagcagugcuaguaauggcuugcuuucauuuauacuucugagaagucuuuguuuuugcuucaguuuuaaaggauaacuucccuugguauuauugucuggguuagcacuggguuuuguuucagagcuugaaaugcaucagucuaucucuuggccuucugggguucuuuuaucaaguauccuauuguuucuauggguuucccuuuuuaaguaacacugcauuucuuuauugaaauuuucaguaugauguucuaugcuuuuggaauuuugugaugcaugaaaguguuuaucuggucuauuugggauucucucugccucauguggcauguccaugacuuucucuagauuugagaaguucuuugcuauaacuuuucugaaugaauuuucagucacuuuagucucucuuuauugguuccuucugcauacuagauugguuggcuuggucucuuaauaauguaccauaggucuugaauguuauuuuuauuauuucuggauuuuguuuucuguuauccgaguauaaauuuccccaccugcuaccauaccuggucuagucuguugcugauacuuucuaguaagaauuucuauuagacugaguuuucuauuuuuaagauuuuuuggcugaauuuuuuuauucaaguuacuaaauuucuaguccaaauuuuugaauuguuuuuguacagguaucauauugacauauuuacucaucucuuauuugaaccuucuuauuaaucucucuuucucugugaguguguguguuugugugucucuuucuuguaaacacuugaagaugaggaugugaucguguauacagaagcuaagagcaagaugucagaugucuucuucuaucacucuuugccuuacuucuuugagacaggaucuuucacugagccagaaacucccaagugugucucuguuccccaguccugaucugugcagcaugcuugacuuuuuaugugcgugcuaaggcguccagcucagguccuugcuugcagagcaagagcucuuacucacagugccuuucaguugccccucuuugaccauuuuguaaaucaguaucuuucaguuauuaaagcggugcaaacuuuuagagacgcucccugcuuuguguccccagguuuaugacucaggcuguccaucuguugagauggcagguccuucuuagugagcucuuaguaagcagccuucucuuaaguucucuccucacagaggauggagagcugugauaacagcauuaacaccaaaauagacaauguauuaauauaaauuuaaaggggcuggagagcuggccuagugguucagagcauguaugcugcucuuccagaaggguuugguccccagcaucauguuaggcagcuuccaggggaucccgggccucugaccucuacauagcuacacucauauguacauaaccgugcgcauacacguuauuuaaaguaaagucaauccuuuaaaaauacaguuaaaagaaauuauaguccugcugcaauuagacguccaaugguggaguaguaccaaaggagggggauuccccuucucagaggagaaggggaggagguagaaguggggagggcuuuauaaagggaggacuaguaggagaaguggggggucugcgaucaggauauaaagugaaaaaaauaaauuauugaaaagaaaggaaaaaauuaaagucacuuauuauuacagcuuaagugacaacagaaaagaaagugguaaaaacaauguauaauaaaagaauggauuuaaagauuaguaaagguaaaauuaaugaugaacgaaguaaaggagggggguucucuuuaaagaaugagcaagauuuaaugaaagaggcaggaugugagaugaacggacagcagcauuagaaaaaugauaggaaaaacuaucuaaagguaagaggaauagaaacaaagagauggaaauaaauaaaauacuaaaauaucagaacaaaaauauaaagacaugaaauauuauaaagaguaaaauuaaggaaaguggcagaaagaauggaugaaauagugaagaguuagacgcuucuuccuguguucucuaacuugaggccugggagaggagguggcauuaggcaggcuauggcagcccauaggguuagccccccaaaucagccaugcauuguguaagucuguugauuucuauacagugugaugccuuuuguuuuacucuguugcugucaguauucuucugaucauuuauuuacuuaauauuucaacaacauuguauuucuguauguuuauccugcuugugauuuguugagcuucuuuggcacguggauuugguuucgauuaaucaguguagagguuuccaccuugucucuuuccuuguaggacucuuauucuguggaauugacaugcauguugaagcugcacaggucuccagaccuuguucuucucuuccuguuuuucuuuauuucccucugcugguuaucucgguuugcuggcaaucgaacuuccuugauuaaucuuucauuccaaucauugcuuucuccaaaucucuggcuuuuauuuacuuucuuaaaaaucaguuauaaucccucauacuuacagaccuauccaacguuuuagauguaguuuccuuuaguucuuugaacauguuuguauuaguuugacucaaaguauuugucuaguaggucuagugucuaggcuuccucaggaauaauugcuggugacuagcuuucucucuuguauaugggcaguauuuauuuuauuguuuauuugcaugucuugugauuuuggguuagaagaauaauuauguaguuuucaguuuuuacauguuuuuuucagaucuuacuucuuuaaaugugauauguaacauaauugacuugcugauauuaaacugauuccauaaggcugcuggcauuuccagaguuacagugaucuaggaaggaggggcagaaauuaggaauccagcaaguuaaagcaccagaaagcucaccguuuuuccuugagauccuugguuuucuucaguaauugcucucuuacaagggccuugguuaaauuuaaaaguuccaaaaaaagauagcuuugauaauuuuuuucauugccuuuuaaagaaugaauuuucagugguccagaaguauaucucaaucucuuuaauguuuuuuaccucaguaauuuuaaccauuuugauuauuacccugcuauuugauauguuaacauggucgguguacauuuauuggcagucaugaaaguccacucuuugauuucauugagagcugcuugcgaaauaaacacgaaaugguuauuuaugaagcugcuucugccauuauucaucuucccaacuguacugcaagagagcuggcaccugcugucucaggucaguuguguuugaaagcuguccuuuguuuaugcucuuauauuuuuuuuaaucagugggcuugcagaguggguauuaaggguagcauuuagggccaagauugcucagugaaaaaaaaaaaugcuugcuaauggucucagcuuccucuaauguuuagaaaacauauuugcucucagaacuagcacgcuuucucuuacuuaaaugcaaauauuaauugggauauugauuuuuagaggaaaaaagcauuuuguuuuaugugaaguuuuuauagcugaacaaaaagugcuuuauuuuuuauuugugaugauaacuuuguucacauggaauuuugaugcugugauuaauuucccgacacacagaaugaacaugauuauuacauacuauaauuuucaucuaucugaugaacaguauccacagugauuuuucuguuuuucuuuuuccaguucuucaacuuuucuguagcucuccuaaaccagccuugagauaugcagcugugaggacccugaacaagguagguaucccuuugauuaacaauagacaugcauguuuacuucagaaacaugaaaugcaaagcauuuggcuuccucuucaagcuuagaguauaugaccugugggccucacaucuguagcacccugcuuguacuuauggccuucguugaagcuguuuauacuguuaguccauaacuuauuucugaugucugaguacuuuauguucagguguuagacuguucaauauggaggcuguucacaaguguccaauuaaguuaauuaagauuaaauaagggauucaguuucuuagucacuccaguaauccuaccuaugcguauagccacuugugguaaaugaaaaucauacaaacgagugcagagauugagcaguuuuacaauuccucgucucuaaucuugcaaccaguugugucuuaaaauuuauguguuugugaugcuaugucguauauauuaacuccagugggccugaaguugugcccaaccauuaaaauacacaaagauucuccacaaaacauaaaacucuuuugcugcauggauaaagacuuuuucauuagucugggucaucuuuuccuguugaauaaguuuuacugaaagugauuugcagagguuuuuuucacauuucagaauuuugggucagcccaguguggaauggacagagagauggaacaacauagauguagaaugacaggcauauuuuagcaaccauggguaaaauucaguuuggcagcaguuuguuuaauugcagaauugauuucaaaaugacagaaaguuuuuguugaucaacauuuaccauaaucuuuuucuuaaaguuucuaauguguaguagaauauauauuugugaacauaaaaacuauaaggagauggcaccuauaaccaaagagacugauacuguuauaaaggcuguauggaugcaggcauccaccacaucugaccuaaaaugauugcuuuugaccucagcugcucccuuccgauuguuacuuacuuuaauuaaaacuuagguucuguccguuaucaacaacaaugugguuuugguuuuuuguuuuguuuugcuuuuuauuuuacuucuuucuccaagguggcaaugaagcaccccucugcuguuacugccugcaaucuggacuuagaaaacuuaaucacagacucaaacaggagcauugcuacccuggccauuacaacauugcucaaaacaggaagcgagagcaguguagacaggcuuaugaagcagauaucuucuuuugugucugaaaucucagaugaguucaagguaagaauuuaaacaagcuuuugcuuggucuauagcuuaccucaacagugucuuuugagaaggucuuaauguuuaaugaagucuacacucucauucuuuucuuuccuaggccuugcuguauccuauguaaauaaccuucaucucucucuaagucauaaagguuguguuuuauuucaaauggugucugacuuuaguguuuguagccauuggauguuugugugauaaggucaguguuuuccugcuccuuguuggaaaugaaggggcuuccuuguuuugaauccaaagaccuuuccauucuuuuuucuugccuaauuaaaacagccagcacuuuguaacaaagugcugaguagagccaaugacagugugcugggagugaccaaagggcaaugguaagucuuuguggaagagugaggaugauggcuaugucauucucucuaacacucagccgggaagcacgugaaacuacugcucucugcucaacaggcucuagacugaaaaaguaaacaaaaguaggcauuguaaaacuuugggguauuauaaaaauugucuugcagcuauuuuuaaaaauauacuagaguaguauggaaaauguauugguaagaauaauguuuagaauggaaguuggcaaacuucucuaaaggaucauaaaauaaauacuuuaaaugaucugggcuccugaagugaucuauuuacauacucuuuguuuuuauucuuuacaauucuuuaaaaguuuaaaaccaucauagcuuucaacuccuauaaaaaugggauauaaguguggaagggugcugugugccugcaauccuagaaggcuagggcagaaacaucauccguuaugaccagccugagcuccacacaaauuccaagacucuuaccucaaaaaacaaucccauucuuuacugccuucuaaaggaaacuacugaauacaugcaugguuuggggaaggaaauaaagacaugaaauaaauaaauauuguugaauagcuugaugaaucaagaaugcauccuaaaauaaacacuuagcaauguaacuuugcuauugguguuucagugcaacugggaguccccgcaaaggagaguuggccaccugucccaauaugucaaagaggggauuaaucauaaaaagcagaaaaaggauguugagucaaugugacuacaugggucuggucauugucucaaucugguucaaugaaaugguucagagaggcuguuaaugcuugaggggauaagccaguuuucauaacacgauuggucagccugagaaucacuucacaauguagugaccugucuuugaggcucuucuguuucuucagucuaagaugacuacaaauuuaggacaugacuggaaaccuuuaagacccuuuuuggagguguggaaugaggacuuaugaagcugguaaugagacaccucaauuacuguuaccuuuguaucuucagccuugaaggggaugagaauaguucgguaucacacgcuuuauacuuuuugaguugauuaacaugccacugugcaaacuaagcagguggcugacccaaaguuaaaggagacagguaugaaauaaggcagaucccaggcuuuuaucuugcuuuuaguuaccuuguaggcccaauucaaugauuuucagcaaaagcagcuucuaacuucuaagugccuguuagaaaucuguuuaacuauaauuguauaugagaucucuuguucucuuagauaaacuaauaaaaauuacugcuauucaugcugcucuuuguguuuuuuaugggaguggggagccaauuaagguugaaagauaacugacauagaucaugcuacauuagcagcacaacugagacccaaaccugguuuuuuuuuuaauuuaauuuuauauuuaauuauuuuugguuuuuugaauugagguuuuucugugugucccuggcuguccuggaacucccuguguagaucagaaaggccucaaauucagagauccuccugccucugccuccauagugcugggauuaaaggaauguaccaagacaccuggcuugcuuuuucuaauuugaaaugcacauccccaguuuaccuuucugugucuucaucugccaucaaacauuuaauguuuauaucauuuuuuauagaucuguuuaaaaucuuucuuuuuuguuuccaugucuuguugacuuuuucugacaucuaugauaguguguugaauaugauaaaauguuauuaaaauaucagaguucaucaacuagauaaucacagagggaaaacguaaaucuuaaauuuuauaccugucuccuuuagcuuugggucagucaccugcuuaguuugcacaguggcauguuaaucaacucaaaaaguauaaagcgugugauaccgaacuauucucauccccuucaaggcugaagauacaaagguaacaguaauugaggugucucauuaccagcuucauaaguccucauuccacaccuccaaaaagggucuugucuggauugaauaucugauuguacaaagcaaaagaauaguuuuuuuuaaaaaaaagcauaacgauaucuuuauaacccagugugaaacagacaugcauagauguauguacacaugcauacuuuaccguucuuggucaaggcaagguaugucagucacugccccagcucugcuucuacaaagugacucaaagaagucuuuuuugcuugauggggcaagccuguucccuuaacaugacuuguccugcccgagagcgauuucuuuuuuuuuuuuuuuuuuuuccauuuuuuauuagguauuuaacucauuuacauuuccaaugcuauaccagaagucccccauauccacccacccccacuccccugcccacccacucccccuuuuuggcccugguguuccccuguacuggggcauauaaaguuugcaaguccaaugggccucucuuuccagugauggccgacuaggccaucuuuugauauauaugcagcuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaaaucuaaggaggggccgagagcgauuucuugauggaaugauugugaaugccugugugugccucugugcguauguguguguacgugcacuaaaacauaaaaugauuugacagacuggaacuaguagacauuuuguauuuauguuccaucuccugaguccccagcuuuaccucuguucagcucgaagcagccauuacagagagcaucccacagcccgugcagagagaauaaaguauugaugcucgaaaauauaacaguacaggcaaaaccauauuuuuacuguaaaugugaaaauauaggaaagcccucaaaacagaagauacacuaaguucuugggguuggaugugagauaauuggggguuuuagccccccucaucuuggcacuagccuuuguuaacuuucaucuacccuuuccuucaucuguuuuugccauugcauuuuauugguuuauacuagcaaauacauauguacacauuucauacauuauguacaaaaucaucuucauaccaauacccucuuugccuuccuccacuuccugcuaaccuacuucuuuuccccaacuguccucccuucuacuuucauguuuaacguguguguagguauggagggauucuucccgugaguuucuuuaagguuauuuacaggaacaugaacaucuuaccaguggccacaccucugaagaaaauuucucacccuccccugucaaccacuaauugugaauaaaucuucagagauggguagaaccccaugaaccucucugcuuuucaugauaagguagcaaugggcccaaucuucugcagaugacagcugcuaugaguucaacaguacagcaguccugucaaaccuggaagucagcauuccguaccacucccuccuauccugacacucguuuuuccccuucuuccucaaguaaaagguauguuugugugugucugugcaugugcacacaccuuuaagggggcuguauauucaacagccaucuauucccaguaccuuaagcaguuaugaauugccuguagucacugccaaucacuacauuaagaagguucucuggggggcuggugagauggcucaguggguaagagcacccgacugcucuuccgaagguccagaguucaaaucccagcaaccacguggugacucacaaccauccgcaacaagaucugacucccucuucuggggugucugaagacagcuacaguguacuuacauauauuaauaaaauaaaucuuaaaaaaaaaaaaacuuuaaaaaaaaaaaaaaagaagguucucugagcacaguugacagcagcauauauggacauuaacacaguuucuaggaugcaaauccaaucagagaauaguugguuauccccaugacaacuuggacuugucacugcugcaccagugggcucaucuugacugccacuuaauauugccuuuccuuuaucuuuuaaaggcccauccuuuacauauauuuugcuccuagccccauucuuauacauugauuagucuaaaaagaaaaugcagauggcacccuaagaaguaguuucagaucaacuuugaagaaaaaacaggcuaagauggcuccuaaaaagaacaucccugcucagcccauggauuuccugcacaucgucuuacugaguccuaugcuaauaaaaguucuuuauauucccagugccccagaagauagaaaccugagauaaagagucagcuuuguugucuucggagucagucuuauauaaacuugcuuuccuuuaccaaaacaaacuuugaaucugacaaaacuacccuaaauaaaacauagccuuaaaaauugcuuuuguuaaaaaagcauugauggcuuucuugaacccacagauuacuuaaaagaaggaugaaagccugguauccaaaguguguggugucuucagcaacagaaucuuaccuucaaguuucaggaaucagccuaaagcaauagcaaugacuauauuguguuggaagucucuuggacacucccuaccuugaugaagaugaagcagacaaaaacuagcauauauuaaguggaaauauaaguacagucauuuuggaaaaacggacagagcuaaaugaauauaugcccaguucuacuccuaaguauauucccauauuugaaaugcauguacaagguucauuuuauaaugccagaucaagcaguuaauuuuggaggaaucuauaugguuaaaaaaugccucuaaaugccuagguuugacucucagacuucuuagaugugugauugacugccucaguuuccuugaccauaccaaggagaugauaauaauucuauucccaucgaguuguugugaguuauaaauagaaugauaaaaagcuaagaggacucuaguguuaacuauugcugguuucuaggugaaucauaugagaacuauaaugguuccuauugagugguugaauaucgucuguauuauuugaauuaauucuuuuauuuuaguacaauugccauaaaucuuuaaaaguacaaauagauuaauuuguuucaauaugcuuuaaguuuuaguauugccccucccauuuuaauuauuuuguuauuucauuuuugcaacauaggacacuauacuauucaaagaaguaguaauacauuuaaaaguauaaaacuuccucucauaugucccauaccuccuuauaaaacuuuauucacuuacacauuugucuucuuuaguaugccuuuuauaaauauaagauacaugcauauuucuuauuuuauuguacaucaaaauuagcauacugcugugcucuuuuuguacaguacuuuuuuuuuuuaaccuaaagauaaauggaagccaugcuaaauuuuuugaaagagauaugccucauuuucuuuacagcuacauaauaccccagcaguuuuuauauauaaaacaagguuucuguuuggguaaugugcaguuauuuuguacucaggaacaaugcuucaagguauacccaaagcgugugguuuuuuaaacauuagaucuguguuucaaaacauauuuguuaugaaagcuaaauauaauaaauauucauagagcaagccaaaugcugccaggaguguauaaaaguauggcuuccaauaaucuuaccaguaguguguguguugagcuguuguaguuugccaaccuuuuggaugagaaauaauguuucaauguguaguuuuaauuucuguuaucauaaggaaaauuaaauaucuuuccuuuuuuagauccuuguguaugugcuuguaugauauuugugugcaaguauguguguagacauggguacauauaugcuagaauauguuugaaggccagaggacaagccuaggugucuguuugaggcggguucugcuugcuacugcauucaccaagcuagccuguccacuggcuucccaccucuccuguguccuccuccccucuagaucacuggagcagcauugggguuacggauacucauagcuguauccacacuuggguccucacacuugcuuggcaagcacaucacccacugaucuauccgucuccccagccuaaccaucuucuguauugccaaaggucauuucauaccucucugugaagugccuguucaguuuuuccaccacauuuuuuacaggauuuugucuuuuauuuuuuccauauuuuaacacuucucuuauguuaaagauacaaacaugugaaacauguugcuacuuuuccccccaguuuuccauuugucuccuguuagaauggauucuguaaugcucacgguuuuuguuuguuuguuuguuuuuuguuuuuuuguuuuuuggauugugguguaguuauauucaucagucuuuuugucuauuccaucugauuuuuagucauuguuaaaauccuuguacuucuuauuguggaggaauucacucauguucacuucagaaacacuuauacuuccguguuuuauucaaguuucauauguccuugcucucugcauuucucuaucuacuuuuuuaucuauuuguacacaccauugccacacaguuuuuaauaagcuuugucgacccuguuagcagcuguuaacuucccaucaaggcuguuguuacuguuuuccaagcuuguauguuuuuuuuucuuaucaaaauaaagcucccuuguuucauaacauuuuuauuguuauuuuuauugggaucauauuaaauguauaaaguacuguagaggagaacaagcuaucuuauugauggugaaguccuaagcaaauaccaggauuguguucagccccuuugacugcuguuugcuuuccuccaggugguggucgugcaggccaucagugcucucugucacaaguacccucggaagcacagcgucaugaugacuuuucuuuccaacaugcuucgagaugauguagguaguagucuacguuuuaacauaggaaguuguucucuuaaauucccucgauugcuguuaaauaccaccacaguguuuuuguuguuauuguuuuuaacucacuucuucaugguuuguaucauuauuuuuuucuuugauguuguaaugcauauauucaauguaucuuaauaauguccaccccuuuccugccccuggaggcucuccaacucaacccaggaccucccauuaguauuuuaagcauauuucuuuaucauguguuaaauauauuucuuucucauuucuguauaccaugcaaacauauacagaauuccaacugcuguauuuauuacagcuaauuauuuucccacuugaaggggaacaacuuuguuuuuauuguuauauuaaauaaaguuaguugaaauuuuaauauuauaagcaugaaucuuaaaauauaagcauuucuuuaaaauaaaauucuaaaaaguuccuuaaaaugggaacaccauuggugguggguggugguuagauuuuaaaaaaaaaaaaaagucuuuagaacaaauagcaguuuuaucuucucuuuucucagggagguuuugaauacaaaaaggccauuguggacugcauaaucagcauuguggaagagaacccugagaguaaagaagcuggucuagcccaccucugugaauucauugaggacugugaacauaccguucuggcuacuaaaauucuccacuuauugggcaaagagggcccuagaacuccuguucccuccaaguauaucagauucauuuuuaauagggugguccuggagaaugaggcugucagagcuggugagucauuagagcacaacuaaugaugucauugcuggucuuugaauauaggugauucaagagaguaguaaugaaguugcagguucccuaauguugugauaugaucuuggaggacacccugguuccagauauacagcucuucuuuuguguuucaacuuccacacagauuuuugccuuuaauuagagaccuacagcccuugucuuucagugugacaggaauacuauaguggggccucuauuuuuucuuuaaaccauaaguaaaauguauaaggauuuauguauguauagauguguucauauauacaucuuaagugacucuuucuagucuauuaccuagaaucaguaaauucuccugugaucccuucucuuauaaacuauugaccuuaucuauccuuauauuuuguuuccagauaaacucaaaaaugacaucacuaguugccuuuauaugcucuuuguccauuuuuuuuucagcucaauaaaauuuggcccucuuuaaauucuuucuuguuucauuuuuaaauuacauauaaguuaacuggucagucagacuacuuaauauuuuuaucuuaguucacauucuucuagauuguuuuuuugagcuuuguugacuccugaauaugaauguucacaccaccccucaaauauaaugugaaauucaaacuacuucaaacugaaaucuucacuugauccuacucucacaagacagauuucagucacagaguugaaccuuccucuguucuuuaccacagugcugucacuuuucuucccuccugauucuucauucuccugucuuuaugucguuugguacagcuuuaggcuuucauucauuucugaucccuagcucaucuguuucuaguuucacagacaguauuuauuagcugaaugugaagagccgucauuaaaauagcaaacuugggcuggagaccugacuuagccuuaggaguacuuacugcucuugccaaggaccugaauuuggcuuccagcaucuacauuacauggcuaacaacuaccuguaacuccaguucccagaggaucugauauuucugaccuccccuagcacguguguucauguguacauagcugcacacagguggauauacaugauuaaaaauaauuuguacaaaaucuuaaaaaaacaaacuacauauauauccuauaccuaugugggauaauguaaccuuuaaaaccuugacgucugugugguuuuuaguuuaucucuagucuuuuacuuucauucuaacauggguccaacacuaagccuuucucacucaagucuaauagcaacacuuucugcucaggacacaggacguuuugauuuguuuuccuuucuaauacucuuguccugccuuuucccucuggcugaacuaacuauccuaaaaaauuaagugcaguagcaucucaaaucuuugucuuuccuaagccccguacuuaccuagcaacuuggauacaguuuacgagagauuuacuaggcaagauagucuuuacuugucuaucuuacugcagccacacuccuuagguuagagaccaugucuuuuaucuuucuaccccuuagcucuugccacaccuccagguaaaauuuaggugagcauugaauccuuguugaaugaaagaaauuuuaauaauaguuuuuuggugcuaguuguuuaaaauuugaacugaaucaugucagaggauauauaagaggcugucauggggaagagacagcucacacccaggagauagauaggugguagauagauagacagauagauagacagaugauagauagauagauagauagauagauagauagauagauagauagauaauuauuuuuccucgcugaaugagaaucuuccucuauagaguuugcuagauucuucacuauucuauuuauauuuaaguaagaucaagaaacugucaacacaagagacuuuauuucuauugacuaccaacugcuucucuaauuugcuucuaguuuugguauuuuuguuuuguuuuguuuguuuuccacuacaaggucuuacuuuguagcuuagacuggucucagacuuugaguaaccuuccugccuuggccucacaagugucugauuuguuuuugaauguuuauugcuuagcucugagaagccaguauuuacauugcuucaucuuguguuucacaauagcugcugugagugcuuuggcuaaauuuggggcucagaaugagagccuucuccccagcauccuuguacucuuacaaagguauguaaaagaaugaaugcuggcuguuggaaaauaagaauuccauguagcuaaguaguaaaaaaaccucuuuguacuaugucagauaaacugaggagccaagaguagagcugauagaguuaguccagggcaaauggaguuuugggggucugguuguuuuguuuuugguuuuuuuuuuucuaguaauuauuuaugugcaaaauuugaguuuuagauuucuuuuaaaugauacugagagaguaagguuaaccuguguaccucaacuuguacaguagguacuaacuuaaaagagaugugaaaugauucguaugaaaagcuaaagauaguagccuuuuaugaucuccauaacuccuugguuggugaggaaaggaaaaaaguuggugguccuuuuagcaaauauuuugugauugcauuuuauaacuaaagcaauuaacucauuagccaaagacugagacuaacuaguuuaaguaaaacagauugccauuugaacaauggcugucuagauucugagugcuaguuuucuuuuuguauccuuagaaaguuuaacauuuccauuucuuaguuguagaaaagcugucuuuguugagcucauguagucacagguucaggauuagauuguaaauuauuaugucaugguauuguguucuuccuagugaucucagugccuucucaaauagcaacauuucuuuaguaauucguaacaggucaagaauuuuuaggauguuagcuauuauugaacucuugucauaaaagucauaucagaugaccucagcugcacucuucagguaaguggugagacuguucgacaucucuguauacaaagacuuagacagaagugugccuauacuauuuuuucugaucagguguaugauggauacugaugaugagguacgggaccgagcuaccuucuaccugaaugugcuacagcagagacagauggcccugaaugcuacauauaucuucaauggucagugagagucaggauuauggacacauagcacauuuguuugucaaaugagcaauguuuuuuuuuuuuguuuuuuguuuuuuugguuuuucgagacaggguuucucuguguagcccuggcuguccuggaacucacuuuguagaccaggcuggccuggaacucagaaauccgccugccccugccuccugagugcugggauuaaaggugugcacuaccacgccuggcugagcaaugauuuuuaugcugagucauguauuagcugacuccuuuaggcaguugaauguuuuaaaucuuugaaugcaauucuguuucuagagaaacccauauucauaaagguauuuucuaauuugguaauagcaguuccuauaaaauaauagagaagaugauuuuuuuuuaaaauaugaaaggguccaaagaauauggcuucuuaagcucccucucuacagagugagcuccaggacagccaggacuauagagaaacccugucucgaaaaaccaaaaaaaagaaaaaagaaaaaacuuaagcucccucuuaaauggcuguccccauuuucauuuucuucugcuuuucuuguucccauauagauaagauauuuuuuuaugagaauugcuugcauucuguugauauuuuuuauucuuuguucccauguuuccuugaaagaaauaaagcagcuuauaaguuuaugaggcagaugucuauaauaaucuuuuguuagauuaaguaggcuaucuacagcuuccuaaugcugcaacccuuuaauacaguuccuuacauuguagcaaccccuaccauaacauuuuugucaccacuucauaacuguaauuuugcuccuguuaugaauuguaauacaaauauguguguuuucugauggucuuagacagcccucgugaaagaguacuuugauccccacagauugagaaccacuaggcuauaguuuuuuguuauguuucucuuucuuuaaaaagcuuaaccauuacagauuguugagaauagauuauaauguugagauuuuccugucucuaggucugacagucucuauaccagggauggaaaaggccuuacaccaguauacauuggagccuucagaaaaacccuuugauaugaagucaauuccucuugcuauggcuccugucuuugagcagaagucagguaucagaacuguuuaccucuaugaguuuuucuguguguaagucauuucauaaaaacuuguaaauauagcgucuaaccuggagaauaaaaauagaaaaagauuuuuaaaaauagcauaguuucucucucuuucauuuuuuuuuuuuaaauucuuguuuguuugguuuuugaggcagggucucucuauguagcccugucuuagaacucacuauguagacaaagcugagcugaaacucauagagagcuaccugccuuaucuuccaagugcuggcauuaaaggcauaaugugccgccacaccaggcauauuuuuuucucuuaauacuuuuuuuuuuauuccuugagaucuuuuaguacuaagauagaugacauuuuuuaaauuuaagauuuucauuuuuaagccucuuugguuuuauccaaaagccagaauaagaaauauguccuaaguugaaaaaaaauuuuaauuauuuaauacaaaauaucacaauauuugaagcuguuugccacuguguaucuacuagaaguuauugccuucauuucuuucuguauacaaggucaguuagaaguagaaaaaaauucacuugacugcuuauuucugucuuucuagaaauuacacuugugacuccuaagccagagaaguuggcuccuuccaggcaagacauuuuccaagguauauuuuuaugaauacaauaguuuuuaaucccuaggcauuauaaauuaauaacauccacugcuuuuauucauuuugauuaauucucaauucuguacauuuuccugugucauaggcuuuaguggcuggagcuaccugcuguucauggacuuuccaguuacuaguuuacuaccugggacuguuauucuugugcauauuuuguugguuaagagagaaagaauuagcaauuuaguuucuucuucccuccuacauaaaggaaucuaguauauaaacuuggcaacuuaaaggauuauuucacagaaguuuggagaucuccaaauugacuuuucaauuguuaguaaaaccuuaaaauuaaccgcucuuucuacucugugguaacuaaagcauuuuaauaaagucucuuccugucuucuucauacuguacuuguauuuucuuucucuuuguacuuaacagaacaguuagcugccauuccugaguuuaugaaccugggacccuuguuuaagucuucugagccugugcagcuuacagaagcagagacagaguauuucguucgcugugugaagcacauguuuacugaccauauuguauuccaggugagauaacaaacuaacucuugguucuuuuauagccuuuaaguacaagcugcuauacuuggagacaaauaguacuucccuauaguuuaugauucuaguuccuuucauaaaggauugauuaagcaacacuuccaguuuucuuuuuagauguauacuaaguuucuuccucugaugggcuauuuuugauaacuaaaaucuaaaaggauauaaaauuaaaauguuccaaaaauagauauacagcauaauuuuuuaaaaaucaguauuuaaacaaggucaacuaaguguguuggucacagaacuuagcuuuguaacaccuugaaguagagacagacucaggaagacacacacugauggcucagcacaaagcacucauaauaagccugucuguuucacagacacaguugggagaacacucauggcagguauaaggcuugccuucaaucuaauacaaaaagaagaaaagccuuaggagaccuacagugcuacuuaguguugaguauaguagaugccagagcugaacugugaacuaugagugaguagaaaccacuuauuggaaagcauuucuuauucuuuacaaguuuucuauugcugacuuuucaguuugacuguaccaacacucuaaaugaccagcugcuggagaaaguaacagugcagauggaaccauccgauuccuaugaagugcugugcuguaucccagcucccagccucccuuacaaucagccaggaauaugcuacacacuuguucgauugccagaugaagauccuacagcagguacuaacucuuagaagggagaagguacuuagugcucuaaaaugcaucgccucuugagcucuuagaaugucuugacaaguuuuuaauuuucaagaauguaauucuuuccagaauuuaauguuggggguggguguguuuauaaaguugauuacuauuauauagguauuacuuucaaaacuaaaucuguaaggaaaaaaugcugaugauaauguuaaaagaggaacugaaugugcacaguaauagccuaaaaaagcauucagguuuucuauugaaacaacguaaagcaugagugaaaaccugauaugucuuauaagaaucgggauguuucuuuccaagauuccuggggaaagaugguuauuuagcagaugguuggcauuuuaaauacaucacuuuuaagcaucuuguagcauaagacuacagucugcaguguuucagccucguuagcuuagucaaccauuuuguguuccauauuugaggaaggccuuaucauuuacuugaccuauggucagucuugggguggaaguggcauaagggucuaaaugagagacaauuacuagugccaguuauaguauuuauacuuugaggauuuuggauggucuucaugguguauccuuuauaaauguugaaaucuaucccacuugaaccuccacccaacucaguuuucccauacucauugcagaacugacccaacuuucacagaaauaagcacacauagaccauuaauauuuaaaguuuuuacuacuuguaaguacaugaaauacagaaauuaacaauauuaacaaacaucagagaaguuacagaauuacaagagaucauaaaaggacuaguaaauaguucccuggucaucauucaguuacacugagggcguguucugauuuauagccucuucuccuaacucccuucuucaggguucacucaugggaacugcugaccaaucuuagcuggguugggugcuagacuaggcuacucagacucuggcacgagguagauucauguuggcaccauugcugagucugaaucccaggauguucccuuugauccaguggaacuguuuguguuguacagccacuuggaucuguaacuguaacccugggugggaaggaaggcacuuuccuaucuggacucugacauuucuccuuugagcuuuugguaaucugucuuuaaacuuaauaacuuuguuuauuccuuuguaaaauccucucaacuuccauuuccuugugguuucacuuuauucucuggucuucugauauauaugcuagacaguauuuaaacuuucuguucucucaaguaaagcuaguuuuguuugcuacuguuccaaauuuauaucuggguccagccuuaaugcagcucuaugucuuugcuaucauccugggagacucuguuuuuuccaauagccaucuuucauugcuucagaauucuuccacaaucacuguacuucucacuaaacuuguguguuauuaauuuuuaagggaugccauuaauuuacacuuaauuacaauaggaagcaaaucugaacccauugaaaacuccagcccuucccaguugagauuacuagcuccucaguauauacucaauacuagcuccucagguggacucugauauuagauaacucaggggacccacaccccagggaaugggauuaaaagaauaaguacaguuuuacaauaccaaaauacacaaaacaacgauauugaaauuacagcaguuacauauagggaaacaauaguaacauuaaacacuuccaccaagagagggagaauagaucaucaccucagcucucuucacugagagguaacuucuuaaaacagaucuuacauguuauuagcccagagguuugaauguuugcucugcuggcuauggacuauuuggcuuuuguuugugaaaauuuggcaauuagagauguuucuuuauguuagauuuagaggguuuucugaucaguggcauaauguggcuauaaacuccaaucuuguuucaucacuuuuguguuugaccuaccauaugcuuucuucuuucuauucuuuauuuuuauuagaauucaugaauuuuagccuguagccaaucucagcucuacugugcaaugaacgauaugaaauaccaggacagaggugguaauggagcccauccuccugucugucuuuucuuuaacauugaacuuuuccccauugcagauauucuaacaauuaccagucacuucagaaucgugucacuucuaaaacauaucuuaucucagaaaaaauauuuuuccuuacagucucaaggaaaauauagaaauucuuauuuaugauuucuuucaacuugaaaauaauaaagcauauuagaaaggaauauggguuuaauagauaaagguaauaauuuuaauucuggcccuaccacauacuaaaucugugaauuggacaaauuauuuuauuuguuuaaguaucgccugguaccaaacauaauaacacacaauauuuuguuuaauuuugggcuuccuuaauuuuuuucuacuagcauauuuaaaauuaguucuucuauaguucaaaagauaugugcccuccaguauucuucagacuauuauucauugauuauaacuuucuuugcucaaucuauaaacauccuuggcucuaagauacugguuucugaagauugugccacuuacaaacucaucucuuuguaaccauuuacuccccuuacccaacccguucauugauacuugaugaaacuuuuagggagccaaauagccuccuuuaccauuggagcuaugugaauuuuuguuguaggccauauuaauuauaauucaaccuguguccaacuuuucuuucaauucucauaguuccuuuuuuuuuuugucuuuuucuuuuuuuguuguuuucuuuuuucuuucuuuugauuuuuuccuuuuuuuuuuuuuaaccuuuuucuuuucuuucauucuuuuuuuuuuuuuuuuuuuuuuuuuuuucuaagacagggucuuccucuguaucccagguuggcugugaacuucugaucauuuugccacuaaacccaacucaaauuuucugauuuuauaauaaacuaugugauaguccuacuacuuucucucucucucucuuuuuuuuuugucuuuaauauucuucuguuuucuaaauuagugaaguuguuucuucacuaaauaaaggcuggguuacuuacugacuugcuucucuuaugaagagaacucugcuuagucuuugaaaaucugccuaacauuccuugcuuaaccuggagauacguuaccaccucccacuuuggaaacccugaauucugccuuuugcuuuccugcccuggcuccauuauaaagggugagccacaacuucuguugguuuuaaccucucuuggccuuuucauuuugcauuagugguauguccaguuugauucaaaauguuuguuggcauucuacagcuaccuacuuccuccucaacaacacuccuuggaaccuuccaaucaauaugagaacucccaagucuuucuagcccugucugaucacuuccugauuuccacucacugcucccaucacugucaaccucugcauuuaggacaaacuccacugaguccaugugcucucuaacuucaccuagcuauaaaagucuaggugauuaggucuaccauugugggaaaaucauguuuuuuuaaaacacagucugagacauuuguccaugguuaucaaugacauagaacucacaguuauuuuauaggcacuguuuuucuuuuuugccagaaccauaguuuuacagcugaauuaaauaucucauuuucucuuuucuaaggccugagucuaccuucuuggugugguucauuccucugagccccucugcacccuccucucucccagcuccucucaugcucucccucccaccuauuacaacuuccucacacuucuccugggucccaguuaacccuuucuccugcucuaccuuccacugcucagagaagcagagucacccucucaacaccugaagcuucuuccgaugcccucuggggugcuccgguguauucuacagaccugugcgucagcaccccagcuugaccuguccuccacacccacugcuucaccugacuugggucucucugcauccgacugauuguaccaagucugcacccucuacccagcagucucucuggcccagacuucaugguccuucuagaacuaacuguguccauggcucccagugaccugugcugcuucuuuucacauccuuccauucacaucugaugaagcucucagggaaccucugacucugaccgugaucuuccaccuguccuguguuuuggcauucugccugcauagccuacccugucuccagaaguucuaacuuccacacugucuuaaugcugcugaacugaagcucucucccuggggacucuagucccugaauuuucuuucuacuccucagcacucaucuccuuccaugagcuucccuacaucacuggcuccauuuuuaccugccuuugauuccuacauacaacuagcuauaaacaccuuucaccucuaugcauccuccaucucuaucagccucacugccccaccucaguccucagcaggaagcacaguuggcagugcccucccugccccugacaggaaacccucucacagcucucacccuuccucccaccucccuucugcacugcauccaguugcugcucacugucaucccccugcaccagcaggaccuuuccucccaagucugacagucaugacucugaugccuccuccaucugcucacccuuccuucucuguagccuucuccaucccccuaccccuuccaccagugauucucacccgggggugcauggcccccaaguagccuaucagaaccaucuucugagcuaggguuguuguuaauguuugugagcaggucacugcugcuccccucugauguucugauaggcuacccgggggccgugcccgccccccccucggguggaaccccccaccccccacccccggguaagaaucacugcuguggauggcccccuguccucccuggccuuuguuccccuauuccauguccccagcuuucugguggugaccauuagaucuccucacucaagcaccucaguguuuccuagucuuuauccuuuauuugacacaacuuauuccucucccaguauaaucuuuuacacagaacaugcccugacccagucuguaugugaaagguauucuuuuuaacccuuugucccuagcuaucauauucagauaccuggcaucacucaggucuucuuuagucugggucuucggggugacuguuauuaccccuuucacuuuccuccucugcaauuaagaaauugugguacccucuucagaaacuacaccuuuuuuucgugggccaacugguguuguuuagagcagcuacugcccuauuucaccccuuaacauccuaaaguccugguccuaccaaaguagauguaauccuuccuggccauggccauggccaucacauugaccuuucauccucuugcuugcccuuugacacauugcuccaaggcuuuccugcaugcucacaaccccacaagcuugcuccucuguagacucuugcuaucuuugauuugcccauugacuccuucccauuuuuuguuuuguuuuggguuuggauuuggguuuggguuuuuugagagacaugguuuaucugacuagcccuggcuguccuggaacucuguagaucagguuggccucaaacucaagagagccaucugcuucugccuccugauugcuggggugaaaagcauucaccuccaucaccaaccuaauuggcaucauuguugauccucguuguacucuugguucugugccuucccugcacgcucuccucuacaucuacaugcagacuccuaaccuccucucccucucccuaguccagcuaaucccuucucuggcuguauucuuuauuccaggaaagcauaggcauacccaccacacugaaagcccuuuccucuguucccugcaaugcucugguucagucuguagaacuggguacacgcucugcuucaccuguguccuccagacccauuguucaaaccaugcuccuaucuuugccaccaacugcuuuuauaguauacccagcaguccauguaaguuccuucuagaauuccacaaucauggcucccuggaaaugguuuccuucuucucaugcuguuuguuugacaguguuccugaaagucucacagagagugucaacuaccucuugauguuccugucccccccacccaaugcuuuuugucuucugcccucauuucugccuacccaucuugaaaaaagggugcccauucacucugaauugcugcugagcugacagcucucuuucaggacacugcaucuuccuuuucuuccaucucuaucccccuaccccuuccaccagugauucucacccgggggugcauggcccccaaguagccuaucagaaccaucuucugagcuaggguuguuguuaauguuugugagcaggucacugcugcuccccucugauguucugauaggcuacccgggggccgugcccgccccccccucggguggaaccccccaccccccaacccccggguaagaaucacugcuguagauggcccccucuucucuaugaccuucccucuucagguccaugccuugagcuuucuaguuuugacuccuugaaauccucacucaagcaucguagccugcccucaaguacuccccuauuggaaccaccuucucauuuguuuacuccuucucaagccugccucuaccuucucuuucccacacacuggcccuucaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaauucuucauaccuccucguacuguuuguucaccuugcgccucuaugcccaaauguagccaauuagauguacgcugggcucugccagggcuuaccaucugagcccucucuucuacacugucucugcuugguggccuucugcauguguuuccuucccuuugcuuccagucuaucuuuucauuuucauucccuccugaauuggggcccaagaauacaguguuagccuucaucuaauaccugucauuccuuagugccggcucuuuuauauaugagguuauugaucuucuguucugggugcagcauucccaugaauucagugcugcuagguaaacaaccacucuccccccacccccacccccaccccaucacugcuuaacauacuuuucaugcuccuuaauuuccuguguccuguauugaaucuauuuucagcucagucuagaccuauguggaugacuguuuccuucaacccucucuuggcacaccuuuuucuacagcuaucuaggauucuucaggucuguauucuuuugccaugguuaacuccuccaacuucccacucuggcuugugcucacuagacacuauaucccagcccggcuacacauccuucuuccugugcagcuucagcacuuaucuucccaacucuguauucuuuccauacucaucuccuuagcaaguccucauaaaauguaccucacuuuuuaagccucuuuaacaggggucugcagguuuuguuuucuuuguucccuucggguuuugccuuuccuguuucaugaagcuguagucuuuaugauaguaaaguucugcucuugcccugacggccccucugacuuccucucgguucucccaggguuucccuuuucucuagccacacugaugcauuacuaccaugauuuguacuguagcccuuggcagauuccuuacaaguccucguugugucaaccagaucaguuaaugaaaauugccacaaagguucuuuuuacacaucccucuucuauccuuuccuaucugucacauccacacugaaauggccucuuucuugucuuuugcauaaaauucaaccaguuugccccaaucuguggucuagcugucugccauucauuuuguuucuaauuuacccccagacuccuaauccugcaacuuuacauagcacucuauuaaaauuuauauugaaggauuuauggcauugaauuguagugucaucaauagauuacucauauauaucaauuauauaagggagaaagggaaggaaagagggauggauggaugcauuauggagguauggaugcauuauggagggauggaaugaacguuuacagacugaacaggugccucuuggugcucacacugucaucuguuuacauuugagucuccuucuucucuugcuuagcccccacaauagcuuccugguguuucaauuucuacuacuguguacaugugugcccuguccagaucgcugaccagcccagagacaccuuuccuccaucccugcuggccaaauucucuccuucaaacuguuuggaaaacccugucuucaucaaaauuuuacuuuccaaaauugugucaauuuuuuauuacucauuugucaaucaucugacacauacaguggcuguguguuuuuccauugugaaacagacauuaucaauaauaaaaccucacuuugaccucuuuacugcacauugaagguugauguagaguaguuuauucugguguuguguggauccacucaguccacaaucuaaagacagcauugagaccaugcacuuggucaguguuacucuaaugagcugucugcuuugcuguuaguaguguuugcuuuguuguauauuagagcaaugagugguucuaaauuuuucaaaauagacuuuuugaccuacaugacaaaaagucccaccaaaaucucucccccuacuuuuuccacgucaacacaaaaacaguauccucuucugugcacuguucuaguccacaguacagaaauauuuucaaaucuugcuuugugaaacugacuuuuugaucagcuugcaagcugcuucaagaacuacuaccuucaaacagggcaugcacgucuauguuagacgugaggauguggagcacagugcugagcauggguggugcguccucagcaaugaugggagugugcaugcucuguccacucaugugguuucccugcuucucccuccaguugcaggcaccuuuagcuguaccaugaaguucacaguccgggauugugacccuaauacuggaguuccagaugaagauggauaugaugaugaauauguggugagucuucccugccgagaucuuugcaacauuaaaugauuucuugccacaagcgcauuuuucuauaaacagcugacaaaacucacgggaccuagacuagccuucucuguaaaggaacugucaugccaggauuuaaauggagcacuuuguaauuauagcaaagaaacucacuguuuccccgcgcccuuuaaugggaauaacuaagagauaauuacaucacuuuuaaugugauugaauuuacuuauaauauagguuuugguuuugcuucugcaaacuuucauuugguugguuuuaauauuggcaaguccuggacugaaaagcuuugacagaaaggagggguggggugucaaguucagaaggugcuauaugcccucaacucugagugugacaacaugacuacugugcaccucggggcaaucagcacucagccuacacuuagcucuuuccagguuguucuugcuccucucuacuaggaccuauagcuagcauugggcucacccagaccacauuagugaggaagggcuucccucaggcccuuuguaugguuuggagacauaauaauaagugaucaguuucuucuaucuuuguuguagacucaaaggacuuuuauuuacugaccccugcuuguugcccacuagcuggaagaucuugaaguaacugugucugaucauauucagaagauacuaaaaccuaacuucgcugcugccugggaagaggugggagaugccuuugaaaaagaagaaaccuuugcccugagcucuacaaaaacccuugaagguaagaacuuugcugcaauggguugccuggagccaguauaaaacccaggaggcaugcaugcaguucucaaagaacuccucucugcucaaaaacaggggccugucuucaucaucugaccaaaucagccauuuucuaggcuaggagccucccucuagucuacagcccugugcaccugcagcucuuaggacaugguggggcagaggcagacccacauguuuaacuuuucuaauucuuguugcauuaaauuucuccacagaagcugucaacaacaucaucacauuucuugguaugcagccaugugagaggucagauaaaguccccgagaauaagaacucccacucccucuaucuagcagguaagagacuuccaucaggcccggguggggagaggcccuccuugcccugcugcuucugucauccauuauguaacuauaggaaagcuaguuagaaugaggaguugauuuuacagcucuccuuagguuauccuuuaggggcaccaucuggcuaaaauacuugaauguauaacagaugcuguugcuacucucacuaaccacuaccugagugcaccaggcagugucacugacuaccuccauguaccugguauuucauaucaacauuaaaaaaguaggauuguuuguaggauuaauuuccugugaauuuguauaaaggcugaacuaaaauaauagaaaggagguaugggcaaaacaugauaaauucuauuaaucagagauuauuugaaguucuuaauauacuuuuccucgcuuuuucucucagguguauacagagguggcuaugacuuauuggugcgguccaggcuggcccuagcugauggagugaccaugcaggugacugugagaagcaaagagagaacgccuguggauguuaucuuggcuucugugggauaaguucuugcugggaagggugauguugcuaugcccucccuauuggugguuuuuaggcuaguggcaugaucuuccaagaaucacacauaaagauuaauaaugaugacuuugaagaagcaaauccaaguguuuggcccugcgccagcagaucaaacaucugucugucugucugucuuugagcaugagcuuuagaguuucuucccucaucucaugucucacucacucagccucggugcgacaaugcagcuuugagugggcuugaaaaucagauacuacuuaugcuauucuacagcugcuuagcuucauuauaugcuucuauuuaaugugugaaaaacucuuggcaaugcuggaaaauuuuaucccagaaggguggagggggaggggaagccggaauccauuuuugucacaguuuguuuuuauuaauagaaaauaaacacucauucauuccaguuucaaaguugcuauacuugaaauuucuaauuuaaaaaacgaauuuaaaauaaucaauaaugcugcuuuaacuaaguuaaaacuguggcuuaaaaaaguauucagcaccauuugcucuuaggucuuucagaauuuguucuuaaugucucuggaaacuugccuguuuaaguacaggaguuauaugagaaagccuuucugaacagccagcgggaugcugagcggccaucauagaggagccaauggacauucauuccgcacuuacaugucccuuccccuccacgucagcccuggaggagcugccccuaggcuguuauuuacuauucagcuuggacuuucuaaacaguaacaguaaaucucuggcacagaugcaguucuuaaugccuggcaguuuuaggaaauucugcaaauaauuucaaccuguuuauucacaaauucuauauauaaugagguuuucuucuuagcaagggccaacuguuuguaaauauauacaugaguaugcaaaucagucuuagacucauacucagaacacuguauuuacgccaaugucuauuuagguucgaugggcugggguggggagagugcugggaacugaacccaagggcuuuaacaugcuaggcaggcacacuaccacugagcuacuuccccagcccccuaagccaaugucuguuuuaacaaaaaugucuguuagaagcagccgaugaaacuaaauguaaaggagugacaagaugaucccucucauaaacuguaacagauccugaaagggagauagcaagcuccucccucacucuguauuccaguuaggauugggccggaagggagcacuucuaaauauuuuaauaaaguccacagaaacuggguuuuuguuguuauuauguuuuggggguuuuuugagguauuuaacaccaaaaaagaauaucuaaugcuguuuuucuacauaaaugaaaaguguuauuagucagaauguccuaauaacacaaaacaacagcagcucuauuuauuuggucagaugucacagaaaugagaggauuaucaugucacccuuagagaugagguggacuauugugucacccuauagaguuccagcugccugauuccuguaguuuguucaccaaugugaaggaaauggacuuugaugaaaggauaguauuugauggccaggaccucuuuugggcauuucuaaguggaauacacacagauacgagaaugggggagguaauacagggaggcuacucuuuccagcucagaaggaguugaugaagcccauauaugcauucaagaagcccaugggauccucuagcuguggguaguggcuaauguggucauccagaaucgacacuguggaccgcggcagcguuuuccuaguggaagagaacagcauggaggugaacuugaggcuggagaugagaggauguaaggcaugggaagccccgcagaugcccuacagacacaccacacuggaaggaaucaacagcauuacucaucuccuacugggaaacuguaccuuaggcagauaaacuugccaacuccacuuacagugguuucaguuguucagaacccaacagacaacaucuggcaaacacaacacuucuaucgcaggccucacaacaugacuuucagcuccuuagagaagcaucaacaaguggcucacccagcaacucacugcccaagcaaagauaaacaaagaaccuuccuuaaucucacgaggagauuguuuaaaauuauacgcaagcuggcuuuugccagguuguauccacuagggcauaggaaggucagaaagauucuuguaugacagacaagcaccuucuaaguaaguuccuaaagguuaacagccagugaagggguguuucuguugauaacugcucagcugagaugagugaacuggcucagauggacacauggaaugauggcagccaugacagugagaagagaauguaugaauccagagaaaguaauacaaaucucuugaucuguccucuugggaagaguuaagauuaccggucccuggauggucuguuuauuuuguuuccagugaggucagaugcuagugccaagaagugucagggugaacuacuccgaggacucaccuguacagcuccaaaaacucuggauacggauuuauaggauccaauggcccauagauaaaaugaacuaggaaaaagaagaggaaggaauuucuaacaacucacauc

SEQ ID NO: 2885 - RNA, 1398 nt, Mus musculus
ggguugugcuugagggaaagauagacagcaagacaguccuacaggcaagcagugaagcuggucuccuggccagaagaggagcuggagucggaaccagagcuuuccaccauggcugggggugguggcucagggcggggagugcgacgacgaccucgguacucgaucaugucgggaugguaaguuggauggcgacgagcaugcuuggucagguggucgcuccgagagaacugcuugggacacagcgggcaggagaagcgcuuuucaccggugugcguccuguaguggcgggcuagcucaucagaacgcguaaacuucuugucgcagucgagccaaucacaggagaaggggcguucccccguguggguacgcuggugugacuugaggugcgacgacuuguaguaggccuuguugcagccauggaaggagcacugaugucgcuuggaugcgggcguaaucugccuccuucgguacgucgggcccguugauggcgcagggcgggccccugggggccccucgggcacuucuccgcugucauccggcuccucugaggccucaggcgcauccaggauagcagaaucacugcaggagcucucggcgucagagagcucauccucgaagaaggccuggguaggcucagagcccccaguagggcuggagcaccaggucggcucgaagcagcuaguugaggcacacggagcuucuucggagucuucccugaagucuucccgggcaccacagcuuaaaucagccaaagcgcucgcagccagcagguggggcgcgccaucgccuucuccggggcucgggguggggaccuggaggacuggggguauccacagcaccccccgugacccgguacccuuccccgccgacucccgagacacugcacccaccucggagacagccgcugcgcucgcgccuucgggguccguugcgcgccggugcagcacggcgcggguggacauagacaccaggcacucggcagcgaaguaguccaggcaagccacggcggccgacaugcuggcggcgcccgguugcgggcgagcgccguccgagcgcggccagccgcgggccggagaguccccgggagcguccgucccgccgcuuggagccagacgagcuggaagccggugcgcgccgcucgccgcccgcagccgcugcugccggagccgagcccgccccgccugacgcgcccugacgcacugaagccugcggggguggcggggacccgccccggcccgaggacaccccuggaucgcgcugccgcgcgggcuauggcauucccagcagccugggaaauuaucuugucugcgcuuucucuccgcugcuggcgagccagguaauuucaaugcgcgcaagucccggaucgcaacuucugggcagccugccggccucgccccc

SEQ ID NO: 2886 - RNA, 1548 nt, Mus musculus
accugugguaauccagguagaaaaacucaacuguggaagguccucccuguagucucacuuauagcucaucucggauuugucacugaccuggaaggagcuuacuuggaagcguggaugugcuuauacucugggauguguggggauaagggaauguaggcaucuacaaacaacuguccagucuucacgucuggaagcgugggucugucggugaagggcccgagagcgugggccgccgagccgugucauuucauaacccuuccacauuguuuuguuuccuuguuucauggguaagagcaucauguguucaguauguaaccaugcaaaguguggcuaaaauucuuguuacccuucagcaugcauuucaaacgaggacuaaaacuaaagugugugugcguaugagguauacuugugaggucaugugacuaguguuuucugugugugcaugguauaugugaauauaugcuugcauguauguggauugguaugcacguguaggucagagggcaguguuuggugugccucuugaucacuccucagacaucgagguagagugucccucuugaaccuaggcacuuugccaguucugcuaguuuagguagucagcuugcucuccauccugucuccaccuccugagugcugagauuauaggcagaccaccaugccugcuccucccaccaugccugcuccucccaccaguuuugagugugcugggaaucuaaacaccaguacucacauguaggugccaugagcuuuacccauugagccguccccucagccccaagugucucacaagcaagagacacuuguuaacauacaacaaguuacuauuagccagaagaguuuaaacuguacuaagggugacugccgggagcacauuacuuccugucagccauugugucaggagccuuugggccuuuuuuuucugucuguggaacgggaaggagcuggucacuagugcugaugaauaaggcgacugacuacagagcuauguguguguuucuugucgucagcaaccagcgggccuccaccucaucccuagagucagcaugucauggucagaagcagcuaguucauggauccagcguuccaggggaacaccacauagugggaugauugacagguugaggaaacacugcagaguggugggcacugcagcugaggaaccugcuacuagaacccagaucaggaucagaugaagucuuaugauagagacuuggggaaagugaaacgugugugugaguuggaggcgggaggagagagagagagagauugauuuagaguugcuuaugugaucagaucuuagaaauucagucccuugcacuaucccuuauucuaugccguguucuaaggauucuuggacuaacuuucacagaauaguuccuuuuuuuauauaauaugguagcgcaugacucuaauuccagcacucgagaggcagaggaaguggcucucugugaguucgaucauaggcagaacuguguggaaagaccuugucucaaaacuaaauauaaauaaauaaaauagcauuaaaagaacauaaccaaaaaaaaa

SEQ ID NO: 2887 - RNA, 5574 nt, Mus musculus
acacacacacacgaauaugaagaugcuagcucagcuuuacaaacaaccuuagcuagagagcaaguacagacaguccuagaaaccuuuggcagguugcagcacuuuuuauccuuuuucacuauaggugcuucuuucucuccaaaaagaagaaaugugcuaaguuucaauuuugauugcaaguugauaggucaggaaaugucugcugacgcuucuaaaguacacacaccuugaagcuauuuuaagaaaagaagucucacugcaaaaauaagauucuuuauugccaccuccuggccugugccauucuccugguucccugaagagccaggggcuggacaugcauaugcagauagcccccgcccacugugaggaggcuguggcuucuuuccuuaggcaccacucugccacccagggccgcagucugauggagaaaggggaguguagaggauccaggccacccaggaggucagcacuggcgaaugggaagcaggcacaggaggccuggugauagggugugcuggugcccaugugcucuggcugggcagagccaguucgcugcucucagguguguggcuuugcagugcuuguggggaggauguugauguggguuaugcaaguucuuguaaauagcaauuagcguucuugccucgguucccagauuccuuauuuaacgggauguuggaaagcccugcaucaaacuaaaaagucguaagaacggcucuuaauagaagugaccacauacuauacaccugcucuggccugaggauggccaucaggagccuguaaacaccgauggacuggaugucagacuaucagaaaagaaagaauacaaaugguaaaauaaaguuucccuugugaugcugggcuaaaggcuucucuagaucggaagugugaagacagcgaaguucugcaggucuguucuguggguagagaucccgugugugcuguaauuacagacuccucacaaacgugagggggugcuauaggugcauuuguauaggcuucccacgaacuacaaaugauuguuucauuguuggcacuaugaaaugauguauucuuaauuaaaagcgaguuacugggacuacuucuaaaggaucagcuauagcaguagguuaugaaaacacugacaguaguaagccuuucccaggaacucaugucuuaauguguagaauuaaggauauucagacuagcuuccagucccuaaauguguucuguagugcaccuuuaguuaggugguaacuucagcgucaucucucuucaccuccuccuugguucauuuggaaccucucguccagggauugcauggaugcuggaaucucaguggucaucucugagacuggcucaugauuuccccuuccacacccugggcugggugcgugcaucugagaggagcaucacacaaagguggaagcagccugggugugcugcgugugccgcgcugagaagagacugcccacucuguggaguuagucagggcguacccacuucagcagagguuggggugcagcccaguguuccagccugaaaggacggucuggaacuggaaaagcauucuaagcgccuaugacguacagaguugugaaauugcccuugggggagggcucuacagccuggccuguuugcccugccugauacgggagaggaaggagugagcaaggcuguuuucaguaaggaagccccuuaccuggaaaauaaucgguuucucuugaguccaggucccucuuaucucugcuuggcuuuaagcuauaagagccaugcagacugaaucugucccugccgugugccuucaaaguaacacuuucccuuuguuuuaaauuaucuauuacguuucagccaccugaggauuuuuauagugggccuuuucucucaggacccuuaccuuuaaaagaaauauuuuugaaaaaaaaauuucagacuauuuucugauuguauuuaucuuucuccaauuccuccuagauccucccaccccuaucauauauacauauacacauauauauuuacacacacuuauacauaugcauaaacauacauacaucagagaaacaaaagcagcagcagcaaagaaacaaacaaaaaacccagaaaccaaacauauaagcacgguugugcaagccuuuuaaccccagcacuuaggagucagugguaggaggaucucuugagccagguuugugaguuugaggcuggccuuguuuacauaguauguuacaaaucagacuagauaaaagacccugucucaaaacaaaauccgaaaaaaaauauacaagcaaaaggccaauaagacccuuggucccccaagaaauaaggaaagaaaaaaaaagcucaaagcaauuuaaaacaaaaugucuacaaaaauaucauugaguucauuuucuuuuggccaucuacugcugggcauggggucugccuugaagugagguuccuuugggaaaaaugaauguucccuuggacaggauagcuucuugguuagauucccccucugggaccccaucugguuugaauaggcccuguucgugcugcuauagucucuguggaccuaaauaagugauuuuuuaaaauguuaccuauguuacucuuuuaaagaaaaucuuugggggggcuggagagauggcucagcgguuaagagcacugacugcucuucugaagguccugaguucaaaucccagcaaccacaugguggcucucaacuaucuguaaugggaucugaugcccucuucuggagugucugaagacagacacaguguacucacguauucacauauaauaaauaaauaaaucuuuaaaaaaaaaaaaagaaaaagaaaaacuuuggguguguguguuuacgagugcacccuaagacaacuuccaggaguugguccuucccuucugucaugcggagcccagagauugaagucaggugcucuggagucagacuugcagccagcaccuggaccugcugagguaucuuguuauccucagcacgcuguuauccuuagaagcaaaccgagaaacagaugcuguagguuguggaaggugagcaggguaggaguaaaggugaaauguagaacauccuagcucaucgucugcagcaucaggaccucauggaccagagcucgcucucacaaggccccagcugacgcccuuaggcuguguuguggaaagggaugggcagggauuccauaccugaugcguggcagccgccaaggccgagggacugaggcagagcugcucccagagccauacuuagcuuuuaaacaaucccuuccugucuguuguccuuccugccaccucucccaguugcucagggccucccuugugaugguuuguuucugggcuggccucacugcuacagccaagacgucaagcuggacugugaggacaccucuuucugacauucauucugccgugggucaguaggucuucauguaaagagccgugucuuaaacacucguggacugccguggccacauauagaagggccuuucuccacagccagggacaaagagcaaaugaaagaaggaagcacacgggggcggccaguguaggaguauaugugcucucagauucucuuucuuuaaaauaagaacaguuuguuguugaucuucuccacugucggggauaaucauggauuacuucuauacuggaucaaaacccagcuuuuuguuguaaauacaguaguuuaaacaaaaacacgucagugaauuguguuacuuagcuaacugcauaucuauauaucugccacuaaaauaaaacaccccagauuaagaacuuauaaguaaacagaauggguuuauguuggcuuacaguuuggauguuuuaguuaugacaguugacucacugcauuaggucugugggggugggggggaaauguggguggaacaugagagagcccugggacauaaggccaccucccaggaguguucugcuggagacaaagugguguauaagccgcagcgucacaccacuaugauugguucuuaggacccucuuagggcaucccauccauguccuaagaaggguccaucuuuuggauacccauuccccucuguuuagagccuaggcgacuguaaaggccaaccuuacaaucucugcagugucccagaaacccuguaacuggucucugcucuccacccucccaugccuccacugugauguccacacaacagccaggucucagcgucuuugcagaggaccucuuuuuaaugccaaaaugugagguucuugccauggcuggaaauaucucucccaagauguaugcaugacuuacuuuaaugccuuuucaggggucauauggcgauuucucgguuaggugugcccuacccacuguguuuagaugcucauucugcccccgauucacccucuucucuucucugaaugauacgaucauccagugugugauguuucccucagcgcucuuugucucuuccuagauagaacauggccuccucucaaagcagauuguaccuacugugugccuguaaaacuguuccuggccuauuuacaugcacacuguugaaagaaggcaguugucccucuaacccaugucuagauaaggauugagaaccaggugugcuguguauacgucucucugccgcuuuguucuuaauccccucacacaaaaggacagacugugaaagugaggggaacaucuuuuaaaaauuaaccacaguggugagccauguaaaacaccaggcguccaguuaagaaguggcaauuaggugugcggcguaggagcggcgcuugaggccuggaagcguuccgcggccugccgggucagcaccaugagcuccaucggcacuggguacagcuauugggaucagauguaaagaugguguuguguuugggguagaaaaacuaguccuuucuaaacuuuaugaagaaggcuccaauaaacgucuuuuuaauguugaucgacauguuggaauggcaguugcagguuugcuggcagaugcucguucauuagcagacauagcgagagaagaagcauccaacuuuagguccaacuucggcuauaacauuccucuaaaacaucuugcagacagaguggccauguauguacacgccuauacacucuacagcgcuguuagaccuuuuggcugcaguuucauguuggggucuuacagugcgaaugauggugcacagcucuauaugaucgacccaucagguguuucauaugguuacuggggcugugcgauuggcaaagccaggcaggcugcaaagacagagauagaaaagcuucagaugaaggaaaugacuugccgugauguaguuaaagaaguugcaaaaauaauuuacauaguacacgaugaaguuaaggauaaagcuuuugaacuggagcucagcuggguuggugaauuaacuaaaggaagacaugaaauuguucccaaagacauaagagaggaagcagagaaauaugccaaggaaucuuugaaggaagaagaugaaucagaugaugacaauauguaauauuuucuuccccauccgcugguuuacauuucuguaacaguugcauauggcuagcaccauggacuauauauacccacugaccgauuuucauuaaauuuugucuuauaaacauugaaaaaaaaaaaaaagaag

SEQ ID NO: 2888 - RNA, 52928 nt, Mus musculus
aagcauuaggggagcccacggcuacaaaacaagugagaagaggugggagaaagagaaacuacgccaccuccucugcagccgagcgcacgcagcagccuggcgugacaagugggcgacgccagggacagagaguggggguccuccgcccgcuccggggacccugucgcccaccguggugcgcugagcaacuuuuagccggcagccccgcaccugucucagaguccccaucgcuccccaccaaccaucaugggaaaauucuagaagaauacgcucucggaaucuacgugcgcaucauuuuccuccucacuccagaggaaggaaccagaaaagagagcaaagcgguguaguguucagccucaagguaaguucuuuaggguggggaaaacggguccagcaggacuuggggacaggauuuggugcucaacucccaccuuggggguggaaaaagcguccccgcacucucggugaggcagauggguuggcgcgucaucugugcuauuuucccgguggacucucuugacguccacccucgcaguccccggggcccccuuacggucccccacaaggggccugaggcagcgggccaggaugcucggcgggugagcgaaggaagguaggguugcugcgugaaacgggcaugucggagcuauuucgccauguuuguguugcuaagagcacuuuuuuuuccccuuugcgguggcuugaugccacauggcuccuccggagcugcugccggguugagagcgagugguuuuuuuuuuuuuuuucaauguccgcauuccagcuaauguugcgcagauaaaauucaaacuugagguaaacagacgaagaggaggaggaggaggggagggaccggcggggggggguuggggggggggagggaggacuguuuccauuucgagaucccaccucuucacucagaggagaccaacaucccgaaccuagaggcaacucaugcauggcucccacgcccccccaccucggccgucaacaagaaguaagggcugggggcgagcgguugggagggacgcgacguuuugguucuagggggaagguggggggagaggcagccccugggaagccggagcuuugacuucggcuauuauuuuggcggagggaagcaggaugcguccucuugcucuggagaugggggguuguauguccccccucucuaucacuaccuaaucguguugccucacucccccccaccacagguugcccccacaggcgggauggguggggcuuugagguuccagaaggcagguuaccuagcagguguguagggugggcauuuggauuugguaagucgcuuggauuugguaggagaccaugggggaggcaaagcgagugcguagguagagcuaagucuaacgcuuauguaugggggggguugcuuuuaaaaccaagagaaaaaucaagacaggucccccccccccaauaugucuguuucagcucgcagcgaagcugcugcgugagugucgaggacgagggcgagcuucgucauguggcacacacuguaggcuucugacagcuuggagcuaucuacccccucccgcgcgcgcccggggcggaagguguggguugggugguccgaggcgggugacguccgaggcgggguggggacaagacuccggagcgccuggguccgcagccacggcuugcucggcacggcgugucagggaggaggcggccacgugagggguccgcggcagcucgcgagcugaaggcugggggcgaagugcguagcaagagucgugacgggggugacacgcagccgccguggcccuuugcucacugcccacgcagagccgcgccgcgggugggugcgcacucacgcgcccgcucccgggagaccguuuccggcucagggcucgagcccgggcgguaaacaggguggugcccucugcccucccgcccccggccgggcggaggcgcgcgaucguggcggacgagcugcgguggcgagagcgcgcgcgagcgggcgagcgcgcguccccgcccgucccgccuccucuguuuuuguuuugauggagcccgcgugcagcuggcgcgugucgagucacgugccgcggccgcgagguggcugggcgccggcgaccgggacacgggggagggucgcagacccugaacaguucgaaaacuaccgcgagguacagucuuguggggcuggucgcaguuguuccccuggagcaguauuuggguucgucgucacagcaucccugccagucggcugucccccccaccccauccccuccgggccggagacucaacagagggaucgagcagaccguccucccagguguguuauguuauaucaguggacacagaaguaccuacaucuagcucuucauccaggcugcacgguguaaucaaccccagagcuuuagaauuaaucccgauacccacucucauagcuagggaacugaaauccaaauagagucuggacugagggccauuuucuucaccuccuucuucuccaguaauugugacgcaguaagaauaaaaacugauagguagccagcuugguaggcuagauguugagucaucuguauuuacgcaucgaagaaugaaaaauagccccaauaguuaacaugucggucucucacuaaauggggccucuaugugccagacaggaugacugcgcaaacauggcgacaaccuggaggaguaacaguuuuuacuuuugggggaauggaaguacaggagguucuggcagagguggagcuugaggacucccugacgggagcucaugggagcaggccccagaguucauauuugaaaccauuacuccggguugcuugagagaccuuucaccuuugcgaacaguuuaggaauagugcauacuagcccgagggcccgaauuucuguacauggauuucuguuguuacagcuuuaucuggaaagguucccuuguuugaaaggagaaccaccuuuugguaaauucacuagugccuucaggcuacugauucuaguauuuacugugggggggggggauuuuagcaauuugaaguuaacagguggauccccucauacauaguaucuucaugcucguugucauuuaacauacguguaaacugaagaagaguccagagggugcgucuguguuccaucuaugcucaauaaguaaggacgacaugaugggccauaguuuggauguggacaaagugcccccauuggguacagugucugagaaguucugucgugaaaauuuuggaggaagcacacacacuggauuauagaagcuuugccuuuuuuuuuuuuuuuaaacaaacgucccuuauuccuccuugguuuuguuucucaugugaucuugaugggaaccuuaagauguggggguuccgguacuuguuuggaaaaugugguuguugauaccuucgggugauaccaaauaacacauuaaacucaaguuucucuccagaguucuaauucuaacaaucuugugacuauuugcauuaucauuguugucuucuguggccuaaagagcucugaauaugcauacuaaugacugccaccaaauagcauucgcugcacagugggcacagguaaguauauuugagaccaggguuuaaagguuaguguucacauuccuugcaguuuggugagccgacgaucuugaagacccacccaggccagcacaucauaaaugugaacguugcuggucuggaauaauuaauuguccagccacaugcugugcucuucccgucgauccuggugcccucaccacaagugacaccuuuuucuuaagcauugucaggcuguuuagguacuggugggcucaacuuuccuaaugcugcgacaccuuaauauaguuccucaugcugugaccccuaaccauaaaauuauuuucauuucuauggcauaacuguaauuuugcuguuaugaaaugcaauaugugucuauguuuaucaaugguuuuagccuaccccugugaaagggugauccccaaaaggguugagguccccagguuaagaaccgagggcuugggggguucucgaauagcucuguuaagauggccuuucugcuucuugguuaccuccucuucuugaagaacuuguucuuaaaaaccuuauuuauauaugugguguuuggucugcauaugcacaucugcacaccagaagagagcaucagaucccauggggcuguaguuaaagacaguuguuagcuaccauguaggugcugggaauugaacucagggccucgggaagaguugcuggugcucuuaacugcugagccaucucuccagccccaccuuuuuaaaaaauguccuguagccuuucgcacauccuuggcucauuuugucagacacagaucaucauacuguauuugucacaaaaaaccaaaccaaaccaaaacaacugcucuucaacguuaggaaugauuuaaaaaaguaaaaaguauaucagugguacacaccagcacuaaguucuuuccauuggucaccauugaauucucuuugccucccucacccacauucauucggaagcacccuucccacaucugguccgagugguaaggugaagagcacacacccuuuggugagagauacagauuauggccccacuaaugcuuguuugcgaaacaauaacaaccaauguuuuucauuuguuuuccaguucuuuuuuuuuuuuuuuuuuuuuuuggcugaguggauacugcguuuucuuacugauaacacacugggcaaguagcucccucccguugccacuucccccuuauuuggaaagaaaugaugggcauuaccagcggcugugcuuuuuuuuuuaaagcacaaaugcuuggucagauaucauuacacuguaauuuucagaugggguauacagagcuacgugagagccccucagcccugugaggcuuucugagaugaagaugagauuuuuuuuuuaaucuuuugauuugcaguauguuacgagauuggggaccucaagccucuucauguuaaaagguggcuugugugacgcagaaacugaaguuggaguugcugcaaauguggguagauagccacuaguggcuccuuaagggacagcauggagggcuugcuucucuuagagucuaaacauggaacaagcagacauuggagcgaaggcaguguaccuuuaaaagagaagucuuguugauucuagggcauuggcacgagugcuucucauuucuagauccuagguacuugcuggugacacuuuuuuuuuucugaccugaaugaggccuucagcuagagaacaucuguguuauuacauaagcuggucuuauacuguauguggucucauggucucccuuucaggagcagagugaagaaguugaggauagcuauaaugaugaguaauuauuuacaaauggaggggaguaauuggagcauaaaccaaacgacugccucacaagcugaauaaggugguguuuuguuuuguguuuuagugugcuguaaggagacaggcaggauguaucuugcugacggauacgucuccggugcuuagcacagugcuucgcaucagaagcgcucagauauuuauugaguaagcccaucacaucauuucaggcccagagugcagguugaagagcagaagaaaagacagaggacacaguucucacgucauucuugacgccacgguuguuccaaggcauucuggucaagcgugaccuugauuucuuucccguagcccuuacccuuguuugaugacagaguaaaagugaagucaugagaugggguguacagguuaggaggagacuguaugcacacggagaaaagcgaggauuuauucugauuguguggugaagaaaguaaaauuccaugcauugaagagcuuugguuauuuggcucaugaaaaaaaauauauaaauaaguauauguuaauaauucugaaaagaagagugaaaauaccauccuggcaugacauugagaaaacaauuucagcauaagagugggaaugaacccuucauuuuauaaucucuaagccucagucuugugcuagaaccuuggaaacuucuccaaguggauauuuaagguagaagcagaagcaaguguuuuuuuacguaaguaacuacuaggggauauuuuuauuaagaaggccuaggauaugccaaacacauuuaaaacgagcucgaagguggaaaaucccgacauccuuacaugugagccagucugcuggggcugcaugacagugcagcugccgugcacgcgguagugucugcagaagaugguacagaaguccacucuccaucuuguguagcagaugggcccacuugaugcugugaugugugccugagguuucagccugcauuuuuuuuuucccauggcuucuagaauuccugaugucagggccugucauucacuaugccccacagugaaaacuaauuuuacuauaaaauaagugcaacacaaggaaauacaaaccugucccucgaaacaaaaucaaaaggcaugauuauuccuaugugaaaugugaacugaggcgggggcaggcaaccuuuuucuuaaggaauuucugccuauuuuuguggccuauuuuaaaauaauucuggagugaaucucucuacagggucugacugugagccccguggaucucacuguguaaaccagacuggucugccuuugccucuggaguguugggaucgagggugugcaucaccacgccuggcggaaucuguuugagggguacaaauaauaacacauaaauaagugugagcuccucaaacugucaaccaaguguuccagcaauuccugcuguugccuuagaaacaaaaccaaacacuacugagagcaacagaauugaaccuagcuaaacaaaugaaaggaagccuuugauacuugauguguucagaggucagucauguguaggcugcuuuuuuagguuuucaauauaaauuacucagcauaaauaacuuuauauuugccugugucuacauaucuagugaugcuguuagauugguaacagaaucaagaugcauuuugccuaugagagcucauagaacuaaauggauucaggugcagcguuaaagaaccuuggcuuucagagaacuguugacaguaaaugaccaagguucaucgaagaauuuaaggaggcuggguguguuuccaaugaccauucuggcuggcaggaggcucacaaguucaaggcuaaccuacaucaugagacagucucaaaaacaaaauugaauaugaggaaauguuuggcuucgguucuuuguggaguugguuacauuggacccgugguucccaaaccacagagggcuuguuagaacacacaugauuggcugcccagaccaucugacuaggaaggccuuggauuggguaggcucacuaauacacuaauauauacuugauucccaggauugcugguccugaugcuuagaggaccacacauggaauuagguaguuuuuuuuucuucuccuugaagauuuuacacacacacacacacacacacacacacacacccucacacccugauuauaucacaaccauuacuugaauucuccaucaugacauuuuaaaauugccauaugguaguaauuauuacucuuugacaaauuuccacguuuucagaaaaccuugggucuauucaaacucagauuagauauuccugaguagcccgagaauucuuaguaaagauacauuaaaauagccaggucugguggcccaugucuuuaaaucccagcacuuuggaggcacaggcaggugaguuugagacuagccuggucuacauaguagcaaauuccaggacagccggggcuacuuagaucauguuuuaaaaaauauuucugauuuuaaaugucaguauuguaagcagcugauuaaacuuccauguauuaaauacuaaccagucaccuuuuuuucuuuuuucuuuuuuuaacauguguggguauuuuuccugcauguuugucaguauacacaguuccugaggaagccagaagagggugucagaagccagagugugccuugcaacuggaguuacagaugauugugagccaccacgugggugcuggaaaucggaccuccauccuuuggaggaaugggcagugcucuuaaccacggagucaacuccuguccagcaaauugccuuuuaagaucgaguggcagugcagugcuggggcucacugaaaaacagugggucuagcacacagaguguauuucuaguugagguuauauagcuuugggucuguauaagacagugauagcaaugacacagaaguccuccgagaacaggggacgcagggaagagcaugugcucaggaacgagaugugguaugugcaggaugcauaggaagccggagcgcagucaugaacaggcugugggcacagcagcaguucuguggcuccuagcagcccgugggcagaagcgaggggucagucagggauaacggucuuaaagcagacaucacaguguacuugggacucuaugcuggugcucucauauggcuucuaagaggacaggagcucuggagaccuuccaaaugaugaccaggugagucagggucugacauaagcugagguaagcagggagaguucaguggaaggaagugguuuccauuggaagucgguacagccucaucggagagagaaaccaaaugggaucuacagggaggaaggaccgguggcagugaugggauccuucaagauuuuuaaacacuuuacuuaaagacuuauuaaccggacuaauuauagcagcacaggcuucucugugaggaaauaauggcugugagcuuucguuuucugugacugucaccacguccuguuauuuagcucaugucagacuuuuuucauaguucugcuuugucagagucagugcuuauacuuuuagauggcuuugauaaucacuaacacguuuaaaucagauuucuggaaguuaggcauguugcuucuuccggaguguguuugaugaauucgugugggccauagcggucugcagccuccagacuggcuccacucugcacgagauuuagguuuaucuugaaauaguauauuuuguaacugcucuuaggaaauacugaaacuuagacucuuaagagcugauuucacacacacgugacugauuuuaggcuuucauagauagagcuguaggcaugaauuuguuuaucauguugaaaagacgugcuacugagaucuacagucgcuuuuucuuguguuugacacugggcacggagaugcaguucuuuauaugaaucuuuagauuuuauuuugauuugagccaggaucccacacuuuagccagggagucucuggaacucacuuauguagcccaagccacccuuaaguccuacagcaguccuccuucugucuuaggcuccuaaguguaagaauuaugagcacaaacaacagcuugcuauacacagcuaacucagagucaauuaaguuugugacagaaguuuaauuucugggauaagcggacgugagaaugcugggaccuggaauguccguugccaugccuguuguaggguucuucuccuggcccuuccuugagcgucccuuuccccccuuccucuagagcacugguuuuucaauuugugggucugcccaccuuggggauuguuaaacagcccucucccaggggucaccuaagaccaacggacaacacagauacauucauagcagcaggacuggcgagauggcucagcaguuacgagcacugacuguuuuuccgaagguccugaguucaaaucccagcaaccacaugguggaucacaaccaucugugaugggaucugacgcccucuuccggagugucugaaaacagcaacaguguacuuacauauaauaaaauaaauaaaucuuuaaaaaaaagaaacagcagcaaaauugaacuuuuuaaagaaguaacaauaaauaauuuuaugguuggugggcucaccacaacaugaggucacuaaagggucacaacauugaaaagcuaaaacagucuuuguuuuaucuugucuuuaauaaagaccuuuucuauaugggagcaucugacucaauuucuuucaguuccuuuuacuccaaccugugagaauugugucgaagccucucucauugggcgggguuggccaaugcuucuguguggaucuacaugagaccgucuccacacuuccuuuuuccggcugaucuuacuuggaacauugagguguaacacugaauguuuuguuuuguuuucgagacaggguuucucuguguagcccuggcuguccuggaacucacuuuguagaccaggcuggccucaaacucagaaauccgccugccucugccucccaagugcugggauuaaaggccugcgccaccaugccggcucugaguguucuuuuaacagugauguauaguugcuuggcacucacaguugcuccugguagcuuccgggcccugggaaaagcuggcuccucuucucuguuccuuugugagaauuuggguguacaaaggguuucccugcccucaggugcuaaauagaacuuaucccuacagugguaggguuacagacccucacagggguguugcuuaucacaggccugacagagggcagggucuugauugcaggugagagacuccagaaucccuuacacgaguuuaguuacugcugugguucgaacacucaaucguguuguguuggucacaguguuauucguguucugaauuuagcccuuugaauuuuguaguuuucccacuaauucauacaggcuuugugacaaaagaauuguuauggcucuauaaucuuucccacuucuugcuugaaaaugcaucuuuuuggcccucucccucccccuggaguuugggugggucccaaguccugucaguugaaguugaauccuaaagccaggaaaggucaccuaucaggauuuggaagauuucugcuacguugugguucccaggaggauguggcuucuaaagacagccuuuccuguguauuugaaccacugagggaguuucugguuuagcguuucuguuaacgccuuuugcacucacguaauaaaaccuaucccagaucucucuucuucauaacuuguacauuggccugugaccuugggugcuuguguccuguuuucagggaauccuugccagugaggaaucucuuucuucacaacuccagcaggcugcuuuaucuguccauggucaaggccacuggcagucguuucugcuuuccgguuguguuugguggcacacacaguacguaccguccgugcuuuuaaaagccuggggugauucccggugagcuuaguuauggccgugguucgaaggccuaauuaaucaccuuguuuuagaguugguuauguuucuuuggcuuugccuuuucuuuucuuuuuuucuuuuucuuuuucuuuuuuuuuuuuuuuugcuucagaauuuuaugguguguauaaacucuugucagagagcaguaucaugauggcuccauauuuuuaaaaagcacuuauugcaugacaaugcuuauguuuugauaggaaaaagugaaacauuuuuaaaggucauagcucauuuugggguuucaucuuccaaauuuauaccuucugccuuggcuuuguggggcuuugugggaaaguaugcccaacucccuccucauucccacuuguagggaguuccaaguugagauucuuccugcugccaauuuaauucuggaagaggacacaagggcucugcucauagccacccaucuuugugaccaucuaaugagcugugugcaacaaggacuuuuuuggcuuaaugaaccaauguccuaguuacucauuucguauuaucugcauaauauuuucaagaccggaauuuuuuaaaauacaagaucagggcugggggauacugcugggugggcgagcuuuuguguaaguaugugugggcuuuggguucacuccagcacuagaaaacccaaaaagaugauuugggauucuaaucagcaaacuugguuuccauuugucuuuaaugaucuuccugaaaacaguuguggaauauuuguugucccucuguuggggacaugguggugacaugaggcacagccucuguccaaggggucccagaucuuuaacccagaaagcugccuugcauucuugaggaaagccaccgcagcauccuaagagccgacuagaaaugccugugcauucgcuguguuuuguuaguguuggagguaccacuugauggcaagaacagaccugcaauugugaaaguuuacguaacacuugcuaacacacugcggcacccuucugaagcuguaagcucaggcaggcuuccucaccaggagccuguggguucguggacacugcagguaauccuccucagagggcugaggugguggaugugagcuacugcccaucaguaggguccuccuacucuucaguauggaagucuaacuaaaagguacaaguuaauccgaucucucugguuacacuuucuguucaaaaagcaaacaaugcuucgaaugugucuggaaugugccuuggaagguuugugggaugcugguacgcugcggcucuggcacacccaacuuuggccuccccuccccucauucuuucuaauuuuccaauuuuuuuuuuuuuuuuuuuuuuuugguguggguucucuucuguuuaucugccuuuccuguuugcucuucaaaggcuguggacauaacagcucaguuaguagaggguuugcuuuacauucaugaggcccuggauucaauucccacaaaacaaauugcccaggaacauuugggacguucacccacaucagccccugacccuaccccacuaaugaccaucuaaagcuguaggcagcuuugacucuaauguuagaauuguuuuagucuauaaacaugcgugugccgauggguaguaaugaacaugaaacauuucugaauauuuuaauuuguugauaacagguuaauuucugauuggauggaaaguacacaugaaguguguccuuuguuguucaggagacguucaagugggauucagacgcacgccugaagacuuucugcuaggauuuauuguccuuuuaaguaacaaauuucaggauuguuuuuuaacaaauuuguugaacaaaaauguuguuuggguucaagcaauguuuuuaaauugcuuaaauuauguuugguauaaagaacucggcagccaaauuauguaaaccaccacugucggaugagcaugcagucuagcuguaauaaccuccagaguuaacagaaugcaguccuauuaguccuacgccgaagaguuagucuaaaauggcguagcuggcuaguggcauaacugacagcaggcaagugauaguacuuuuucugccaaaagcucaggugacuuggaaggagaguaggccaagcaauaaaguuuuugacuuagauaacaccuaguuaccuuagauaucacuuaguuaacuuuggauaccgccuaguuaccuuagauacuaccuaguuaccagguggguauuggucuuuggaagggaauuagugaggaagguccaauccaggucuggaaugcaauucauuguacuuuguucuuugcuacaguuucuguugaaugugucgucccucaggcucccaggccaaugcuuggccgcaucucagcugacugaaguuugaauacucauucacauuucacaucuggaggaaggagcccuccaguaauacccaaggcgggucuuuaaggggugcucuuuucaauuuucauucuuuaacaguuugagagaccaguguuacauaaauuuaugagaauuuuguuguuuccaacucagaguugcuuuguuugggguuggagaauagguuuugugguucccaguaggcaguugggcagagggaagccuagcaaucuggaacaaucuggaaggggugaggaaagaggagcuuucauaaaagcaucagagaaaagcugagggcauuggagcugguacugagcagcccaugaacguggguguccaggccuuucgccauucuuagcaaguuguuggucuuacuagcuuggcaguguguagccuuucgccauucuuagcaaguuguuggucuuacuagcuuggcaguguguaggacacuauucuuuugcccuaaggaagugagagagagagguauggaggcaaauggagagaagaagcccuuuuaacuuuuacuuucugaagggugugauacccacccaggcugcugguacgugcagcaccacacacuggcugaguggcucacgggcagcacaaauuuaugucucauaguuuggaaguccaagaucaagacacugucagauucuuguuugaugaagaccagcuuucuggcucauaguaauaccuucuugccauugucucaauguggcagagaggaagccagcgcuguguggcuuguuguuuguugagauaggucuugcucaggccauccuccaauucccugccaucuuucugccaugucugucuuuguguguuuuaaaaaggucacuaauuucauccaugagcgagugcuccuccaccuuccucaccucagcuaagauuauuucuaaaguucuugccucccaauacugucuaagaaguaggauuucaguaaaugaauugauguggguggguggcaaagaauucagucuguagggauaauucuccuugugccccuucauuugauaguuuaguuauaagaagggauuuuuaggagcugcuguggggagagggagaugcgaugggggcugguacuuaggaagccagggagucucacgggaaagcacaaagggagaagauacaagaacuuguuugcuucuuugagaacagcauaguccucugagaaugagaggggaucuuggaguuuauugcaggagaaaagucuagaagacagcaaauagaacucaguuuaccuugaauauauauuuauaucacuuuuaaucagaaaggaaauaaaaucuaugaggaauucucaccacaguuuuaacaaagagagaagaugguuugggaucuagaguugaaucuaaccacaaaaaauaaagggcagauaguaacuuuaaaaaacuauggaaaaaugaauauguaaaaguaaauauucacuuaguaauaauaucuacacuuagauuuuuuguuuuuguuuuaaaacagaaucuuuuaaauagccccgguuaggaucucaauccuccugccucagaugccugauuguugugauuacagucaugugcccuacgacauuguguuuucaauuuuguuuuugcuuuuucuuuaaaacauuugcuugaguuuuccuaaauuuuauaugaacauuuaaaaaaacuuuauuaaguaaauucuaaauaucuaugcuaucaaucauuuccaugugauagcaaugugauuaucuugaaugauuuuaauuuuuuuaaguugcacaucaaccaagcaguagagauaguuggcagaggacugucuauaugccauguacauuauaugauguuacaagucuguaggcauugaagguacuuuggaaaaugugcagagaauaugugcaaaugcuagaccacaugauuaguaguagacuuaagcaucugcagguuuuguuauggguugagucuuggauccaaucccacguggacaccaagggcaaucauaauuacaggauugaacaccugauguucauucuucaaaauaacuuuacuaacacuguuuuaaauuuaauguacuagugcuuugcugcauauacaucuggaguccagaagagggcaucagauccccuuauagaugguugugagccaccaugugguugcugggaauugaauucaggaccucuggaagaguagccaugcuuuuaacugcugagccaucucuccagcucucccuuuauuaacacuuugagacauguuacauaaaagaggaacuaacaucagaauuaaccuagguagauuuuuuucuaagcaaaguuaaugauuaauucuuaagugccucuacucuugaaggccaguguuacuguuuacuccuagugcccaaacacacugcuuacaaagacaggagaugaggaacucuguaguggucuguuguagaccccuccucuagccaugauggaguauugagugccuggaucauuuggggucuuauguaagcagccacagcuucaucgaguccaugagugcaguguccaugucagaucaaguagacauuuuuugcuucacaucuccccauucucuggcucccacuaaaagacaaaaauauacaauuaaguugggaaauccagcagauauggcuauccaccagguuuuuuuuuuuuaaaauaauuucaugcagugaauuuugauuacauccauccucagcucuucagauccauucucacuucccuacaccccuuaucaugucauguccuuuuucuggguuaauucaguaacccuuugacauucugucugugggaccaucuggauugcaguugacuugugaagagcagcuccuuuuaaggaaacugauuaucccuuccucagaaaccuucaacuguccauuacuucucaaagcugccaaucuauuagcagauaagucccagggcaguuuuauaccaugcccauuuagcaaaguagucauaguagguucauccccagggucuguaagcucuccaaacuuggccucguggcuagauuuauaguuaccagguauguaucaccuucuguggaguggacuuucaaugcagucagaaagcaguuggucaccucccuaacguuugugacaccauaguauccauaggcaugacuucaagugucaguuguuacugcagcuggguaagacuguugguggcuucacccuggcagucugcauagcacccaguuacugucuuaauuaguauuagagguagcaugcuuccuggucaguacccacuugguuucuccauauccugugaccaguguaugugggaccuucagcaguggucuucagcagugaggccuuaccaugcaguuuuguuaggcaaucgagaagaacagugauaauagucuguacuguuuuggggauuuccagaauaucucccaccacaaauuugagggcaggugucccacaccucaucguugggcuuuuuguuuggcauccugugucucugagguaaacaugauccccagaguaaaguaacucuaguuaaacucauuguuuucaaauguuuuugaaaacauccuuugggcuagacaccucuccugcagcuucauccucugccuuaccugccuaucccugugugcuugcugccguugccauguuugaagaauacuagccaaucacuauggagaaggugcuuccauuugguuuguuugauguuugcuccuaugauagucaggguuugugcuuuuguggaugugucacccuucagacauuauauccucacuguaucacacuggaggcauaaugccaccccugagaagguugacaccguuguuaaggccggcuuuucucucugugucugucuugucugucgguuuuuccuccauuuuucaaauaaaaacaagcucaugggauaaccuuucuuagauuuuuauuacuuauuuauaaguaguauuuacaauuuuuugguuuugguuuugacuauacuuaaguuuuuuguuuuuguuuuguuuugauggaugggcuuuuuuugguuugcuuuugaaacugggucucagucuagcccuggcuaggcuggaacucgauguggagcucagacugcccucggcuucuggcaauccuccugcuucagccuuccaaguacugggaugacagcugugagucaccacacuaccuucucaaguuuugaaaaauaucuguagucaaacugaugagucuuucuuauuucugacugaguccuaguucgccugcuccacagcagugugagagaacaagccaguccuccuccaggacuuguacagcuuauucuugugaguggucugagguacagaucuaaguucaugacucucgaaauggcucuccagucacuuuagcaucguuuauugucaagugcuuuuucacguguuuccuuuaguuugcacaaagcugcaugucuccuugagccugcucuuuacuuuguuguguggauuccuuggucuuucuaucugaucuguccauuauguaggcuuuauguuagaauauaucaccuagaagaacauaccaucguccccucuaguaccugagaguuucccuggcuauucuauucauucauuuuucaauaugaaauccucuuaucaaucauccacuuaaaaacuuaguauauuuuggaacuuacauuaauuuuaugaauuuaauuacagugagcuggcauuuuagugacauuagcuuguucuauaucagaaaauacaagagcucuuauuugguugaguuuucauuuguuccuccuuugagauguuuguaaagucuuccucugauggguuuuacacauuucuuauuaugaaacuugcauuuuuuccacuuaauauucuguugagcaggucaguacauguugaccuauuuuaucuuguaaaauggauccagaguagucugccguguccuaauuuaauuuaacuuugccucuguugauguaugcuuguuacuuuuaauuuuuuccucuucuaagcagcuagaauuagaauuccuuauucauaaaccaucuggauuuuggagguaauaaaugcugccaaguuauccucucaaaccauuugauagucaugcaaacuuuauugcauauguacauuauuaccagaucuccaaacuuuuuaaaaaaagguuuacuuauuuauuuucuaugaauacacuguagcugucuucagacaaauccagaagguggcauggauccuauuacaaaugguugcgagucaccaugugguugcugggaauugaauucgggaccccuggaagagcagucagugcucuuuaccacugagccaucucucgagcccucuccaaaaauuuuaaaggaaaaaaaaaaacaugaaagaugcuccugcucuaaaaguuuuuuguguucaugaacauggauuauauaagguagaaguggcuggggaugcagcuuagucauucagugccugucuagugugcggguucaguuaccagaguacuacaaauaacaaaguggcagaagucacaguguuugccuugaguagcuacaacacagucuuggaaaccauauuuacauacauuagaaaguaaguaaaguuuccaugaauguagaccuugaauugagcccagaagagugagucacugggucuagggacuucaauccuaguauucaagggacaggagcagguggaucucagugaauuugggaccagcauggacugaacagcaaguucuaggucagccaaggacugcguagugagaccuuguuuuaauauccuccuccccaaaagaaagugcugaaagugguguggugcaccacugguuuggugugcuaauggcacggguugagcuuacuuugccagcgacaguaauggccuagacuaaaaugggaucuguaugcaaagauaaggaaaggacagcaggugauggaugacugaggugaggcccaaagaaacacuugagguuugaucuccugcuggcaagcuacaacucacccucaaauccagagauuggagucaacaguaaaaacugggugugucuaccugugucugggguugggguucaggacuggggucucgucuuauauugaagucauaauauuagguuccaguccucuuccaaagugguguacuuccuggugcuggugacuccuggagaccucaguucucccugugagucucuccacagaguagaguguccauaagaccuggccacuucacccccagaucaaguaauccaggggaccaagacaggugccucagucagugccuuuugacuuucccuuuggaagccguucaucaccugucucuccacauucuauucucuagaaacaagcuguaaguucaacccacauucaagagcaggggaacuaacuuucauguuuucaaggggaaugucgaagaaucugggaacagauugugagaccuacacacuguccugucuguucugacaaggagggaugcuaacauuuucaaaagggaaaaaugagcuucucucccacucaccccccugugguauccacggaagaugaagccggcuguaguguugaauauagauugaagugagaucugcccugugcugucaucaagcccgccaguggggauagaguuaguugagggcacugacgggggagguagagcgggugggacagcggaggcagcagagugaagagcaagugaugaaggagagagagaaacgaggcaugucagaacugggaagaagagcaaacucugagggaaaaugaaacugcuuugguucuaagcauucagugggcaaagcccuaaggaguccaaaaugcacagccaggacccagauugaaaccucucacaagagaggcccagcagugauaguuacacuguuagggagaaaaacagccuggcaggccagggccugugccugugcugugguuuggagcaggacuagaggagggagccagaucugcagcauggcggggaagggagaaccugcuguguuccuggcaggaaggagagacucuggaauguuccagagcccucagguguugggguuuaaagagggcuguguuugccugcaagacugcaauggagacagcaguuuuuaaguggaauaaaacaguuuuggaacuuggauuauaacauguacauugauggcuuuuuaaaugcucaagauugggaggaaggguggcuggcauucuagaaauuccuuccuuugauguugacauaucuucuggauuccuuuuagaacccccgugcaucccagggauggcgcccucuacaggaggguccuugccucacuuucgggagucucuuaacuguaagugaaaucuguuuaccuucuuagcuuuuucccccuccaaguacugcuucaagauguccuugaagugcaucuguuaugugugugcaucaaccaguauguccaccacagcacacauguggaggucaggacaaccugugacaguugguucucuccuccuccugagugggucagaucauucucaggcuuugaggcagacuccucuacccucucggcagccccugcuccucucccccucccugccagucuugcuuuuuaaugccugucuaagagauugugaaauucccuucuuuuuaucaccuacauuaagugugauucucuuacuguucuuguuaacuaaacuuggaauuuauauauaacaaauacgauuaaaaugguuaauugagaucauacuugauacccuuccauuauauaucuguaugaugcauaaucaguuuucacauuaggaaaauaguucguaagucucccagugggacauagcauguucucagauuucaauaaagauuuaagguuaaaugaaucagggacuuuuuauagguuaaacgucaaggccccccuaaauuuucuucaccacgugauauagugauugcuuuccaguucuucuuuaaagaaaaaugcuuaggucugauaaauacagaaacuaaaucaaaguggcaaaaauuacuuagugccaaauuacagauuuuuuuuuuacagagcagucuugauagcuuauguugcgauaaagcaacuauuguugauaaguuccuuuuaguacaaaaaaauaugauuaugguuagugucaucuuucaaucaguggggcagccucacaggacgcagccugguccugcagaaugugcagggggugagcacggacagagauugaaagaccaggagugugagaggagacaccggagaccuaggaccaggacaugugcuguguguaacccagaugguacaggcacaaggugugcggaaagggcugcaggcugcaaaccugcauggacuccaaacuacaggugguucuuaguuuuccuuaaagaaauaaaagaauggaaagagagcaucucgggagaucacuacauuuucauucugugucaagagcuacagagauuaacagcauccuggcuuuuacaaaacauuguacuuggcgcugguuugguuuuuuuuuuuuuucccucccuuuuccugguucuuacccaucuugcucucuucuuuuuuucuguacauucuuuuguggacaacaacagaucuagaaacuuguuaggucacuuacuccguucccauuuuucccacaaacucaggaaguacugucauccuccaagcuccucugauuccagaauguucugggaacuucucgaucaccaggcuucuaggacauacguuccugaccuuucacuugcaaagggguaauaagucaggcucauuugagcagccguccauugaauagugaccaagugcgugcuugcucugcccuucugcugacugcacaccgccaucagcaguggugcugagggcugccuaucuguggcugagagguggacuaugcaugaugggagguaucuugggggcuuacugaaguugagugacacagagcugcuuaucugagguguucugcugcggacgugucagggaugggucgggaacuagaaacccgaugcaguguaguguagugugguaaacacuggaucucaagcccaggcuggucagggagucugcaguccacuugccugcguggucugggcugucugaggacugucugcaguccuuccgagaagucgcugcuccucaccuuggggaagaccagggaagcguuuccaaggcaccauguggcacccuguagagguaugaggacuuaagaaagggcucgaggcuggugguggaaaaguggugggggauggggcuggagagggcccugcaaagacugcugaugcccuguuggccuugggaacuguuggaaguuuuaaauguaaaggaacccuguagcuuggcuagaggacuugaaacgauggugacugcuuggaacagcuauggcgauuuagaaagaagagaggcaggagaggaaguggacugauuacuucgcuguaaccaaggcauggcggggauugaaggcaggggaggaagaguuaggagcuucuugccugggagcuuagaacuacaucacaauuauuuucuuaaaccagugcuuuucaggacaauuuaagagucuucuaaaucucggacauuuuuauucaccaggcauuagaaugcaguuuucuaucuuuaaaugcacagguggcaccagauacaucacuaccaccaucuucugcggcgacacuguacacagcuaagcaccuuccccuuagguuaagucagacaaugucugcccuuuugugauaggcuaacuuugcuuagugucuucaagguucaccugugcuguagcaugugucagaauucaccucggugguuuuugggacagauucucauuaugcagccugcuuuuagccucgaauucacugugccccugccuccagccugcgcauucagggcucacaggugugcuuuuuaaggcguuuuccuguuguccaggaaaugaguccagcuccucauggcacuaagcaguucuuacuuagugcacuagccuugaagaacagaauugggggcuagagagaugguucagcagcuaugaggacuugcugccucggcauaggacucaaguuugguucucaguaccuacauaauggcucaaaaccaguuccaggguacccagaaccagcugugaucacuguaggcauugcacacgcgcacgcgcgcaugcacacacacacacacagagagcaugcacguacaugcacgcaaaauacuuaaacacauauaaagaaaauuaaaaaucagagcagucucagagcuuugcuccagauggagaauugguuguguauacccauucaacgcacagucauugcuguauugugugauguuuuguauacaguuuaauuuugauuuaacuaucagaacaaaguugguagaucuguaggacagauuuaagaaggaagcugccuuuuaaauuuuaauuauuuacuuguccuuucauucauucauuuuugccuuuuugagacaggauuucucucuauuauagaccuggcuauucuggaacucaacucuguaggccaggcggacuucaaacucagagauccaccugcuucugccucccaagugcugggauugaagaugcaaaccaccaccaugaaacuaccuuuaaaagaaaggaaggaaggaaggaaggaaggaaggaaggaacagaaaaggaaagggaaaaauuaagagauucugucuuaaaauggggaaaauacacaacacacacacacacacacguucaagguucuuugcuaaccaaauaguagucaaguaauuauguuucaggccaaaaaguauaaucugagaauugcuguguagaaggguugcuuuuggggaggaaagaaagaaaagaaaaacccucucuuuuuucuggauuccuauauauugugucagugaaaguuguuucucuuugaagaucugagagugaugacggugggauucaaggcuguuggagugugcgagccucagaguccccagaaccauucauugagcugugcuugcucccccacggccucugggcagaagcugggucuuugguguaguuugcagcuagcuuugugugcaugucuccguucagcguguugcuuuggaaccugugagaggccugcugauggaguuuuaucggcauuccgugaccaguugucggagagagcaguggucugaagcuccugcuggcauuggaguuauucucggaaggccuuuuugggaagagauaaaaggaggggaggguuccagcagccagguucagucuugcuguggaugcucugugaaacgauaaggauaagugguucucugggaccaucggagggaucugguuucggccugccuacuguaaaggugaagaugacugacaggcaaccaggggggugucggcuauccuccggucucccuccaagcaaucauggaggacagaugagggcuuucucuccacuuaagauggagguuguaaaauuucuuaucugucaguggaucguguauuuccguaucuaagugacuagcaaacagagauucugauuuaaaguggguugucuuguugagacuucguaucauuuuaaacagcuaguauaaaacuaguuuuaaaacaacuguuucuacugaagacuguaacagcagcuaauuaaguucaagucucugaaaauauuucuccucuucaaaguccuacccaaagaaggacguuugacuaaagccaacggugugaaggugcugcugccguauccaagugugaaggccugaaggcugcacacacuauguauggcaaaggcuauuuuuauagugugcagcuuguacgacugucugagucaggugagugggugauucugggcagaaaaaaagcccugaguuuucagugaguagugagaagacuccaaacugaggagaagaggggugaggccaggaauccucuggcaaggggaggcuuccagaaaggacauggagugcuuagguggugggcccaacagccgcaggcagaaggcuuugaaccagcaaguucuuuuccuggggcccaacaggaaaaggauuucucucuaccccagacuugaggagggcucacucagccuuggucuaaugaagauggaguuccucccagggauugcuggccagaggagcucugaagagucccuuagguugcaggccugucuuccuaauugagcacuaugagauugcugugcuuaaacauauacagacggguaggacuuguguucaggaugcacggcagugagucuuuuggugcauucaaacagauccuuagucuacuacuuacugcgcagcacucaguagguguuucucaauaacagacaagagagcagaaaaugucuuccuagcugucauuuccggugucuuuaauuuagauagggugacagaacccaagugugaaaccuucccaagagggcuggcagggagguacugcauuuuacacagccuucggccuauaaaguuacaaacuaguuggcaucucucacaacauggcugguuugguucccuuaaccacagugggucaggagggccagaacugaaguucacacagucacugggaauugggggggggggggcagugugacaggcagaauggaguaucugcaguuguugaguuaucagguguguaucgugcaggguagcuggggucuugcagcuaccacagcucuguggugcauggauuucagacacugcuuuagcacuggcuuuugucuucagcgucugcauugucuuaugaaacccaggcugcuuuguaguuucaguuggacaaggcacaguuucugagaggucauaggucagcuaauguucaaaaucaauauauuuagucacaugcuaaacgcaggcauuagaugcuuauauaaggccuuauuauuugcuugugggcagugcauacagagagacccagauugcugaguuuggcaauuuagcgaguagagcccuuucugagcagacacaaggaucugagcucaauacccagaccccauguaacaaguuggaggaggaggaggagguguuggugguggaggugguggugguggugguggugguggugguguuccacacuuagaguuccagcuguagagagguaaagacuaguagguccuugagcuucacuggcuggccagccuacuuacuuauuaagcuccacaccaauaaaagacuuuauuuuaaaaacaaacaaacccccaaaaccacggugguugguaaucgaggaaggacacuagaggcugaucucuggcuuucacggccgcgcacgacacaccugugaggaagaaaagcagguccaggcuuuccucucacauagucugagcgcgugggucagguggagacgcucugucaucugguguuugcugcaguagagcccugcucagcuucagauccuggcgcugacacgcaccauuguuuaacuucgaaaaagguucucugcugcccuagaccuugaaaggaucugcauccggcgugugccaacaggaagcgguaccuuguccuaggugguagaggccuaaagcaaacaguggcuguaaagggcucagcaacuccagugcacacgaguccuuuguucacauuuggggcuuuugugcuguucucagagcccagggagagugagugacuuaguuggaaguucauuguuagacauaaggguugaggucucuguguggaauggucacccagacuggauggcacagccagaagcaacccuuuaaaauaggggcagaacaagaacuugaccuugugugucacagaaacagacaaguaguuuuccuuuccauuuucuuugaaguuagaggggugauuuagacugaucgagaagugacaguaacucaacucacccauucuuguaauaaacaccugcugauccagcuaguugaaccucucuaggucugguauccccugguccacuucaggagccguguugaugguugacugucaccuuugccugguuuaugaguaaaacuacuaaauaauaauuugacaaguuagaaagaagugguagaaaugacucaguggcuaaacauacuuaacugaccuuggccuggagucauauguggaaggggauucugggaaauguaguucccuuuaaccaagccgauggauugcagcacaaacacacccccacacacccccacacccacacccacagugcagugaaauacauuucuguacuucauuguucuuuugggaacuagagauagaauuauuuucguuuuaaaaauaucagaaaaguaguugguauaucaaaguaguuagcaaauauuuaacuugauuauugcuuucucucaguagccuuaccugcguuugaaauggcacaauagcuaaaaacaaaacaaaacaaaacaggacuguuuugaucauauccugccuccugaaagccguuuuugucauuugacaguuugaaucucauaaugcaguauuuucuaaaauugccccauauagugccaucuagugguagauuucugcacaguaguucacauccccacccacuacccccaguuuguuuguuuuuuuuaauuagguuuuuuuuuuuuuuuuuuuuuuuuccuguucuuguucuucuaauuguuucaagacagccuggcuguucuggaacucagagaccuucccaccacugcccagcucucacauuuuacuuucugauaaaucaguaaguucacuuuuaaucaugcuucauuuucuaaauauaguuaaagggacuacaucuaaaacaaauacuuagaaauggaaaaagaaugaggaaagagaaaacaauuggaguggaguuuuuuccucuccagguuuucugugcaucaauacacacacacaccgaguugguuuuugucuguuuacuugaugauuugaacauacacauaaagucauuuuuguuuguuuaugaaagucacaugauuguuucacaagugugacguaaggaacauggcucagcuuugcaaucaggcaugcacaggcauugcauucuguaagguaauggguuauugcugucugccaaguggcauucuggccacugcauguguaccaacucauuccauauuuaccaacuuugauuucucauggcaggauugaccucugcugcacacccccacccugugugcaucgccgcuuaacuuugugcgugugaugauaauaaaacuucauaaugccuggcauuuagauuguaacggagcgcguuauucacagcccagcgagagaaucugaacuuaucuuuuuuccuccaucauaacuuuguuguguuuguuuuuaauuaaugauugauugggggaaucuagaugaccuuaacaccucacucacucccgaacucgaccuaacuucuuacgucuggaauguuauuugugguccagugaaacagacacugauguuuugugucgacuaagucuuccggggguagcaguugguagccagcaccuggccuuccucucuggccuacuucucucaaguagccguggcgucuucauugccuccaagaaagcucguuggccuuagggucuggcugggaguggagccuccuuuguguggcucaggguucuaguuagcaagagcucagucaagcaugaguguucugcaaggcagaaguauuaauugcuuuugauaguguuuugucaugagaauauagugggugaauuuucuaggauuucaauaaagacaaagucauacacaagaaaagaacaaacaacaauuaaaaucuuguuugaagcaaacaaagaacagaaaggguccuugacauuaguuaggugacaucuuggugggcagugccaauggagaagcucuugacaugauucuuccuugucugcuuuggcuuguugugacccagcagugucugagacguuaagcuggggcaucuggggcaucgccauuacccauguggaagaggagcggagggcaggagucggcucccacuguuguaguagaagcauuggcugcugaacuguuacuagggacacagaggcugcuguucuccauggccagcacuaggaggccacagaggccugacggcacacagguuucugcucaucaggaggaaaacaaaacaaaccaaccaacucuagggggaccagcacugugcagaugagcuaguuuaaagagcuugguaucucauaaccuggugagcaacagucugaauuggcaacccacuuacuguucgauucggggcauuguaaguacaaggaacugagcauuucuggcuagguaaccccugcuucuuagagugguaacuguaagcuuccuuggaugcaccaggcaucccuggugagccucuggauacagguccugauucuugucguugucugguuuuuuuccagacaggguuucucuguguagcccuggcuguccuggaacucacuuuguagaccaggcuggccucgaacucagaaauccaccugccucugccucccaagugcugggauuaaaggcgugcaccaccacugcccacugcccggcucagauccugauucuuaaugcacgguuaauccuguggcugauggaacagacuccuccaguccauuguguuaauugaaaacaaauaguuuucaaagaaaacaaguaguuuuggccacaggcauucuacuaauauucuagugaauugucuuuggccuucaggcccugcuaggcagacguuggauauggagguguauuucuauguaguuguguguuuucuugguucccuuuuugcuuuuaaagguaaaucaccauuucaugacauaauuaucgcuauuucugaguuggccccuuauucagucccugguucaccucuguuacucugaucuccugaacucuguagaguuuaauccacacuacauugauuuuuauguauuugcuacuucuccuuauuaaaauucuaauuguguguucuguugcuuaaggacagguggucucuuauuuccuguguuuccugguagaaccaagugugcucguaaaaaggacaggacagcugcuuucuugacaguaguacauccuguggguggcuuccccuccaaccucaucccuucuccccaccccacucuccuuccuucucugcagcucuccuccuucccuccucugugccuccacuugugcugugucauauuucugaaagggccuugaagguagcucacuugaugaagugcuuagcaaggcuugaauucaauccccagaacuaaggccagaauggugguguagccccagugcuuaggagauggauucgcauggauuccuagagcuugcugaccaggccagccuccuuggagaguucaggaaggacacgggaaguuguccucugcccuccacacccaugacccagccuagacacaaacguacauaaaacagauacagaggaaacuuuaaaguaaugaacuuuucugcguucucugacauuuuaucuguccuuaacauuuuauuuaucauuguuuaauauacauccauaauuucugggaggcauauuacuuaacuucuccucaagguauuaaaggcuuuugggggggggcuguguuuaccaugcuccuugaaggacuuuguagagauuuuaacuaaaagucuguguguccagguucaagcagggacauugacucuuuaaaccacaaagaggagauuucuucauuugcccaccuuguaauuuucucuguaaaacucuugaagauuuauuuccuuauucuuagaaagugucuuuugaacagacaugaacauguguuaagugaaagcuaguccuauucuaugaaauggcuuucaacaugaauuacgagguacuauuuuugucuauuguuuauauccaggaacacugauggacuccuacuuuauccugacaguuucucuuuguacaucuccuauagaaaguuaccacccagagaugucauuugcauguuugcauuuccuuuguauauuuuugugcguauguuguaugugcauccauauguuuacacgugugugugcgcuuguagacuccagaaauugacaucaggcaucucccuggucucuuauuuauuaaaacaaggucuucugaagguuacagauguugugagaugagccggaagccuugggucugcccaucaugggccucuuguucucccugcucugaaaguacuggggcuaucaacaugauuggcugucaugucuggugaucugaacucuggcccucaugcucuuauuaacugagccaucuucccagccccucacucuugccauuuuaacuguuuuuauuaagacuucuauuguauuauuaaauaauccgcaguguugcauuuucuagcuguuaaagaaaaugcuucauuuaacaguuaaacacugaauucguuguagcucuuaaaugacucuaaucaugucuuuuucuguucuacuaugucaggcuuuauuuuuuaaauaugaagguagcucaagaaugacaaaaccauuaacugucccuuuaaggacuuaauuuaacccgaauuaauauucugcucacgucuauaaaaccuugaugagaaagucacccguguugccuagcaugcuugguaaaugugaccuuuguuguauaaacguguaugugguacgggaggaacuguguguggauucugaguucuugaugggaugcugcaacucugagcuucagaaggaaggaacucuuacucuggcuuucaugguaacucugcccacagccuggggccacuagagaacacccugcuuucugcuugaaacacaaggcuuccaaaccagcauguuaggucccuacucuugcaaucacccuuucccccaguacccauccagauggaggagaguagcucauggacagacauguggacuucucccucccacagacagagguaccugaaacuuuccuuuaaauaaagcaguauucuccccuccgaguccucugcugcugcugugcucugcuuccucccaggauucccgagccagguggcuguguguguguguguguguguguccguccaugugugaggccguggggggggggcgcuguggggggguaugggggagcuugguaauuggcuggcucacgguguaguuugaaucccacauggguguccaaaacaagacacaauggccauguucacuggagcugacuuaacauuugcccucaaguucugauuuuuaaccaugaauagaagagcuacaggugugcuaacuauacauacuauacaucuaaauauaaagcuagcacucuauauuaucuuuucaaaauguuauaccucuacauaacuauccauacuuucuuuuagacaaggcgcuauuguaaagacuuggcugguuugaaauuuacuguauagaccaagccgcccucaaacuccuaagagaucugccagcuucugccuccuaagugcugagauuaaaggcaugcucacacacaccccaacuaguaugauauauauuaauuaauauuuauuagucucaaaaugaucauucuaccaaaaacuuguaccguguccagcauguagguauguacuauuaagaguuacuaaaauuaaaucuguuuaaaaauccuuugccacaauauagcucagugguaugaggcccuggauucaguccacacuccuggucaguucaucaagccuuucuguggcuaccauauuugaaaaauacuguuaagaaguuugauugcacacugucuggguuuuauuuauuucauugggcuaucagagcuuugcauuuguaccauauauaauauauacuacaaggaagucugaguaagcaugcccccaggggcaguccucaguuuauuguugaucugcuagaaaagcuuguucucagauaggaaccagacaagucacaguuagacugagacuuacuucccagcaucccuagggauaacuucguaaucaauucucuuuuguuuuugcuuuaucugucagggaauguugagccaaaguucuggcacaguugaaguagucccuuggcuuguagaucuguaugcuuagucccagucucuaagaacaccugccagaaagcccuuuagcuggcuuuuccaaaacacuuuaauuuucaaaauaguaauuaaagaacucucacugauguaguugacaaaacccuucaggcuucucaggguugcuagggaaauucagcugggaguauauuugugucucagucaagcgcuguggacaggguuugcauaaaaaggcaagagggcuauauugugucucuuuggaaaaggguucuuuuaggcaacaaauugaauucuuagcagguauccuucuuagugcaagacacacugcaaugcuuuccccuuuucuacuuuagucuagaacuuauaagccacuaugacacuagcauauuucaggacaaaagguaaaauagguuuauaaaaaacaaaguuuaagccauucuauugggaagaauuggugaacagauuugauuugggggcuuucuaguugcuaaagcgagaaaaggaaaacacagaguugcauaguuuguguguguugacaaccagaagcacauaaacaucugcagaaaccaaacauuuccuggaacuaaacucaagcagaaacgugucacgugaaccuuuguuuaaagagucuagugaaaaauaucuucaaccacaguuacauaacaggcccaggacaccgcgugaauuggguucucuaggagguaacugggaggugcacaggacaggcgaucagaaacgaacucugggcccugaggucuggcccugggcuguuuggaaaucugcugaagagagcuucaaccccuuguuccucugacuucacccugugagggcuccuagacauugcaguguagcgucuccauagugugccuuccuccuugcuccaacgacaaugacuccagugcagacauuuuguuuugaugauuaggauaaagcacugaagaaagcaaagaccaucuucagucuuucaaagcauauauuuuuuaaugcaaguuuuuauaauaaagaagcuuaaccauucauaacaaaugaaauagggcagacccagcuccucccugcauaugaagggcaacuguagccaauugcccaucugagagaaugugaucacagaagggcaguuucuuuuaagaacacucucuucuuggauuauuagguauugugguuugaguaagaaugguccccauaggcauagauguuugaaugcuuagucuccagggaguggcacuguuugaaaggaucaguguguagccuuguuggagaagaguguguuccuuggguuuggcuuugugguuucacaaaacccaugccaagcccaguggcucccucuugccugaagaccaggaugucagccauuucuccagcaccaucauuggcacaccugccaccaugcuuccugacaggaugauaauggacuaaaccucugaaacuguaagcacguccccaguuaagugauuucuuucuucagaguugcuuuggucgugguuucucuucauaccaaaagagcaauaagacccuaggguacaaccauuuuaaaaauuaaaagcauccuagccugccauguauuucucauacagacauuaauuacugacugcccauagcaguaaaacaugaauaauacuuucugcuacuugaggccagaucacacaccuuaccagcaauguaagaggauguguuaaugggguuuagggaggugucauggguagcuuuucguguguguguguguguguguguguguguguguguguguguguguguguguguguguguuuccuuguuagugcuguugauugaccccaggaccuguguaaccaaccaguauauccccccagggacaauucugaagaccccaguuuauaugaaaaucugcuggacaagacuuuuucagauaagaacugagacuuuccguccagcauggcuagagauaacuuuggaauugcuaaaggcugugccacagagcuguaggcccugcucuugguuuuaugagcccggucuuagcaucuaaauucaaguagccuuugaucuugccugguccucccucugccggccucuugagugcugggguuacaggcuuaucuacuccaugcggcuguuugaaguggggcuuuuguuguuguuuguuuuagauuaagaaggcuaaugacagcuuauggaugauggccacacuuagaucucuucuggguuuuuguuuucuaacgcuguguuucugggacaugaacccagggcuccaucagugccagugcuguguuacaagcuuuggcauuuaguuuuugugugauaaaauuugcauguauuuuucuaugucuucuggaccuauguuuccuguccuguuuuuugucaauguggaauuaaacugauauuuaaggaaaacaaagauuuuuauuuuugagacaggguguuguuguuguugucauuauuauuaauuucuggcucuccuggaauuugcuauguagaccagacuagccuugaacucauauucaccugacccuguuucuuaagcacugggauuaaaggcauguaccaccaccauguccacuauccuauauauagagucuggaacaagcaaagacuuauagacuggggauuauagaggcuccauauuaaaagaugggguugcacaugaagacauugaaaacacuuaacuacagacugagaaaagcccugggugaccuaggcaauuagaguuacaccugaggagguuggaagauccucaggagaagagcgcagccaccacgagagacucucccucucugcacuauccaguuucauggucuguauagcuaugucgucuuuucuguauagccuaacagccaggguucccgaguugcuuacaggggguuuucagagaugggcuuccuaaaagcacacaggugagcaaaugcaguguuggaagagaacacucuagcaaagcacggaggacucagaguagggagggcagcgugaugucacuuggguuaaagccuaugcugucaucucugauaggaaggauuggcauagaggggaguagccucacagagggagcaguccugacagaucccuguggaugaggagaaagccuagcuagggccuugugguuugagagcaggccauaagagccugggcggugggaggagaccagguccucaggccucgaaggcuuuaggcucgggagcugucaggaguaccaugggacaaguuccgaggccuagagggauagugcucaguuugcagugugcugagguggauuagaggggcaaggacaggaaacagcaaguuuggcaaaaagaaaacauccaugaaaaauacucaggcugaagcauggacaguucugaguuaaacguggugcagagcacagccuccauugaacagaacgugccuucggcucauagguucccagcagguguaaagagcaguuuccugauacagugucccuggagcagggccagcugaagggguucauguuuucagcugauucaaugugauacugcggcaucuguaaacaacuuaaaauaaugaaaucauacugauuuuuuuuucuaaaauagcagcagagagaccagugugagagaccaucuagggagaacagagacaguucaucccagugcacaccaagccaaguggucuuuucaguccaugcaugcagacagcuuuacaguuguguuuuaacauuaacauccaguugcuuucauguuuuuacaauaagcccagaguuucaaucagcuuaucuguuaauaacucauuuucaauucucuucucuuuucucacugacauuuuccucucuuucucucucccucuuugaggcaggaccgcacacugcaucccagguuggccuagcuuaguugcuauauaguccaggcuagccuccaaaucauggcaguccccuuacuuuggcuucccagcucccuugguuauagaaauacaucuguguguccugggucagucuuguagccauuuucccugccucuuuugaaucaaaaauaucuccaauuagucuuaucgcuagagacagcagauucuucugggugaagggucagacugguaaaaaguaaccagaucaugcuauauguauauaugccuuaaaacaaaggacaucauuugauacaaagauugcuauguugugucuaaggccacaaauuaacuugcucugcgcuaucacuuuaaacacacacacacacacacaaauggaaaagaaaaccuguuuucuuucuacucuccuugaagcuuguccuggauguaauaguuucuuuucucccacaggcaucucguugauuccuagcguuagaagaacugagcuaacaggagucugccaccucucugccuugcugaugcacccaggcagggcucacugguuugcaggaguacaugaccacagaucagagccauugguaaguaagugcagcauauggcacccucuggcuuccacguacgagugugcgcaugcgcacacagacaggugcauaagcauguacaaaguguagaaucuuagagcgaugaggugcauuuuaauuggguucuuuaaauucugcuacuagcgagugaugguggggugguaauuuccccugccaauaaucaauaauuuaagauaguaguaaaugcguguuuguaaaugaagggauucugagagacgguaaagucacugauaagagccauggaagcacuuuccuuacauaguaguucaucucugaagacaauagugcuuaaaugcaggcauuucguguguaaaagccuucuccuugguuacuuguuucagucucuauuaguaaaaugcagauguacaggugaggcaauuucuguaacacuggaaaagguugccucucagugcagucccucagagcagggcggacccgagauccaugccaguuaaguggaaaucguaccgaugguucuagcuaaaaacaauggcugugcuaucugaguguacagcagacuguagggccuguuucuuagucacacagagcagggagaagggcccuggccucugccaucaaagcacaagccacuugucuugauggcagugacguaucagaagagacacccuuucuucuguuuuauucuuggaagcuuuucugacagaaguaguacaccaugauccugccugagggucuuguuuuggacuccaguuaacaauagagagcagauguguaaggcaguccccauuucauugagguggcugcuuuugggucagaacauggcauuguucaauauggcagccucuuggccacacgcaucuucugagcacugagacaugguagugccaucugagauguucucugcuaugaaauaagcgcuauuccaaguacuuaauacuaaaaacuaccacguagcaaggcauaguggcucacgccuuuaaucucagcacucaggaggcaggggcaggggcaggcagaugucuugcguuucaagucagccuggucuacagagugaguuccaggacagccugggcuauauaaagacacaauaacaacuccacaauauuuaaaauuuuucauacuuuaaauguggaaauaacauuauucauauauugaauuaaauaaaacauuaaaauuaaaauuaauuucauuuuccuccauuuuaccaugugacagcuagcugucuccccuuucucucuccucucccuguucuuucucuuucagauagaaguuugaacuuuaggcuggucuucagaucucuugccuuaaauuccugagugcucaauugcaggcaugugucaccaugccuggauuagaaaauuuuaaguuguuuguaccuugaauuugucagucucucuguguuuacuuuuuuauugacuuguuuacuuaucuguuuauuuaaagcaagguuuugcguguagcccagauuggccuagacuuauaacagcccuguugccugagcuucccacgugcuagauaauaggcguguuccuucacacuuucaggaaagcuccuccauugaaaaguaccuucugagacagcagagcaagcaaucccaggggaaggcagugggacugaguguagacagggucgcaaauccagagaucuuaggaugcagccaggccaggcuugccuggacaggagggagaggugcacacaggaguaaagugagcagcauagggccacaugcaaaugacgguuauacuagggguuuuuguuucugaugacaugaacaggaguugguggguuucaaagagagaggugugcggcgucugcucuucuaagcugcugcagugugaauaguccaagaucagggcauuuacaagggagaagcagagaguggagcagcggccaagugccugagaccaaagcuaacuaaaggaagugaggugggauugcaagggagaugggugccugagaccaaagcuaacuaaaggaagugagauggaauuggcaagggagaugggugccugagaccaaagcuaacuaaaggaagugagauggaauuggcaagggagaugggugccugagaccaaagcuaacuaaaggaagugagaugggauugcaagggagaugggugccugagaccaaagcuaacuaaaggaagugagaugggauuggcaagggagaugggugccugagaccaaagcuaacuaaaggaaguaaggugggauuggcaagggagauggguuggauagcaccuggacaguguaguacagggucugaaaagcugcaacgucggugagcagcccuccauuagucagugcagcggguggguuagaucagcugggaccuugggguugcuggaguuagccauggccuugacaguagcacauucaacaaaaaugggcaaggauaauugggagaaugauaagaaaccgagcuuaggucuucuugagucaaggagagcuaaggaaguugauugugcacugcugggagaagucagcaccguuucccaaggcuggccaauguuagacuugcuuuccugacaaggcucucuucauuugugacuuagaagauaggcaccuaccugaguaaggccggggaggggaacugagcucuugggcgaguguccugggcuugcucuggggugggacagagugagggagugagcagagaggcuggcgcugacucugcuccaagguugcuuugcagcuauugugaaauuuggccucauuucuccuugcucagugccauuuauauucugacagucaaaguucuuaagaaacaaauguuaaaacuuaguucuugucaacuagaagugcugaaagccugguucuuugggauuaauucccuguauguuacuuuuaaaggauguuaccaagauauuugaagaaauaaaggcuaaaccaugccccaagcccuggcccuaaaccacugccuaaacaucucuauacuagaucagauaaugccuacauguaagucuucuaacagggaggcaauuuccgugccugcgacagcuucacgaaggucaaauggaggcaguaagaccaaaugcuguaaagcgccuuucccguuggcaaguagggagguuaaguuuggcugauguuugucagagcauugaguauaacugggaaaaguggacgcugacaccuucugggcugcugauaacuaauucacaaccugcuaauggaaccugacagaagucuaagcaaacaaucugucuauccugagaaaccucagcauuucagagcauccgcuauuuggguccucugagguaauaguggcacagugugagguuauucucccuguggaagauacucguuaggauaauaaagcauauuuauauuucauaccugaaguagaaguagaguuguguuuucuuuucacaguacaguccuccuuuauuuagaggaaauugagaacuaaaacaggaagagccaagugggcaugguggcacauaccuuuagucccaacccagggagggauaagguucuuggggcaguagaugguagcuaagaggaaccuuggagcgcauuccagcaggagcugcccauugucuaccguaggaccagaagggcaucagauuuuggagucuggccgucuccacucccaguacccucauaucuaaaauagaaaauuacauuucaaugucuuuuggguagacuucuacauuuuaauuuuuuaaaagacuauucuuuauucuuagaugguuucacucauacaugcaguauuucaugauuggaucugccccuaacucuccaucacuuccuucugacaccucccaacguaugccucccccaccuuccccaccaucuuaauaaaagaaaucaauaagcuuagaaaaaacuuccuuagucuaaagcaaauggaauaaaguaguuuaggaaacaguuguuugacugaaguucacuaagccaaaauuuaggauuuugguuagcaccaaguauaagcuucccugcuuuuguacacugacaucaguauguaaaugagggugacacuuuacuauuuugggaagugugauuauuuaugccuugucauucaaggaagugcuugcaguaacaagcagaugcacaaaagaaaguccucuuugugucccuuugggguaauguuggggaaagaauauagaaaguuacucuucuuucuugggaaaacugguccaugauccacuuuuuugguuuguuagugaucaugacucuaaguuaccccggaacuuauccaaacacaaguugaagcuaggguuucccugagccauagguaagucuuuucgugacauaugguccacacaugcuuuaggagcaaucuugacaacaaaacguucaugugggcagaugucguuugugccacugcugugcaaagugggugcggcacacccgagcugaacacaggucccugcgaagguacuaagaggaagccagugagcuguuucccuaucacugaauggcaaagaugaaagucuccacuguuggaaaauucuagaagguccuccaggcugacgagccacucccggaagcaggcuuuugugugccacaagagggagccccugaucuaaggcaugaauucucauuuugcuaguauuuguuucuuuugagcuuaauauaucgcccugaccagacuggaacuguauagaccaggcuagccucaagaucacaagagauccaccugccucugccucccaagugcugugauucaaaggcgugacccaccauggcuagcuuuugcuggaauuuacauuuauaaagggaaaaaguuugagcucacgguguuugcuuuuaaguguaauuuuacuguggugcuuugaguauuagaaaagguuccgaaucuggaaggaggucaccuuaagccucucccuucccuuugguuccuucuuacacguuuuaucugugacuuguuuguggcagauuuaaacaccaccccugagcagccagccuguccugguucccauuauagggcuguuuccuggggagcugaugugagagcucuccugugguucauuucacucacguggagcuugcugcugcccccagcagaggaaaguggcucuuguguagaacgcggcaugauuuuaccucacuguguagcacgguguucauacaugcucuccucccaccccuaugguucugucacaauacugcgauacucgcacuggucacaagaggccagcucucuugcucagggaggcagaaaggagguagaacauagcuaacaaagaggcaggccaccaucuuucuaaguuacucuuuaaaaucaugggucauuuuagcaauacaaaaagugcauaaggaacucaauauagaacucaaaugguacguggucauuaagacauacuauguguuuucccagaagccuuugcuccucacugcuuuccucucuacugaaucuugucaucccaaugcauuuuaaaaacaugacaauguaaacauacauauauucucaaacauagcaucauuucacagcaugcuguguuuuguauguucuauccaaaguaucaguugugucuguugggagggaaggagaggcugagaagauggaggugugggaaggaugucagaucaguccaaguguugaugcuuauggaagagaagaaaugaggauugggcagagggacaaauuaggcagucagaaaggcuccacgaaggcuucaucugauccccagagggacugcuagggccuguccuggcuuuacauuauauauagcuuaauaucugccaguuuuuggccugacacagggaugggagggaugagacuccuccugcagauggcugucagguugcagcaguccucagagagguggggaguaagcuuucccuacuuaaaagggaccgggacaguaugucucccugaucgucacaguucguauuguaugcauuuucugaccuggaauuuuucauccaaugauguaacuuugagauuauuuauauuaauugucuguagcccuuauuuaguauuuuuauggucuugaaguucguucauuuguaugugugguaauguacuuguuaguguauguaugugugcccucaaauguggaggccagagguugaugucuggugccuuuuuuccauggcuuuguggccucucagugaaccuggaacucaucaguuuggcuuuaccagguggcugugagcaucagggauacaccucuccccuccccuccccuccccuccccucccuugcugggguuacaggcaugugccucuguccugagcuuuuuaccugguccugugaaucuaaacuuauguucacccaacuaagucaugucuccagauauaugucacuguuuuuaaaauguauuuuccuauugaaagacuucugaguauuaaagauuuuuuuuaacuauuagaagaagaguaacugcacuuuuucccacuucauagagaaugcaccggauuagcucugggguagauaaccaggaaguuccaggggcuuagagcacucacaacuugaaacuuaauagcugucaugauuugcucuuugaagugccuguuuugggccacagccucauuaacacuugucacugucagaguuuaauucuuaccaagcuaaggguauaacaugguuucuuguauuuuuaguuagaauuguguugauuauguaggagauucugaauuugcauuacugucugucugucugucugucugucucugucucucucucugugugugugugugugugugugagagagagagagagagugugagugcaugagugcgugcgugaaugugugggagcacacgcacauguaugcagguauucgaagaagccaggagaggaauucggauccucuggaguugaaauuccauguguuuaugagcugcccaauguggggccugagaacuguccucuggaagagcaggaagugcccuuaaacacuuagccuucucugcagccuauguggcuaugccugugggugucauugccuuagaaguuuggaggccaauguaggagcuagagaaaguacccaagagcugaaggggucggcaacccuauagguggaacaacauuaugaacuaaccaguacucccagagcucgugucucuagcugcauauguagcagaagauggccuagucggccuucauugggaagagaggccccuuggucuugcaaacuuuauaugccucaguacaggagaaagccagggccaagaagugggagugaguggguagggaagcagggcaggggggaggguauagaggggacuuuugggauggcauuugaaauguaaaugaagaaaauauccaauuuuuuaaaaagaaguuuggaggcaaucaauauauuugucgcauaaguuccuuggaaucuauauaaaaacaagcaucuaaccucacaagaaauagggcuuaguuuuuuauuuuaaaaguggugccuuuuguugaaaaagauuugacugcacuaaaauucaucacugcucuuccugugggcagcguuccuuuguaucuuauuuuaaguucuuccucagucuaaggucuucuaaaguggcuuuuagugugugggagaauggauugcagaugcccauguuuugguccuacugauaucuguguccaccagcacuaccccuggcugauguguccugucuguccugaugugcccucccaacucuaucuagauguuuuacauuguaggucauugugcuccaauugccuauuucuugacuuauucuccuuaugauggcuucauuuauuuaucaccucuucucugaucauuuaaaaucucuauccuuuauacuaacuuaaaauggccuacuggaugcccuuagguuuccaaauacauuuuaagaucguguucaaggacaaauuugcuguugauuggggucaugcauuguauuuauagaugaaucugaaaacugauacacuugugggacacauaguuccuuucuucuuaaugucccucccccacgcauguuguuuuuaaaaccuuuuuacuaaauaccgaauuaaauuuugucaaauauacuugacaauacuaaugaauagaucuuuuacuuaaccaacguuuuugcucacguuuggaucaaauuaaucucucagugauuauucuucuacccaagucuuucccgugaugaagauuauaaguaucuguucauaucucagucugauaauguuaggaguuucauguugugcugaugugagagguauuuggguagggaauagaagcaaacacguaacuuaaucuugucucuguaugacagggcugggggcugcuccagcuuucaaguugaccugcuuuguuuccccugucauguggccaucagcugggcccacacagccaacccccgccacacacacacacacacacagacacacaaacacaggcagacauucuguagcugucaaacugauuggaccugguuguuucuugccugguuugcagauaccguacuguacguauuccauugaucucuccuuguggucaaguugcuugagucuguguguaguagaacaucauuaccaacauaguuuuucuuuucaggaucuucuagguuauuucugcuuuauacuuucacgccagaugaacuucaagaggaucuguccacccccuuccccccaaaaaacccaccaucuugauuggcaguguuaauuuccuggagacauucauguuuucauuuucuugccugaugauugcuguggauucaucugguucauacauucugaaacucuuugguuagagcagauuaguccccagauuucuuuuccaauugaaauucagcgcaauuaaauaaacccauuucagcauacacgaucaugccacguguuuguucugcgaagacaaaauguuuuucccuauugagcaauuccugaaagacuuagguggcuagcuaggguccccgaauuucccaaccagacaguuucagacaccgucauuuauggacugcuguguuggaagucuuuucacguggacugcauugucucuugucugugacuucuguguuuacaguaagaaagucagacacaggucuguugagacugucuaacucucucacaccugcuuggguucugcaguaguauuugcuaagugaaauaugaggacugguuugucauguguuuucacagaacaccgauggcuccuggccaaucacguuagucuuagucuuauuuuucccccaugcauaaaauugccuauuuuucacuucagaugggggugagagccaguucugaguuuuuuuuuuccuuguugcuugcacaccaucuguggucuuggcaucucagacaaguucccagaucacccaagguauugguuggucagcacucacagugaucaggacccuagccuaggcuugucacuguuugucaggcaaugucacucuagucaccucagugcugaacguggcugcuguggccuccguguuccuuucauuguaaauaaccucugcaaagguaaugcagagaauuugcacguauacuccagccagucucaaggaacaaacaugguaacauaaccgaacaagcaugucucuuuauccacacucauggguaguucucuaguguccauuuccuguucagaaucuucagccagggaugccauauuacucuuagccucacgccucucaaaaauugcguuuggccuuaacauaguugaguauagguguuugaauuuuguuuuugcuuuguuuuguugagacguggucucacauaguccaggcuggccuggaacuuucaugcagcaaagagugaccuugaacuucuaauccucuugccuccacuucccaggggcuacauuuacaacaugccccacaauaccugguuuuaugcagugcuagguagccagcccaaggcuucaugcauuccaguuaaguccucuaccaacugagccacauccauauugcuacagcaucaguuuugaggauugccuuguuucuuugucuagggcagccuacagaagaaagcauuuauuuaauucuagcaucacguuucagagggcgaguccauggccaucaccaugggaagcauggcagccggcaggcugagcgcucauggccugauccaaaguagaaggcagacagacagcaggaccuggcauggguucuugaaccuucaagggccacucccagugacauggcuccuccaacacccuauuccaacaggucauacauaccuccuaaucuucuccaacuacucugucaacugggaccaaguauucaaauauaugcucccauggggccauucucagugggacccgaagucuauuggggaagauaguguguagauugucuaucugugcccguuuuacugaguguuggauguggugggcuuggagggaagaccacagaauggaggucuuucuuugucaccuccccaugaaugguguacaugcugucugucaccaucagugucacuugucacuggcucaguguuugaugguuuucuguaaaaacuuguuuucuuuucucccucuacccuuggaagcaagucaccaaggauaguaaucucaccuguaaaguuauguuaacugucuuuccuauacauucuuuacaugcuguguuugaaaucaugccagcuuggggagggguugguaucugauuucagauaucuauagucuagacuuaauguuuagagccuuaagugcaagaauaaguaaaaacacgucuacaugcaggaauguuuggaagcaguguaguuuugcagccgccugaauuugauuuauuaguuuuacuuuaaaaucuccacaaucugcaaacuguagcagccgcucugcucugaucagauggcugcacagacugcucccaauucuuuuagcauaagaaagccucacaauuuucucuuagaauucggggaauaauguuuagcaucauagcauuuuauccauacugaagucugucuaguaaacauaaaaauacauugauuauaauuaauggaaguauuuuugaguauugaaauguuccuaagagucguuggggcaguucacugcucccuccuccgcccacuucuuccaccuaaaagaagucggcuguaggaguucacgcucccucugcuggcucucuugucugucuuuguguuucaggaaggggagagguucuuccaguuuuguuuuacuagucugcgacucagucaagucaaauggccuuauuuauacuuaagaaaaaauuaagguauuacuacuuuagcauauaaacagaauauuccagaaaugguaucuuugaaaugguucauguaucuguuuauaggaugaauuuugugacugccaaaaugaguuaauuugugggacaacacuuggagccauuccgugccaccuacaguuauaaacauuggucuggguggacuugcuaagucuuuugucaagacucugggacuugaugucuccccguguuuucacuugacuuugagacgguuucagaaucuugcacugaggguaaaggcuuaaaaauacgucugagaagucuccugcucacuucaugccacuuggaaggacaacuaaaaucaagagucguguuuccagucaggcgcaggggaaauccuuuccuugacuuucaguuccacucucaguagugaaccgauuccuuccguucauguggggauucccaugcugacagccaggggccuuaucacauaugugcagcacacaggggagugccgccuuuguuauuucuuaacugagugaagucugcccugagaacuauugccguuuuaauauuacucauucuucguauggaccuguaaagucugaacaucaaaaaguuaaauauagaaaauuguuaucaaguagguuaaaggccauuuaaauauaaggcuuuuggaucuguauuguacauaacauguauauuacaccacaaauauauaaaacuuucuuaaauuuuagguagcagguaaaaaacauacaagaacagaacuuugaaugcaguuugcgccugucuuuuguuugcuucacugugcuuucuucgauuagauguagaccaccaggggauaggacauggcuuuucuauucugaguguaagaguguuuuuucagcguguauauaugugcaccacauguguaccuguugccugaggagguaagacagagggucucaaguaucucgaguuacagaugguugugaaccaccaugugggugcugggaacugaaccaggguccucuguaagaccaagggcugcuaaaugcugagcugucuucagcccuaggauguguuuuuauggcuugguuuguuugagucauuuggaggaaaaucuacugauaagacaagcugcagucuagcuaacagucuuacaagguagaggacucugaaauuagccacaugaaaguuuaaaagcacguggaacacuuuugcuauuucuuaaguuuguggaagagagaacuguggcuucuaagugucccuucacuuugcucagucacccuaguuaaugucccuaggaaccauccccuaacacacaggagccugcccucuguuguacuaugcuagcguguuugcacagagcagggagugaaaaguccucuuaacugagaaggaugccggaguccacugcugagaagccauacccuguccuuugcagccuugcccuccagccucaucucuagucucucacagagacuugcucuuucugagggaauuccuagagguugaagccaucagguggcucacagugcuuguaauccuaaauccagaagauaaaagccuuguggccucuguggguacuuguagugauauguauauacucucucucacacauaauucaaaauaaugaaaauaaucauuuuuaaagaagaucuguucuuagaaaggacuuaacagaaagaauggucuacccagucauugcugaaaagauguguggucacauaucuuuuacuucagucagccauaguugcacauaccuuuaaacccagcaacugggaggcagaggcagggaggucucuugaguuugaggccagccugguccacagaguggguuccaguacagccagagcuacauggugagacccagucucuaaauaaauaaauaaauaaauaaauaaauaaucagucuuucacuuugauaguugaaagucagcugagagaauggcaggcuaucccuagaaaauauacagaucuccuuccaguguguuagaaaguuggguuaggaucagcaccccguggcagcugucgcuccucucaccaggguuuugaguggcacagcuguagcuuuguucuguuggguaaaacuugggacacucacucucacggucaguaggccaugguggggcaguguucauucuucuagggcucagggguaaugccuacugaagcaggugcuaaaccaggcugaagggaugcacauuaaccuuagagccacuagggagccauagugggaccuggagaggaaggcggucgcugcuguaagucuggaauggaguguggagcaauggaguccguaguuauuacaggggcagcuuagagaagagagggagagguggcuccagccugcaguuaacagucccuccuuuccucuucccugcuccuucuuacccucuccaggagcagcccugggguagcugcacagcgguuuuaauuacuuguuaauuaacuaaauuauuaauuguuugguuuggguaaaugauuguuggagguuugaggacagucagaauugacaucaugagcucagggaacacagagacaguguugacaggcugcucuaccccugccuccucaggcacucauuaggauuacgguaaaaauuuucuaaucagcuggccauacuguugagucugcccuuagugccucugacaaguuuguugguguaaugauucucccuuucuucaaaggccagugggccagaugucuauagccuguuuccacaccuucgccgauuagaacaaacuuucugcacaguggccuuagccuaggccucaacucuagacuauacgguaguccauggucagccuugcaugccaaguacagcacagugcccuacucagcagggccaucggguccucuuguagccagagcucggggaaggcagggagugugagcaggauggugggcagcgugaguuuccagagcaucacacagccccugccuauguuuucugugggucucccuugcuuuccuucucacgacgcucuguauuauaaacauuuauuauuauaacaaccacuaccuuggugguuguuauaauaggcacauaauaacaauccauaauuucuuguuaacggauuacauuuuuaauggcuuuuuuucuguguaugaacgcuuugucucuguauaugaaucacagguuugccugguucccauagaguacagaaggagggaugcagguccucuggagcugcauuuaccucuacaagaacaauaaaugcucuuagccccugcgccaccucuccggucuugguacuaggaguuuuaagaguagcccuuucuucucuaaaugugaacgggacuucauuugcuuaacuugaauuuuuggugaaaauauucaaaguaagccauuccucacgugcuuuuuucucccgugccagcaggcugcacagauaccugacucugggcucucaggaagacucaggcagagauggggagucggccugcaagcugggacgcuagagcucacgugcaguucuccauuuagcuaggagguuuccagggcaaccaccgaagcaguaauuaaagaugaagagcuaaaagguaaguacuuccaaaccugaauccugaaggaggugguccgcaggcuggugucacagugugcacucuuauucacuuaacauuaaguaaauaauuuuuuaaauacauuuuugaaaaccucugaugagaggauacacacuaaauuaggauguucaugcucugcuuugauuuguaucuuuucacgcgcgcacguauucuuguauguacguacacaccacacacacacacacacauuuuuaugcuuccaccagccagucaugggaccaggcauugggauaccagggcuuaaggugucuuucggguuccuguuuugaacguccuagcaugcauguauauauauauacauacauacauauauauauauacacauuuaaggcaugcaaacgagcaacugcagaggcgucuacaguacuuagcguguagcaggaacauccaggcucuccaggcaguucacgggugcuuacacagccugacgaggugcucgccgugccgccauccuuuccuugagcgaacuguacccuggguuaugaaccuuguuugccugauaguucagggcaucagugcaguaacagggcugaugagagagagcuccaccaaagcagcagcgccauugagaagguagaagacagcuauuuuaacggaagcuucagaagcucaugagucuauucccaggaguauggguaaaguuugcucaugcaaaugcugcauuucaugaguccauggguuaaagcaguuacggacccuggaagaugggagauacuuacaaaaagcaaagcccagaucuccacaccuucaaagagaagaugcucaaaucuccaauuuucagaccagugcuuuuuucaguuaugcacugguauauggcugaaacuguagguggcaugggagacuuugguaaguguaggcccuaggauaucugucccaccauuuucccuguaacaaaaguaaggaaucuguaagaaagaaaaaaauaac

SEQ ID NO: 2889 - RNA, 791 nt, Mus musculus
cagucaaccaucaacacggcuccugaaguggaccaggggauaccagaccuagagagguucaacuagcuggaucagcagguguuuauuacaagaaugggugaguugaguuacugucacuucucgaucagucuaaaucaccccucuaacuucaaagaaaauggaaaggaaaacuacuugucuguuucugugacacacaaggucaaguucuuguucugccccuauuuuaaaggguugcuucuggcugugccauccagucugggugaccauuccacacagagaccucaacccuuaugucuaacaaugaacuuccaacuaagucacucacucucccugggcucugagaacagcacaaaagccccaaaugugaacaaaggacucgugugcacuggaguugcugagcccuuuacagccacuguuugcuuuaggccucuaccaccuaggacaagguaccgcuuccuguuggcacacgccggaugcagauccuuucaaggucuagggcagcagagaaccuuuuucgaaguuaaacaauggugcgugucagcgccaggaucugaagcugagcagggcucuacugcagcaaacaccagaugacagagcgucuccaccugacccacgcgcucagacuaugugagaggaaagccuggaccugcuuuucuuccucacaggugugucgugcgcggccgugaaagccagagaucagccucuaguguccuuccucgauuaccaaccaccgugguuuuggggguuuguuuguuuuuaaaauaaagucuuuuauugguguggagcuuaau

SEQ ID NO: 2890 - RNA, 113534 nt, Mus musculus
aagcagccagugccggcccugcgcggucggguucccggcgcggccccuuuaagagcaggccccguccccgcccuccuccuggcggggcuggcgcucggugguggccgcuacggugcugacaagauggcggcuggcggggcuguugcuguggcgccggagugccggcuucugcccuacgcgcugcauaaguggagcuccuucuccuccaccuaccuucccgaguaagugcggggccccgcgcucgagcugucggagccgcucggugagagcgcggcccgccagagcgugcgguguggggagcggagccgagagaggcccaggcggggccugugacggggaacgcgcggccuccggagcuucucagugcggcggccgagugcuccggccuggcgggccgaggccgggcugagggcccgggagcgagcuccggguggcggcggcgaggcgggcuugcgcagcgggaggugaggcggagcggagcggggcuccgggcccgggccgcgggcgagccucccccgccgucggagguggucagggcgacgacgggggcccgguccuucccggacggcucggacagcgccggaguuccugagcccgcaguaaaagugcuuagcucugcacgaguggcgagagaaguuggggaguccauccgcacccuggcgagaacuuggaggacuggcagaggggugucuuggcuuuuuuuggacgggggggggggcuggaaguucugaaaaagauagggaaggagggcaggucugggggcgugcggcuugcccgagggcaccaccaagucagcagaaauggccuuaggaacacaacgaggaacgggugcaguuuuccguugcuauucgaauaaaauugcuacaucuccggaguguccugaacagggaguguguuccauucguauuuuuaaaauuccucccguuuguucagauuggauuucucgaguccagucggucaggacucuggaaguugaagcugcgggugaagagucagccuccgcggacugcccaccugcccuccuccuagucaccaggucaaggguuggcacugaagccuuguagcucccgcccaaugaaggcugaccuguggucugaucuggccgguuguggccuguugauagcugguacauggccacaucucugauugauauuggaacccagcuuuuaauuugagggugagcuggauaagcaccgaccuucauuugaaguggacuuguggcuguucauucuguaaaccucuguuuuuuuguuuuuuguuuuuguuuuuuuuugguaguuuuuucuuuuggaggugugugugugguuguuuguuuuggaggccuuuuuaagguuguuuguuuugacugacuccuuugaaucugaagauaacauuuuuuuuugugucuagguuagagaguugguggugugucacuaacuaccucgaaugacuuuuuccacccccaggucuuugguuagauaacuuacacuuuagguugucugccaucgcuuuaccuucugguguaggcaugagacugggauagcccaaaucccaguugcauuaccuguuguaugggcauguuaaggagagaggcauuucuaaaaggagucuugaucuggugggauagugguuuuagucagccuccaguuuggaguggggacagcaccugcuguuccaguuggacugcagcuggaagaagccauugcuauagcuuccuuaaggccacagagaaaacaguuuauuugcacuuaguacuugcacuuaguguaucuuguuuaaccacaaagacauuucaaacauauaguauaguuuuaauuuuaaagcccuuuagaguuaagcaguccggagugaaggagugcagaugagcauuaggaagcuuggguuugagaacuuuguuaggcaggcuggugugugucugccuuaguuguaaaauucuugguucugaacuuagguuagcaaguauacgucuuuguaugacaggaaguuuaagaaagagauugguuuccccgcccccuaaaaugaccucuaauggggugaaacaguggaagguauuaugaaaugucucaagcaggugugauuuuuuuuuaaggucuagccagcuauuuguugaaauuguucagcaaagaacaaauauuuauugauagaaaucuaggcauuuuggggugaugguaauaauuacaaaaaauggcaauuacuuaugccuuucacaugcuaaucuuuaugaauacuucaaguguuuuagcucauuuaaaccuuaacagucuucuaaagaaucccaaaaaacugggcaugguguugggccuggauggagaugccuguaaugcaagcccuuaggaagcagaagcaggagaaugacaaguguaaggcauccugggcgacauaguaaaguaaggccagccugggcugugagaucuguguugucaccugugaccucagaucuccauuuuccagaugagcaaacagggaugagagguucaaauuugccucuggucauccaccuaggugaggacagagcugaauccagaggaccugcuccacaguucuccacccagugugcuuucuugacugcuuuugucugaggguuuguagagauuagaggggauucuguuaaaggcgcuuguguuaaguuguuuauagacacauaccggcuggagagaguuugugaacaagcuugaggaccugaguucaaaugcuaacauagacagucuucagucuuguauggugcacuugugaccccauugcucuuggugggguagagacgggaggaucccuggggcuaacuggguaccagcuucuagguucagcgagaaaaggaacaaggcagagagugauagaguaggcuacccuggguccuccucuggccucucgggugcacaaacacaguuaucucuguacacauaggugcauauauacuacauauggcuagaacccucccucccacccccaugaagucaugaaaaggauuucaaucucagauuucuuucuaggacuucuauuuuuuuucuaaugcaaaaaaaacuauuuggaccuuaaaauguuaaaacaggucuaguuaaagaucacacuuuuuuuuuuaaguuuaaugcuaacacauuggccuuuuauuuuucaguguguuuaaauggaucuuccuuuauuuuacuuuuucuucugaaauguauuccuaauuuuggaauuaagagagguacauguaagugacacaugauaugauaacauacuacauguaaaaccauuuuauaaaucauugaucuguauucuugacuguuuauuguuguagguuauagcgaugcuggugauaguuuguuggguguuugguguuccugagcugcuuuguucauauaguguuuuuauucuuaagcucagugugcagugagcuuccuauguucugcagcugaggaagcugaggucaauauguauggacuugcccacagcauacagcuuuccaggggccucuuacacguucuuauuuuaaaacaacuccaccaauaacaagcaauuauuaagugucuucuguucucagauuguucugugcaauuagauauguuuaguauucgccccaacuccaguaugagugugauauuauauuuuacagcuagggaauggaagauuuagagagguuaacuaguuuaggucuggggucuaagagcauuggagagaggacucuggucccgggcuuucugacuucccuucacaagcuccgugagcugcuucacugugugauauggcugcucugugcuuacagacaggauuugcuugggucacuucuccagcucugcacucuguagcacacagcuuggcuucuaggcucaucuaccuccgcuccauugcucuuguugaucuugguggacaucccaugguacuggcaucuccaaaacugcuggggucuugcugcaacuagacuacacuuuaacaacuagccucucauaggcucucuucauggugccaagccucagcugcucucaugaccccuucaugucuucaaucuagggucuagggugacucuuacacagucuggccaccaacaugagauucuuccuuggcugucucuggaacacagcuucuuuguucucucagaaauuacuucccagaagauuucacucacugaugcuggucuuuucuuaaucaccgcuaauuucuuagcuccagcuaaccagcaucacuugucccugugugugcuaggcaaguccucuuucauugagcuacaucccugguuuuauugguuguuaauauuuucuuucuuucucucucucucucucucuuuuauaacagagagguguaccucgguaauucugugguuaugaaucugaauuuuuccuuuuaguucuuuaagaacuguauguuuugaagucauuacuagauguauacagacuuacagcuuuaucauucuaguaaauugggccuuugaaaguuauaauaugucccuuuuuaucucuaauaauaacaugugcuucuugccuuuaccaucuacuugguguaguucugucuuccuuacuugagcuacuuuuuguugguuguagccuuugcuuaguuuuuccuugcuggugcuggugauuggaacccaagaccuuaugcauguuagacaguacuugucuagcccucuuacugugcauguuuugugauggcauauuugagaucuguuucuuuuucacaacauauggauuuguuaaaauuaaguuccuuuauucauuuagagagagagggugaaugagagagggaggaagggagaaggagauguuuggagguuagaggacagauuucaggaguugguucauuucauccacuguauagauuccggggauucaaaucaagcuucaggcuugguggcaaguaccuccugagcuagcuugcugccccaagauuugaguauuuugcuauuaaauuagaguuagcucaaauuuuuuucccuucagcauauuaaaaaaauauugcaugccuuucugugauugcagaccugugucuaucuuacacugauuuaggcaucugcuuacuagcaguuacuuaguuguauuuuacuuuugguuuuguugaucuauaaaucucuuuuaagacuuguuuuuuuguaagguguagaauugauaauuuaauuuuguuauaugguauuuuccauuccuguaauaugauuuuauauuacuuaugcuuuuacuaaaacauuugugggaaucuauuuauguuaaggcauguuuagaggagagauaauuggguuuagugucagucuuuuggcuuaugacuguuagugauuaauacuuuaagaauauucuuggccaggcagugguggcgcacgccuuuaaucccagcacuugggagcagaggcagguggauuucugaguucgaggccagccuggucuacagagugaguuccaggacagauaggacuacacagaagcccugucucaggaaaaaaaaaaaaaaaaaaaaaaaaagaauauccuuauaucacuuuacuaugacucguauaucuuauuauuauuaagauuaugacugugguggucuuaauaagaauggcccccauaggcucauauauuugaauguuugguucccaguuagugaauuauauaggaagaauuaggagguguggccuuguuggaggagguuugucacuggggaugggcuuccauggcaggcccaguuucugucuaugucuaucucucccucuccuccuuucccccacgauccucuucccucuuccccucucucccucucugcuugucucccucucucccucugccacuuuccuucucucccucugugccuccaacuuguaagcucucagcuacugcuccaguacccugugugccugccugcugccaugcucccuguuauugauggucaugaacucaccucugaaacuguaaguaagcccccgauuagauucuuucuuuaucaguugccuuggucauggugucucuucacugcaauagaaaaguaacauagauggguccuuacuauuaucaccuauguuuguuguaaaacaaauggacuuagaugaagaaaacugcacauuuacuuguaacagcuuuaugugcccccuuccuuuuccuuucauuguccacuucccccucccauuugguuuagguaguuuccauuagaagagucauaagacuuaacuccuauucuucaaaugucacuugaaauacuauuuuacuaggacacuuugugugccccagucuuccuccguaaggcuggcaucuaucccccaccucugugguugaauacuugaauauaugccugucugguaugucacauguuacaguuuuagcuauguuccuauuuauaugguugcuugcuuuauagcuauuucugucaacuggaucaugaacuccauaaagaauauguagcaaccccccaucauuguaucugagcauaauguuuauuaaugaauagauaagagaauuaacuagcuauuuuaacuauauuucucuuuaaguguuauuuugguucagggguggaauaucauguugacuuguucaaaauagaaaauaauuuauuuuaaaugucuuaagugguuuucaacaaagguugagaguaucuuaaacaaaaaaggauauacuauuuggaaggacuugggauaguguuucuaaucugugucuuugagacauuuauuaugaaguuauuuaagauuuuauagguauuucuaauaagaucuuuauuucuaguucaguuuaauguaaaauuugauuugccaaauaacugaauaauuuagaggauuauuuccagcauuuugauuacuuuuaggauaugguuucuuuugguuccuugauuauaaguguuuuuaguuuuuuuuuuuaauguaaucuugcuauuaacauauaauuuauguacaguacauuuuagcuacuuaaaccaagucaaugagguguaguauagggagagauaagugugacugugacuguagucauguuacgccuuuuuguagucuguagagagcagugccccuuagccacccuucucucugcaagcacuugcugcagugucugucucugaagguugucuguuccaggucuuucgcauagaugggauaaugaaaggcauucuuuccugggauccuguuuuuaaagaucacaguacuauagcaugugucagugccauguguguuuucugacugguaauaugaauguguauagagguaucacaguuuguguauucauuaguugauaggcauuuggacuauauauacauuaugaacaauguuucuguaaacauuguuuaugggaguguaauguuuucauuucuuuugcauguguguuuagagauagaauuuuuggauuuaacuauuugagggacugucaaauuuuuuuguuuuguuuuguuuuuuggucaguucucuuuuuucuuuuguuauuaaagaagugccuuaaaaacuacuuaauauaacuuuauaaacaaaagcucuauauugaaaugaccauaugagauugcuguuaacuuaauugcacuacuuuuugugacagguuagucuuuuaucauccuuuauuuuuguugagugugugaaugugagugugugggaguauguauaugugauuguguaaguauuagugugugagugugugugugugaauggauaugagagugugguugugugugugaguguauaugagugugugcuccauacuuucauccuugaagaucucccuauuaaugugcauauuuuucacauauuagugcugagaaauugguugaagauuggcuuuuagaauuauauuauuuaagacuguggcacacaccuuuauuuccagcacucaggaggcagaggcagguggacuuccaaauuugaagccagcuuggucuauauagcaaguucuaugccagucuaaaaaacaauacccugucucaagacaaacuauauuguuuauauauaaaauaugaguaagauauuucugaaagaguugaaaguuguuuaugaacucauuccucauauaaacugaggcauacguuuuuaaaguguugaaaauaacuucuaauuucucccagagcuuagaauuugggguaguugaaaauucauacaucuaggucuuuggcauuuguugaaugaagccuugauuuuucaacaggcuguaauacucuggaugauaaauuuaaagacagaguuaaaaaaauauuuucuuccuauauuauagcauuugaguugcaauuagagcuuuucagauuucuggcuaucuuuaccacaaaguauaggguauugacuugugcuuaauucucgggccuguuuaagguaaggggugagauuaucugacuaugcuguagucaucguuguucaguagaguggcugaguugaagauacuaaaggcuaaguuuagaauuucaguuagaguagcauuaguaagcucuuacuuuuauuuugcacucuaguuauauagugaaaggagugucacagcaaguauaauaacauugcagaaaagaaugcugaacuaugaagauggcagccucgggaaacuaagauuuuuaccagaggguuucaggucuuuaugucucagacagagaauugaacaggacaugaaaagggagagguaaaaguauacauuuauuagaagugagaguaagagcguagagugcacuccacagaauggaagcaggaucaagcaagccugggacucaagagcugggaguucuuuucaugaauguagguggagggaggagacaaccucuagggagugaauucuuaccuagauuggcaaacgagcugcuguguaaguuugguugaucugcauauaauugugcuauauauaucccuuaauuguaagcuuauggaugucuuaucuugagugugcaagacgguaaacaggaguuuuuccugacaccugucauaaggauagguuggcauuggcugugcuugauuccaaugucagucuaagcuggcuuuuaaagaauucuuucuaucauaaugugcuauccauaaauuaccuacugaagaggaggugccaggaguugccuuacugagaagggacagacacgaauauauuucaugaacaggugcuauaagucacugggcugucuuagucuugggugucuuaaaauauuggccagcuuguuagcaccauccuagcauauaugccuugaacuguucuuauuuaaaguuguauuuuuauuuaugccucuguguguucaugaaugugugacaccuauguucuggugcuggcacuguuagaacacggacgagggccucagauccuuaggagcuggaguugcagggagucuuaugucaccagacaugagugcaggaaaaugagcaagcacauuuuagucucagagccaucuuucuagucuuuaaacuauuauuuuauuugcugguagaaagacuaauggcucagcugucugaaaguugaacaaggaugcugguuaugacuucaaagucaucucgaaauugcucacauucuauauaauuugaagauaaguaaagcccucugaauuuauguacauuaucuauaacaugaauaugacccucuuagugauugaugcagaaagcaugaacauuuuagaugcauaaggaaauuacuugccugucuuuuaaaggguuguugcaauaaacuaauugaaaaagaggcccacuauuuuauuaauaugcaaaagggaaaagucaaauuuugggggaaaaccauugcguacuuacuaccccagcauaauauauguacuccuuuuguauagaggagaaggaaaugggagagugucauucauuuuaggaaaguaguaaugcuuuuuaguggaacucaaugggcuuggagaacauacuguggcuuguaguaugucugcugggccuacagaacagaugacagugguuuguaaauuauucuuuaugggauugaaauagaagauaagugguguuuggaaaaaguguggcuagguacauggacagaguucagucuuugucccugugauaagaauuuaaucuucucuaauuagugagauuucagugagagacugaaggcaauuguguuccccuuuggcagguccagucaggauaggaagcucguggauauggcagaaagccucucugugugcugggaaggguaaacuaacguccgagggaccuugagucugaaaugugcucuguugccuucuagccugauaccucaucuucaggcuguuaguucucagccccaacacagugaaguagcucugccaaccugugaauaugaucuaguugugacucguuuaauuuuacaugaacagauuuguagaaugacuuuaauagcauauuauucaaugacuugguucggaaacauuuguggagauacuguauacaggggugggugagauggauggcucaguggguaaaaguaccugcuacacaagcccauggccuguguuugauccaaagaauccaugaaaggagaggacuggcucuccacaguuguccucugaccugcacacacaaguuauggcacaucauguuucuccaucaugcaugcaugcauguacaugcacauaaauacauacuaauuauaaguaaaaaaaaugcuuuagaagauaacagauaagucuagcucuugaaauuuuacuugaaaucuaucacaaaagguuuuaugguugguggacuccccuguguuaaaguuuaguauaugguauugaaaauuuaaacaguuuuaagauaagaauaguuaauauaguuuguaacaugcuugugaauacuuuggaguauuucugaggacuaacacugaauaauacuuuccaauaugugugauaggacuuuggucuuggucaaagauacugucagcagaguguguuuucagugagugaguagcuuggguuugguguaaauuugcuuggccucucucucagugcagguuaaguuagugggcuccacugagggaggacaucagcucuagaaugaaggagagguacagugggaagugcggugugauaggacacugaacaaggagguauucugguccaguccugguguugacaauucuacaugagucuguucucaaggauuuucucuauucucauacaaugugagcgguuuaagaguugauggacuuuuggaaagggaugccauaaaguugauaaaccagaaaaagugucuguguuucagguuagcauauacuguuauggguuucauuuuggcuucugcaugcaugugugucauuagacuuuucuuuacauuuguucccccucacuccccuuuccuggacucugucugguugcuaccuuuuuuccaguuagccuuacuucugcauccuuguuauaacucauuucccucucuguaucauaucguuuaagauguuuuagaauacauuuuaaaagucaggcauccuaucccaguaacacaguaaauugaaugauugcccagaaaagauaguuugaggauuugaucaggucagaauuugauucugauucccuuaguaaggacaucuacauauaaaugaaccuugcagggagacuggaaauaguuugaucucuuaaauauguauaaacccuuuguauauacuguuguuuagucuaauacaaaugaauguguaucuaaaagcuguaaaccuuuccuaagucuuuuccacuuuuaaugcuuuuugcuuuagguugaagcagggcaauucuuaguauaggaauauauaugagacaacuuuucaguuugaguuuugaccacugaguuucccagucugucaccugcauuggaaugccuauuuucugucguuggcaugcuuuccccaguggugacucuguuugcuuguguggaguauguaugcaugguuguguccccagagugcuuugaauccuuaugcaggcucaaacaugaucaauuccauggugacaauaagcugagucaauuuuuccuuguacuacagugaccuucuauuugcauuccaaaauguccagucucuauuuacacuuaccuauuucucuucuuauauuuccuaaauuaaguuguuucacuccuaaauauuucaauaugaaugaagggcacaccacguuaauuaucuguugccucaguaacagucugccacaaauuacagcuuaaaacaauacauuuauuaaaugauacuuaaguaucaaggguuugggcaugauuuagaagggucuucagcuccaagucucuuacaggacuucagucauguucugcuucgccagagcuagcuagggagaaucaguaagagcuaaaucacuuuuauguaucuagggcuuagaaauggcacuacauugccauuucuuuguauuguuguuugaaauaaguuuaggccauccuacaguagagauaggucauaugaaggcgugaauaaccacgaagacuaaaucauuugaagccuucagaaucgcucugcuagagauuagucuccuuauaggcuucacugaagacucauguaauuucauauaaauauauaaaauaaaugaaaaguuuugccugccuguauguauguguaccaugcugcuugucuguggaggugggaagagggucucugauccccuagagcugaaguuaugcaugguugugaggcacuuuguaggggcuugggaaccaaccuggguccucuccaagagccacauguacuuuuaucuuagccaucugccagccccugugguuucagaguuuaagcuguacagcuuagcuucguaucuguccuuuagcccuuuuauuccuucuaauuugaguagccauuuuuauuaguuuuugguugaagcaaauaaaagcaauuaauguguuuaucuguuccuuaaguauaguaugguuuggucuuuaucaauugaaggauaucuggauugcuuccaguuugggauuauuagaaguaaggcaauuuugaacauuuguauguagguuuuuauuugcauauaaaauguuauuucccuugaaucaguguuuaagagucuaguuuuauguuguuguuguuguuggguuuuuuguuuauuuuguuguuguuguuuuuugguuuguuuuuuggguuuucuagacaggauuuuucaauguagccuauggccucaaacuuguagagauccaccugccucuaccucccagugcugggacuaaaggcauguggcaccacugcccggcgaguuuaguuacugaaucacacaaaaaauacuuaagaaacuauaauauacaccuaaaauggcuguaccauuuuacacucacauuaggguacagguauuccauuuucucuuguguguguguguguguguguguguguguguguguguguguguaacauguaagaguuaguucucuccuaauaugugggucuuggggauugaauucaggucauuagccauugagccauugucaucugaaguuucucugaguugguaauagccuuugagccaucacuguguuuuaauuuuagcuguucugauaggcaaguaaugaugacuggugguggauguuugugauggcuauugguguugcacauguuuucauaugcuuaucugccuccuuggauaugcuuaaugaguucuuauucaugccuugccuguuuucuaauugaauuguuugcuuuuuuucaaagccuaaucauuguaaauacuuguauuauuuuagauaucauuuuuugaacauaaaauagguucuuccaggcuguaucuucucauuuuaccuuuuaacagaguccuuaccagaacaagauuuuaauuauuucuguagccugauuuuugcuuuuauagauuagugaguuuuguguaggaacuugccuaggauuuagagaaaggauaauuguauauuguggguagugauaugagaaagucagucagucagucagucagucagucagucaguaagaacacguguagcugcuauagaaacaguacagaggccucucaaaaaccuuuaugacccagcagcccuacuccuggguauauaaaagucauugcaucaaagagauacccacaccccugcuuauugcagcacuagucacaggaaccagaauuauagagucagccaagauguccaucaguagaugaauggauuuuaaaaacugugugggaacagacauggcucagugguuaagaacauuugcugcucuugcauaggacuggaguuugauugacaggugguucacagucaucuagaacuccagacucagggcuuuugugcccucuucuggccuccaaggcauacacacaaauggcauucauauauacaggcaugcauguauacacacagauuuuguuuucaaagauuguguguguguguuuaugugugguguauguguguccaugaauauaugugugugacagagcagggguuaggaagaauacuguuuaaccauaacaaggaugcaauccugccgaugcaugacugaaacuucagggcauuauguuaaguaaaguaaauuaaguauagagagacaaauauugcagaagcuaaagacauuaaucacauaauaguagauguacaauagcacuuaguagaagcuaggaagggaaagcagucacaggguaagauaagcaguacgcagauacaauugcuauaguucucuuauguuacaaaguuggggaacuaauccagagccauuaguuguacauuucacaauaacuagaggaagauuugaguucccagaaucauagggaguugauauuugagggaugggaguucugaguacucugguuuggccauuauacauuguauuugcacagaaauuugauuuguaauguggucacauaagugaguauaaauguuauauguuaauuaaaaaaauagaaaccagggagcuggagagauggcucaauaguuagaaagaguguuugacauucucagagccuguaacuccagcuccagagaaucugacauccucuuuggucucugcagacucuuagacauacauacaggcaggcaggcaggcaggcaugcacgcacgcacgcacaugggcacacacacacacacacacacacacacacacacacacacacacacacacacucucucucucucucucucucucucucucuuucucucucucucucucucacacacacacacacacacucucacagcauacucucccuaaugagcccucccuuccuuggagcuuauuuuccuguuuccacuguugcuggaaagaaguggcagggacugggggccuaggaaauagguugggcauugaagccaggaauggaagccacucugcugguggcaauggaacuccuguuauuuccuagcugcugccagccaggccacuauugccuccuugucaagguuguccagcacccugacucugagcaagaaaggacagcuaaacccacaaaaccccaaacugccaugcuuggugaucuguaaguucuguuuuacauuuguuuguuuguuuuguuuuucccuuccucuugcuuacccuagcuagagguuugccguuuuuuuuguuuguuuguuuguuuuguuuuuaaggacucaaucucuggcuucauucuuuuuccuaguucucauuuuuaguuugauuucuacuguaauuuuugcuuuacuuuuuauuuauugugauauucaugguuacauuucuuuuuuuguccuagcuccuuaggguggaagcuuaggugauugauuuuacaauuuuccuaauuuccuuguacguauuuaacacgucugcuaaguguuauuuuuaugguauugcaccguuuccguaaguuucguucuuuuuaaaaaaaaauuagucuaguucgauuuauuucuguguuuacccugaggcuuccuugauuuguguauuauauggaacuguguuguauaugcuaacuauuuuaagauuuuucuaacugucuuguaugaaugauucuaauuuaaucccauugaggucugugagcuguuccuguuacugacacguuuuccugugguagugagugcuccugugugaguugaggagaaugcucuuugcuguuggugaguguucuguguaugucaguuacauccaguugauugauagugcuuuuuagcucauugguguucugaguuucugccuccugaaucugucaguugcucaaagugagaggcugggaaucugcaauuauaauagugcuucuugcaauucugacaauuuuuuccucaaguauuuugacacuuuuuuuuguuugguacagucacauuaagaguugugucuucuugaggaauugacacauuucaucaaugccccucugucccuaaugauuuccccuucuuaaguaagccugauuuggaucuggcuggucugccuucuauuuaaaacaugcugcaucuucaucuguuuuuuuuucacauucacauguccuuuauuuauuuauuuauuuauuucauuuuuuuucgauuuuucauuagauauuuucuucauuuacauuucaaaugcuaucccgaaaguccccuauacccucucccugcccugcuccccauguccuuuauuuuuauguggguuucucauaggugauguauuugagcaguuguuuuucucauccauuccaauauucucuuuaaguugguuuauuucagccauuuacuuacaaacugauuauugauauaauuggauugauaucugccauauguaaaacuguuuuccauuucauacacuuguuucuugcaucuuuuuuuuuucuaucucugauuugaaaugagccuccagugugacuuuauuuucuuuuacauauuaauugcauuucucuuaaacucuuuagugcuuguguuaauacaagaguauauuuuguacacgucuagagggcuagaguccacaauggcugggacugccuggaagcagguggcagggacaggaagcugaaaacucauaccuugaacuguaagcuugaaacugggagagcaacuagaagcaggcaaggcuuuuuauucucauagccguccuccagugacacacuucccccaggaaggcugcaccaccuaaacugccucaaauagugccguccacuggggcugggcugaaaugcccgagacgguagauuuagauuuucucauccaaaccaucacacugcuuagccuaaaguuuguuaaauacguuuauaacuaaucuaacucuagcuuuaaauaauaguaaacugcuuaugagugguauugacacugauuuucagaauauauuuuauuccuuucuuguuugacuguaccagagggccauagauuaggugguuuguaauaggaaauguauuggauuacaguuuuagaagcugagcuauucaagauucaggaauuaacaucugggaaaaagaucuuuugugggaagcaucccauggcagaaggguagggaaggaagugagggugacagagaacucuccuuauccuuccugaaugagcucagucuugguaugcaggauaugugacaagaucaaaacagucaggcgucuacuuuaccacugcucaucuugggaaguuccccgaaccaaaaaugauauugauucuuugguaguuucauaccugugugcauugaucuuacacaccccaacaugccaacaugcucccaacauguucucuucccaucuuuauaccuucuccuuuuuaaagaaacaaaacaaaacaacaacaacaacaacgaaacccuuacugaguccagguaguaguaccaacuagaauauggacugaugugcuugauucugugcagauaaucagguaaucaucauugcagugaguucauggguguagcagccaugucaugcccagcagacugcauuucacagguuuccaccccauccuucaacuuguacauucuuucuacccuuucuuuacuguguugcuggagcuuggcagagaggggaauaguugucccacuugaauacuugacagucacuuuuucucaguacuuugaccuaguuaugaaucuuugaauuaauuguugcuuccuauagaaucagcuucucuggucaggguugagagcaacacucaucugugggcauaagccaauaucuagaaggcauuuugguauggguugccccaccccucacagccacccccauggccugugaccuccagaucccuggauuuuugaccagguuuacagugccagucagggcuuagagccaaccagaaagugguugguuauuccauaaucuucacuccaucacuguacuccaucacuguaagaaguggugggcacuucuuaccuagugcguuaguauugucauguccaggauucauugcugggucaucccauugaugacuugccuugccuaccugccuguguagcaccuuucagcauuacggacauuagcugucugugaggaaguuuuucaggucaauuccgguuggauuucuguaugcccuacaaucagaaugugugcugaggagcaguggaucuaguucuugugggcaugaagagcaguggcaauauuguuugagggggcauaugggacauuuuugauguauaacuuauaaggaaguaucccacuccugcuacuaagauuuucauuuaauaacccaugucuucugaggaaauuauugcucacccacacagggaacuguguucaaauaccuuuaccuucuuuuuaauagcucacaaaguaguggaggaucuuuaauacauccuuaguuuugauggugcuugucucuucuccauccacccacuaugccugccccacuuaaaccuccaaccccgaguauucccccucuacuuucaaaucacaaaucaagauuggauuucuuuccccuccccuuucaauacuugaaauaguuccuuuauuugccuguggaguuuuugaugagaaguuuaauguaauucuaaucuuuguuucucuguaguggacuuuuccccacucuuugugauuuuuuuucccccaugacuuucucugugguuuucuacuguuugaauauacugugccuaugugcuaguuuuugucagcuuauuaaggaguugccccuaucaaauuggacuguggacaugucuguggagcauuuucuugauuagugauugauugccaccauaggcaagugguccugaguuguauaaaaagccaauaagcugagcaagcuauggggaacaagccgguaugcagauuuccuccgugguucuugccucugcccuugcuugcguucuuagucugacacggagcuguucacuccaccccuccccuguuuggauuugguauaguuuuuaucauaacaguagagaaacuuaaccaguauagucuagauauacauuuucuucccuuguuuucuuucuauuguuguuguuguuguugucgucguauuuguuucuugguuuugucuuaacuuccuggauagaugguuugauaucauuacuggcuuccaaaaauccucagucacugcauugccuugcguguuucuccuguugcuguuuucuuucagugcagcugugcguaugucauagcucuuugauuucuugcagccauuggacacccccacucucucuuuuccccucuuuucagccugggauuuuucuguagaauauuuccauaauguuaccuaucuauccuauguauuaucuacuuauuucuuuagaacucuuaaagugauaaccauaguuauuuaaagacauuucguaucuaguaauucuaaaaucuguaccucugagacugguucuaauauguugucuauucaaacuuagggaaaaaaagaucuuuuagggccuuucccuucuccacucccccucuccccugcuucccuuugacguccucgucucgcaguucuugugcagccccuuguauugagauuacagguguuugcuugauacuguguucaagucuagcgugcuuucugauugugaguucaucaguaacugucgauccaguucuuuuuuuauaacauggcaucccaaggaguuaaccuauaaccucuguacaguugucugucuuccuaagguugugguccuucauguggggugcugggaauugaacacggguucucugcaaaaacaaggucuuuuagccacugagccaucucuccagcccugcuuguuuuucaguugauaguguuuggaaguauacuagucauauauuuuauuuaaaguuucacaguuuggguguguguguguguguuuguuuguuugugguugugcugggauuguugguggcaguauggacucugguuacuauuuuauacuuccuguuacaagcuccugcuacagccuuuauuuuguuucuauucuuuuccagcuucucucauaccucuagguuggcuccuucuuggcccagcauucuuuuuaaugcuuuuuaaaacuuauauuaauuuagagguuuucugugcuuuuuuucaugguuauauacuauucucuuucaaaccguaaacauuguauaacuuugugguaguuccaguaauuuuauaaugguggauuauuucccuuuuuugacuuuaacuaaucacuucaguuuucuuucuuuuuuuaauucuaggaacauuuuaguggauaaaccaaaugaucagucuuccagauggucuucagagagcaacuauccuccccaaguaagauugcaugcagcgccggggacuauuagaaguuggcauggauggguacuuacucaauugcuaucaauuguguagaauccauugagaguucauuuuugucuucaggauugugagcuacaucuucuuuuuggucuguuaaauuuuuauuuuauagguaaagacaaugugggauuugaugagacacuuuuacuuccuauugacauuuuaaauuuuaauuuauauuuuuaauguaucaauaaggaugcaaaauuaaguuguuuuuguuuuguucugaaaaaaaacaacaacuuaugaauaaaauguuagacaaggacuugagugcuguucugcucuaagccagguuguguucccauucuguuaugcucaaaucauucuguaaauguuaguaaguugaacuuugaaugcgggggcuuuucagaaaagucaacauaguuuguuacauuguuauuguaaucuuuuaaaaauuauguuuacuuauguaugcauguguugagcgugggugaguaugugcgugugaagaugcaaagaugauuuaugggagucuguccuuccaucauaugaguuucacauguacccucaccugcuaagcugucgugcuggcuuggugugcuauguuaagaugguauauacagaagguguuacggccaggcacuaaauacuccuuuuuccugguaagcagugcugcuacuaaauaaaucauucuuuaauuuuacaugcuuaggguguaguagguacauucauaaugucuggauccuugaaggugucaaaaaguagauggguaagcaaacaauauaguagaguucaugggaaccuaguuucugcacuucuuuuucuuuuucuuuuucuuuuucuuuuucuuuuucuuuuucuuuuccuuuuuauuugucuguugcuguagcuauuugggucacuugauaacuauacacuucaccucaaaauguuauguauuacccaaacauggugcugauauauuggcagagcgaagauuguauuuuuauuuacuuugacauuauuacugaaauuauaauguuuuacuguaaauuuccaauuuuaacuauauuuuaaaggcauuuaauguuuuuauauaucucucacuuauuaaaaaauuauuuaguaaguacucaaaaggcaccaaauuaaauauugggaguagagcuuugaaauauuuucucuguucuugaugaaucaagcagagcccugaaucauuuaguauuccaucuauugaauccuuggguaaaagaaacgugacguuuuguaauuaaguaaacuuacuuuaauuuugaaauagauaacauguaaucaaugugucuuaguuguaacugugacacgaaucugagauucuuuguggccaguuucaagggacaugaacaauuuaguuuuauuuauuggacagaaugggcacaguuuugguguauagauaaauagcaagaaguuuuacauuacuagugguuguuuguuguaaaacuuguuucugacuccuguuugaagacuguggaaggcacuugauuuaaagcugcgugugcuuaaaguuuaugaaagcuagcaccuuaaagcagcacacauauauggcuuacuugauccaaaguaauuauuuuaagauuaaucuuggaaacacagcuaugaggucagaggcuaugugauacccauuaggguuaccuacguuacccauaaagcggcaccacuuaucuccacgacuaaacgucacacacuccucgcugaaccaagacuagcuaaggcaaggaaacacugaacaccagcccagauagucauccagugcaggaaugccagaaacucacuuuaguacuuaggcacccacuugccaaaaccagaacuauaaccugaucuggauccagagccagagucaaaacaagauuuagacugauccagauacugauccagaguaguccucagauagaggguaggaagaagacucccaucagggagggguuuccagcugcaagacagccuucugggaagaagggaagaagugugcgagaagccagcuggagcucagcagucaggaaagcacaccgcugggcagugucugucauuguagugaauaguuuacucucagaagaggacugaggauagaaguugaucccuugaacaauauuuuaauaguggaaagugacaccucaaccauacagcuacccaguccuuccgagaaaauacagauagugccauugaaaaaaagaaaggugacccuuaaacagcagugacaaccaacuauugaauuccugaugcauaagucccaaugcaaaaacaauagguaacaugaaaaacaaauuacccuccccuuacaaguccggcauaaugaccaccacugagaaagacagccuagucugaagaaacaaaggauacuucauacacuauuacaaccuggcaagaccuccugcuuguacaguaguggcacacaugaguugagguaacccuuagaaagaaagauuccugauuggauuuaaggcaugcuucacaaauuggaaccaagguauggcacgguuaccagggucaagaaccuguggcuagauaggauauagguccuaggaaagaaucuauuacuauuacucugcuaaguggauauaguguuaaauugacucccaaugauuucuuauagauuaguacaucugucaacuaaucuauacuuuuuguacuaaauggugauaaacccaaagaucuacaauggucagggugcaaagaguaagagaccgaggaaugcuccccuuaaugagacaucuguuucauacccccuucucucaaggcucagagaugauuugggaagagaggacagauagauugauuguaagagccagggguaguagaugauugaaaggaaaguggguuuucugggcacagcaggauacuugcucuuaugaauucacagcagucauaauagcauacagaaguccuguguaggcucaggucagaccauauaacaacaaggagaugagagguggcugugaagucaccccuagcuaagacaguugauaguugcuguaaaaggaacagucuuuuuuucuuuaaggauguggcuccuggcugguggacuauucucuagaaaaggccacgcauccuagaguauaugggcagcaugaacugagcuucaugaauuucuaaaaagaggauacaaaguugaguggguaaggguggaucugagagaaguaggggugugugacuauggucagaguauauaguaaaaaauucucaaucaauaaaaaagaagaaauccuacaaacucaaaaaaaaaaaaaaggaaaaagaaaaggagagagagauauugaucuccaucaagaagacaguacaguuuuaaacaucuaaaaauaaaugcacugcauauaggcacacucaguuucacaaagcacacuuugcuaggugugaagacacagccugaccucagcaugauuguggugggugaagggugaaucaggacuugacuuaaucagguuugagguccugccaaaagguaacccaaauucuguggauucugaccuuauaaaccaaauggacuuaacaguaucuacagagcauccucuccuaaaacugcagaauauaccuucuucucagcagcuuaugggacuuuguuuaaaauuuuauuuuaggacauaaaagaaaucuuaacaauuauaggaaaauauaaauaauuuccuguauucuuuuuuaucaugaggaaagaaaaaaaaaaaacuacaaaccaacaguaagaaugacuauagaauguauaugaccuuauggagguuuaccagcauccuaucaaagagaaauaaaaccuuuuaaaaaucaaaugaaaaugacaugcaauauaacaaagcccaugagauagaaugaaaguaauccuaagagaagagugaaacucuuaguaccuacauuugagaugagaaaggucucaucauuuaaugcuacagguuagggccauagaaaauaagaacgagcugggcaauggucgugcaggccuuuaauuuucauauucaagaggcagaggcaggaggaucucuggguucaaggccagccuggucugcagagugaguuccacgacaaccagggcuacacagagagguuuugucucgaaacaacaacaacaacaacaacccaccacaacacaaaagaaacgagaaaaaccccaaucaguagauaaaaagaaaugauuaaggagauggagacauggcucaguagguuagaguacuugguguguaaacauaaagaccugaguucagaucucugcacucacuuaugguccagcuccaaggagccauggagggccaagaggacuguuaggguuuguugaaggcuagcguagcuggaaaaacaaacaaacaaacaaacaagaaaagaacaaagaacuuaagguucagcgaauuguauuauuuaaauaaaucccaucugugggugauucacuacuggcuccaaguuuaugcuccugaaugaaagacacacacacacagccuuuauauuuugauaugccuuaaacagugcaguagcugggcuacuucccacugauaauccugaguuaucagcaaccuaauucuguauucuaccuuggcugcccuggacccagcugaacagcccuuugggccgcacucuccgggcuccuucacauggcuguuaugucucucuguccuccaaucuucucagguaugacuucuccucccuuccacuucuccuggcauggcagauccccccaacccccaggcacaucccaaaccagggaaaucucaaaucccgccucugucuucccugcccagccauuggcuuccggcaucuuuauuuacuagucaguaccaauugggggcaagguuccucaaugucuuuuguggacccaaauuaacaucgaauacaagcagcauuacgccaugcccaccauggggagugaccuggccucaaaggaacaacaagaaaauaauggaagaggucacccaacaccauccuauauauacuacuuccucauauacacaaauaaauacauaaaacauuuaaaguagaaauuaaugaaaaacaaaaaaguaguaccaaaaaaaagaaaaucacuaaaacagcuaguucuuugaaaggauaaucaagaucuauaaacuuagacaaaaugaccaaaagaaguaucacaaauuaauacaauuagagguggaaauacauuaaaaauaucugcucacugagugugaugacacaugccuuugaccaaguacuccuaagggaggcagagacuggcagaucucugagcuuccaaggccagccugauuuacauagugagugccaggccaaccagggcuacuuagugagacccugucacaaacccaacauauguauguauauacuugucuucuauuacauugggaaaucuaaaaggaaugaugcauuucuagguucaaauaaccuaccaaaauuagacuauggugaaauaauuuaaaugcuucuguaacaagccaagagacugaauuaauaauaaugaaaagauucuaacuagaaaaauauaguuccugauggauucccuggugaguuuugccacaccuccaaagaccuaaaaguaauucuucugagauucuuccauaaaguaggaaauaaaggaacauuaccaaaaacuuaauuaucaaggcaguauuacucaucaaaauucuguaaccacacaauuagaucaaucccccuaauauguggaacugcaaaauuucucagcaguuaagagcacugacuguucuucugaagguccugaguucaaaucccagcaaccacaugguggcucacaaccaucuguaauggggucugacacccucuucuagugcguauaaagacagcuauaguguaccuaaauauacaauaaauaaaccucauauauauaagaaauaaauaaauaaaucuuuaaaaaauuucucagcaauguacucacaaacugaauauaggagcgcauaaaaaggaucaucauuugaucaagcuuggcuuuaguccagagauacuggagggguucaacauucagaaaucaagaaauguaauaugcuauaugaauggacucaugaccauaaccacaugauugucacaaugggugauaaaaugauaaaaguccugaagugggagcugaagcuaggguucagugguucagaguguuagcugcacuuauggcggauaugaguucaauucccagcacccacauggaaauucaaaaccuucuagaacucuaguuccgggggguuuaaucaccuguuucuggccuucacuggcaccagcaauacuuucagugcaugcaggcaaaacacccaaggaacugggaguagaaagaacauaucucaacauuauaaaagcuauauauaacaaaucuauagccaacauuauacuaagugggacagagcucaaaggauuucuacuaaaaucaaagaagauaaggaugcuuguuuucaucaguuauucaguauaguucugggauucuuaauuagagggucaagacuagagaaauacaaggcauaaaaauaggaccgguaugcagaugauaagauucuauguauaagauucuacgaacuuacagaaaacucuuagagcugacauacacuuuaagcagaguggcaggcuacaaagucaguagcaugaugagaaagaaguuagaggaacagucuuaucacaguucacacucauguccuugagcuaaaucuagacuauccagggaugugaaaggccuggaaaacauuaaaacauucaagagagaaauugauaaagucacuagaagauaaaaagacguccugugucccuggauuaggagaauaguggacaugauuaucuuaacaguagucuacaggguugagcagaaucccaagaaaaaagccaauaccuuccuuaacagacauagaaaaagcaaucuuaaaauguauuuguaaacacaaaagaauuccaguauccaagucaaucaguguugucuguccacuccccuccacacacaccccagaaagaaagaaagcaacugagcaagcagagauaucaacauaucugauuucaagguguguuauagagccagagcuuagcaugacacugcauaaucagaaauguagaucaguggagcagaguacauauaaauccaugcugcuacagccaccuagguuuucacagaaguguuaaaaauacucacugaguagagcuagacccuuuaacaagcuaucugggaaaacuggguaucugcaugugaggcuuuauggugugucguucuaauguucuaccugagaaucccuaguuaaucaaguuuuaaucuaauuuauaucgaaauauuuuagucuaauauuuuuuaaaauaaugaauuuugaucaguuuugauuauuuuuaaguguauugugugugucacacaauaauuaugcaaugagauuucuaucugccaauuucauuccgugggaaugggugguugcuguuuuuuaauuuuaaucguguucucuuugguuagugcuagucuggugugucuuuaguucaguuuaauucacugaugagaauuuacaucacuaggcuucuuucagucuguuuucagcauucaggagaauauaguuggcagccucuguugagugaagaauauaacagucacuauuagggugcuguaauauuguucuguuagcuuuaaaacaaauaaaacaaaaagucuuuaagccugccaccuaagauggagcuuucuuaucauucuguuagcugucaaaaguucuaacgucuaagguuguuuuaagcagaggguauauuugauuucuuuuuccugucuuuuucccucaguacuugauucugaagcuugaaaggccugcuaucguucagaauauuacauuuggaaaauaugagaaaacucaugucugcaauuugaagaaauucaaaguuuuugguggaaugaaugaagaaaauaugacagagcuguuguccagguggguuugguugugggguagaaaggacugucugugagacauacugcagagcucaucuacuuucuucauagcuggaucuuugugccuuuuccuaggaaguaaagaaccucuuucagguuuuauuccuaguuccuuuguuaauacuguggcuuaaguugguagguuuguguguguguguguguguuuuaaacuacaagauacuaguuaaaauuguuaaaaaauggagaaagaaucaaauauuucuuuuuuucuacucauaguuuugauuugucaauaacuuuagaaauacuuucuauuuaaugaaaaucucugauacugccgaaggccuggauucaguucccaccacuuccaaaacaaacaaacuauucauuuguggguagaaggacaaaagcuguagcuauuggaaaauacaaaccuaacugaaaucgugaauugccuagcccagaaauaguccucuaggauuuuacuguuagagaugcaaaaggagaagugucaguaacuggagacaaaacaugacagcauggcuugcagucuggaaagugcaccauaaccuggaguucagagcaguuaugucccaagcaugaggaaggucauacagucaguagaaacaaggccacggcgacuuggaauguauuugugacauaguuaccccauuaaggaaaugcuucacuugcauaaguacuaguuuuaugcucugauuuaagucauacaaguauuuuaggguauaaggaggucugaugguaagggauuuuccuguaaacacaagaggugggugauaugaguuaguuuuuauuuaggguaaagaagauucuuuuaaaucagcagaacaagauugccuuugaaaauuuguggaugauaaaaagguaucuaagaaauuuaauuccuugacaaauucuaauauuggccuguugcaguuguuagauaugacugacuuguuuuuaauucuuuuccuacuacuugaaaaauuuuaagauuaacuuacacauugaagauagccacacauuuucauacagcuggccagagucucugguucaugcggaacauucuucauuugcuuuuguauaguguuaagaacuauaauauugcaguggauguggaggugcgcguucugaccagucuuccuuuucagcugcuuguuuacauugucuugaauaugcagugugagcacuggcauaagcuuagcauuugaguauaggauuagugugguuaguguguuuacuaaguuaugaagucauguuugauaacaugcaguguucugucucucucccaccacccaacaguggccugaagaaugauuauaacaaagagacauuuaccuugaaacauaaaauugaugaacagauguucccuugucgauucauuaaaauugguaagguuuuaguguuuuugaauuaaaacuguuuuguaaugucuuugguucauagacuguaguguauggaugagguuuuauagguuccuauguuuuaguuuuuaaauucguuugugguuaguuugugcacugguuuugacugcuuuugugccccaaaggcagagaugaauaguugaaagagaucacauagcccagcaucugaagagauuccuguuggcccuuuacagaacuguuugcugacaauugcuuuaugaauccauuuuuaagugacaguuaauuucaugaggcuauuuuccaaguguuuucucacuuagaaggauucuuacaggguucugugggguguaguuaccuaguuaccuuaauuauucauggaggcuugccaucuauucuagagcuaucagcugcaaccaaacccugaugaguuuuucaagcccuguaaugugcuuuuacaugaaauguugguuaaacugacuuaguccaucuugugguucagauuugcaagccaugguucagaaacacugucuuaaggcauauauuuaucauccagguuuucagcuucugguggugcuuguaaugcauccuucucagguuccucugggagcuuuuagauuuaguauuaugagggcagggauguugaggacugagucuuuggauuuccauuuuugccucaccuuuagaaguauuuuauuaaaauuagaaucaaagaagucaaauuuauuaaugaagaacaauaauuaaugucagagucccacacauugaaaaacauugauuuauuaaacuccuuuaagcacuuguguuauagucuaaucuguguaccuugcuuaguaguugaaaagaaauauuggauagccagucaagucauuuaaaguuccaguuagacaacuaugucaucuucaggugaucaguaauugucuuuuuuuuuuaaguuaguuuuuaauuacuuuauccauauguuuaccugcauuuaugugugugugccauguacuauaugccuacugcaagaggaggucagaagagggcaucagaucccauggaauuggaauugugcaugguugugagcugcugugugagaccugggaacugaaccugguucuccuggaagagcagcaaguacuuuuaacugcugagccaucucuguagcccccacccccaccucuaugauacucauuaagacaucuaguauacccugcacauauauagcagaugugcagcuuggucuuuauuuggguccugaacaacuggagcuggggcuaucccaaaagcuguugccuggaugugagauauguucuacuagcugggcugccuugucuggccucagugggagagaaaguggccagccuggcagagacuugaagugccagggcugggguguaggagaugauacccagggcggggccuaaccgcuaagaagagaagggggccauuagggaaguauugugggaggggcugacugggagggagguagugagugggauguaaagugaguaaguaaaaaauaaaaauaaaugaaaaaaagacaucuaguguaguauugaauuaguagaggaauuggcuucuuugucuuguucugacuugaguaagaguacuuaauauuuccuuagguuuauguuuaaggcuuaagaugaauuuuuaaaguaauuaagcacauauuuuuuccuuuuagcuuuuguuacggugguaaauugcaucgcuguaucucuuuuuauugaaucauccuugaaugaaaucuguuuucuuacaaagaaaaccugagauuuuuuuuuuuugucguuuuacaucuuuccuacuauuuggauaugucuucaaagcucagauugccuuugaaaaguuuucccucuggcuuuguuucaagguucuauauugauauauugauacauaauugaaauuuacguucuauacuuagauauagguuaaaaauauuaucugcuguauguagggccaguauauaucaccucuguuauauuaccuaguucugguuuuauuuauuuaggaguagauguaucaugacuuugaacuuacauuacagauuuuauuaacuaagaaaauaugauggcaucagucagauuuuuuuuuaacaccacaagccaucuuuuaaaaauuaaacacuuguuuuaaagaugaauuugcuaaaaacaguaauaugagacaagaguuucacuguguaaucuagaaacucuuguucuuccuaccguagucucuugagggcuagaaaucuagguguguggcauguguguaauaauuuugaugaaugcguuugcauuggcugguuuuucgugucaacuugacacaagcuggaguuaucacagagaaaggagcuucaggugaggaaaugccuccaugagauccagcuguaaggcauuuucucaauuagugaucaaguggggagggccauuguggguggugccaucccugggcugguaggcuuggguucuauaagagagcaggcugagcaagccaggggaagcaagccaguaaguaacguccuucaguggccucuccuccugcuuccugaccugcuugaguuccaguucugacuuccuuuggugaugaacuacaguguggaaguguaaguguaagcugaaugaacccuuuccucuccaacuugcuucuuggucaugauguuugugcaguacuagaaacccuaagacaagccgggcgugguggcgcaugccuuuaaucccagcacucgggaggcagaggcaggaggauuucugaguucgaggccagccuggucuacagagugaguuccaggacagccaggacuauaaagagaaacccugucucgaaaaaccgaaaaaaaaaaaaaaaaaaaagaaagaaacccuacaacaaaauucauauagauucaaacauuaguggcuuugcuuuauuugaaucauacuaauuuuccccuucuuuucacuuuuccucaaaguuccacuuuuguccugggggcccagcuuuaacuuuagcaucugguauguugaacuuaguggcauugaugauccugauaucgugcagcccugucugaacugguacagcaagguaggaccaugcuuuaaaauuagaccuugauaccuauugagggagaaaugugccaauuucuuuauugugaccaauucaaaauguugaugauaguagaaacugaauaaucacuaacauuuaaacauugugguuugucagcugcucagcagucuuaacucauucaaauuauuacuauucuacaagaaguaauuaucaauccucauaggaauggagggagcagagagguuuaugugcucgggucagucuuugggcucaggcagcauggcucuacaguuugcuguuaucuuguuauauucacuuagcccucaauuuuauuuuuaauauaaauuaauaugaauauuuugaauacauuuuuaguggguuacuuuuauagccugauagaaaauuuuauguuugaccaugauugaaaugccuaaagucagcaugcuagguagaugccacucgcacuacuagaacugcuguuacaugcauuauaauaagccaguuccaaagguggaaaaaagucaaaucggagauacagaguugcuuugauuauuugauggguuuacauauugacaauuauauuguauaaggaaucggauaaccuuguauuaguugagaagugagauaacucuaaauuggcuguuuuuucaaguuuuugggugguauauuuuuuauucagggguaauguuuaucaguaaaucuuuuaauuugucauacaguguuauguaauugguuuucuuaauucucaguguaaagugauaugcuuagaaaauuugauguaauuucagcacauaguuuuaauuuuaacuuguuuguuuuaaauuacuuuucagagcuuauuucuagcauucacccuguuaaaguguuuuauaaacugagugcugacuuucaaauccaugcuguucuuuaucucaguaucugcauugggauguuauuaguugcuguugugggaacuguaaaauguacauccuuaagggguuuuuuuauauagaauuuuuuuuguuguuuugguuuuugagacaggguuucucuguguagccuuggcuguccuggaacuugcucuacagaccaggcuggccucaaaaucacagagaucugacugccucugccuccuaauuccugggcuucaagacguuugccaucacugcuuggcagcuguuugcugcugcugcugcugcugcugcugcugcugcugcugcugcugcugcugcuucuccuccuccuccuccuccuccuccuccuccuccuccuccuccuccuccuccuauaaaaggcuuuugaauuuuaucuuguuugucuccuuugauaacauacuugugaccuugggcuaguuauuacaguacauuaagcuucaguuuuacuacuugacaggugaaaauaaaggcaacuaaugaacaagauuaaauauagugcuuggagccgggcgugguggggcacgccuuuaaucccagcacuugggaggcagaagcaggcagauuucugaguucaaggccagucugggcuacagagugaguuucaggacagccagggcuauacagagaaaccuccccaccuaucuaucuaucuaucuaucuaucuaucuaucuaucuaucuaucuauccacacacacucuaguuaguuaguuuguuuuuaauuguuaacuguuuccuacaguggcagcuaagcagaucucuuuuucccccccuacuuuucuuguguucuaguaguaccgugaacaggaagccauucgccuuugccuaaaacacuucagacaacauaacuauacagaggcuuuugaaucccugcagaagaaaaccaagauugcacuggaacauccaauguugacagauaugcaugacaaauugguguuaaagggugacuuugaugcuugcgaggaguugauugaaaaagcuguaaaugguaagaaacuuagaaacuuguauuaguagggauauuucaguauuuacaggaaacuuccuaaaagaauauaugcugccuaugugccgcuaucacucuuuuauauuuuuccugugcacuuacuuuauaaaguuugucuagucccuuggaguagagaauuauuuuauguaagauagguuuauaauaucacaggaauuuuaaaaaaagauuagaaacagauuugaacucauuuuccuauauuacauugucauucuggaaaccaagcacuuaacuaacaauaaaucagguaaacaauuuuugauacuacuguuaucaaaaaauuccuuuaaguaauuuuuucaauagcuaauauucauuuuuuaauacugugauuuggauaggaggggguugcauauucaaaaaguauuggcagauguaacagacaaggaaauuugcacuaaaaugauuuucuugguagugugaacagauacuacaaaauccuugauuuucuuguagaacugcugacuuccuuaaauggccuguaauuugguuuucaacauguguauauaauauuaugagaugcuuugaaugugaauauuuaaguucucaguuauaugaauuagaaagaaggcucugucauuccuuagugagugagaagaacuuucuuuuaucuucccccuccccuuuuuucuucuacagugguuuucauaguggccaguaauacucaauagaaagcuuguggagggccagaguaugguucauuuguacaauaauugcuuacuuuaaauuucagcauugcauaaacugggccugacucagcacuggagagacuagaggcaagagggucaguaguucaagagggucaccuugagcuacauagcaaguuccaagcuagccugugcuuaguuucuuauaacuaaagaaacuaaaauuugcacuuuucuauuuuagcuuauauauuuuacccuaaaaccagguacucccauugcucaguacaauggcaaagcuaccccaagccuucuacacuacugacguacuuacuugaugaugacucauauuuacaaauaaggaagcgauaguuuugaaauugacuauaccuaagagcacugauaauuaaugucauaucaaaccauuaaaaugccuccaaugaaaguacguaaauguguuucaauuucuaagcgugaguuuacauauuuuuucuaauccuagggagagagagguauauagauaauuuuauaauuucaaguugacuuguuuuacauuuuuaucacuaaggcaucugauuuuacuguguuagugauauaaaguaacaaccacuaucauguguaacuucuuuugauuguaaggcaaauuaacgauaauuacauuuuuaaauugauuucaguugaaugcccauuguuagaaaaagcuguuaaaagcaagugcgacucucuuuauuauaguugcuugcaauucugacucuagaaagggagccugguuuagagaaagugauaguaaccaaaacuuagucccaucauaguuuguguugcccagggcugucucaguugccuaggaacacuuaguuaauagugauuccuuccagggcgcuucaguucacugcugaccucacugaugaugaguaguugaacaaauaagggaaagaacacuagagacguuuuuggcuucucuuucacugaaagcauggaagaggccaagaaguuuuugcccacggaguaggaaagaaaguaggacauggaaacaucuuuuaucaagcuucuuacaauugagccuucaaaaaccuuguaguguauuuaauguacucauuaauaugaucuacaaaugugaucuguguuuuaaggugucuuuuaaaaaauuuuuuaaaaacauuuuauguaugugaguacacaguugcucucuucagacacaccagaagagggcaucagaucccauugcagaugguugugagccaccaugugguugcugggauuugaacucaggacuucuggaagaacagucagugcucuuaaccacugagccaucucucuagcccacaucuuuuuuuuuuccuaacaccuaaaauuuucauaugacaauaagacuaagcuuuguauauuaaaagaaaaaaaagacaagaucacuuugccuuuuuagaggucgauuuauauauauaaugacacuauaagcuauacauacuuguaauguauacuuugaucuacauguugacguauaugugugucuaccuacauaccugaccccaccaucacuauacauaguaacaaacauugauggucccugaauuuuccucaguccuuuuauaaucuagaccuccugcauugcuuguguuucuuccuuaggcaacuguuuccuuucugucacuauaggugagauugcacuuguauaacuucauguaaucagaccauacucuuggacuucuuugaguuggcuuguuuggaauuucaucucuuguuuggaauuucaucuagguuugucgaaacucacuuuguuauugcuaaggcagacaugacacagauauacuaguuuuccucuguguucaucuguugauggacauuugggcuagucacacuugugggcuauuaacuguugauaugaacauuuguauauaagucuuuguauggaaauacacuuugacuuuuuuagguagagacuuaggaauagaaccaccagguggcauauuguaugucugcuuuaacuuuuaaacuucaguguugcuguuuuauagccauacaauagugcauaaaaguuucaguugugugacagugauuaagauaaagucaugaaacugagaaggaguaaggagggcauggauagaguuggagggaagagugauugguggaaaugguguaaguacagugcucauguuuggaauucuaguaaaacaaaauaauaaaauugucaaaagccaguugcuauacauaauugcccauugauuguaaugugugucaauaauuguaauauuagccauucuaaucuaugucuauauuuucugcuuucaauuuguaguaacuaaugcuuagcauauuuuucaucuuugugucuucauuggugaaacauuuguucuuaucuucacccauucuuuuagugaauuguuuaccuaugucuguguuuugaggcuucuaucuggagacaagccauuuauuaagagauauaugagggauuucaaaauauauucuuugaguguaggagagacacaguucuaaugggauaugauuuaaaaugucauaaugaagcccacuauuuuguacaauuaacauacaaauagaaaagaaaauaagaaaauauauuuuucauaggaucuggugguauaggccuguauuuagugaauggagguaggacagaaguauagcaacucugagggguagucuaggaacaucagacucugucccccaaacaagcaaacaaaacaaaaauaaaacaucccagacauauaaaaugauaauauaugcuauagccugugguuuauuuuuuucaucuuuuacugcaucuuuugaacauuggaaguuuuaccuugugguaagaauuuuucuaucugugugcuuguuaauaugcucuugguguuagagcugaacauuuuuuguuuaaagaucagagcucuugguuuucuugcaagaguuuuaagguuaagauuugauucggaguuaauuuuuguguaugguaccagguaggaaucuaauaauuucugguuugacagugcagugcguuucgccaauaucacacuaucuucauuacucagcaucguaguacguauucaaaugaaguaauguaagucuucaagcauuguucuguuucaaaacuauuuugacuauucugcauggucugaauuuucuugugaauuuuagaauuuuagaagcaugugacauugguuguaagugccuaaaaacuaucuaauaggguuuuguuuuguauauaguagucauggaucaacuuggcaagaauugaaauuaucagugcuuuauuuaaaacgugguuuguacuuucguuuuuccaguucuuuuaacauuuauuuuauuguuuauguuuauguuaguuuucuacucugcagucuugcuaaauucacuucuuuugguauccugagauauucgguagagaauagagucuugucguacuguuagaagacccuuuucauguuuucauccagucaugguauuuuuaaguuuuucuuacuguauuaguucaguauuuuccauaguauauugaauuguguggagacaguagauaucuuugcuuuauaaagcagucauuaaguauagugcuaguuauacuuuuuauagacaaccuuuuaugagauugaggaaauguaguuacaaucuuuaucaggaauaguagauacugcauuuuaucgagcauguuuccugugucuuuugagguggugaaaggaucugcccguaucaacugcucacaccuuagaucacauuaauuuucauuuuuaaauucaacuuugcaauacuaugaaaaucccuguuugguuuagaucuuguuauauuugauuuauaaaauuguauuguguucuuaugcauaguugaauaguuuggauacuggccuacaauuuugucauaauguguauauuuuguguugguauuucuggccuuuacagaaagaaugaggugagaauuaguucugcuuuauuuucugaagaaaauuuauauaaauuuuauauaaauuaauaauaccauggugaacuuuuaaaggaugaauggugaaaagugggccugaaguucauguugagauuucuaaacuucaaacuuauuauguuaauaaauaaaaggcugcuuacauuuuauauucuugagugaguauugguaguuuaugccuuuugaauaauauguacaauaugcacaccucauuuaaguuggugaauuuaucaguauaaaauuauucauaguuuuuaaaaaaaauucccuuugaaucuuuauguuguacuacuuaugguuucuucuccuuacuuuguucuucucuuuuugcucuuuuuuucuuucuuucuucauucccugagaccgggugggucuuuuuaugaagccuggacuggucuguaacaaguuuuauacucuaggcuggccuugaauuugugccaguccaccugcuggauuccuaggguuggaauuccaauuguacaauaccagacacccucccuuuuuucuaguuuauuacuaugaauguugaagucacaggcuugcuucauuccuuccaacccuuuuccuuuucuccuuauguuuagguuuugagcuaagauauauauauauaagguugaggacauaaugguaguguauguuuugguauaguuuguauucucaaaagcaaauccuuuuaucaucaccucagaaaguacaggggaaacacuugcugugugcagcaucuguucuugauagggcguggcagacuagagauagagguuagcccgaaaaauauccacaggaaccuauggauuaacauccuauuuaguguucuuacauguuauuuuuuuucuuuuuuaauauccaacauaauauuuuuauugauuauuugggauuuuuacauaauguaucccauuccauuuacuucccaguccuccuagguccaccucccaacccgugacaccccuccccuuuagaauaaaaagaaagauagauaaaaauaccaagucuauuuugguugcucguauuuucacuggagcauggucagacucccaguggccagucccuuaauauuuuaacccugaauccuuccccacccccaccagaaaccaucaacugugaaggacuaacuucagcaucccuaucacaauguuuaagaauucucuaaaauagcuuccucucuagccuguuucuuuuggagaggugagagaggcggugacgaggucgucccagaagacuucuaugucucucagucucagcugugagucugcagucaucacggccaccgcagaagaggcuuccugccuuucagucagcagcagcacagaccauggacuucacauggucucuggugacagcauggaccacggacauccccauggccuccaguggcaguacagaccacggauauccacauggcccaugaccuaugggcacagcacagaccauagacaccaucaugucccucaauggcagcacaggccacaggcaucaacauggcuucagguggcagcagagaccaagggcauccauguggccuucggugguaacacggaccacaguccucaacagagcucuccucauucaauaaugccaugugcuuugucugaggccauguuccugcauugcuuccauacccuucaucacccggucugcuuuuugccauucucugugugagaggcucugcuccuuccaguuucacauguccacuuuuuaaaagcaucuucccauaggaucuaccauuuuuuuuucaguuguucaaggguucugcggccucugcagaguccuccucugccaccgagucuccucucagagccuccauggucuccaaagcuacuuagagcugcucagcaaucucucagagggugccaggggccaccaccaucuuccaucacagccaugcaucagauuucaucuucaacagcgaugacaugcucucagaucacugggagugcuccuaguagauggaguagauaaugggguggacccccucaaagcacuggaucuuggccaaguuggccagcugcugcuagugauucauggugcaggugcagcacccauguucagagcugugcagcaccccagauuuaaaaagcuuacguacagagucuugcuuaaauaucucagucagguauaguugagacucaaggaguaguucauccugucacacauuuuuaccauuuuugcagaugaucugaugcccuuuucuggcccuuguggccaccacgcacaugcacacgcacauaauagauggcaggcaaacaaaacaccuuucucucuugaacccaggcaagugugaaggaaaacgcaacacaaacucaguucagagacaaugauaacucaaucucugggugcaacaacuaaagccuaaucuuguaagccuuauuaaaaucugauuccucugauggcgaauccuuggggcuccgcuaugauaccaggaucucuagcagcuacaucuuaccccucucuguccacauguuauguuugaugugucauuuuggagggccuugcaucacauucccagauugcuaagaaauuguauuaacaaauacugaauuuuacuacuuuuucuaccuuuugugauaaugaauuuuuccugauuuaauccuuuaauguaggaaaucaguuaccuuuuuuuuuuauuuauuuuuaagcugacuuuuuauaucucagauguacuuaacucggucuaucauagauuuagauugguuaauguuuaccuugaauccuucuccauggauuuauuagugagaagguugaauaguguuuccuuuauauuucucucagaucuaguauuccuauuucaacuagugagcucagaaguuaaugucuucuuucuguguuaagauaugaauucuuucuugcuuacuuaccuggaagagcuuuuagaguuagguauucuauuuuggaagggccugcugggagcgcuuucccuaacuguucaaugucuaugaacagugcaggacuccucuagguuguuugcuucagcuucaaucaguuauaauuuuuuuuuuaacaauugucuauugacauguaaaaacuuaagucuuagggagauuaaggaauauuuaacaucuuuuuaacuguuuaauguuugcaagguuuccugggauuuuguuguuguuguauauugguuaguuauuaugcauugcuauucuuuaaaaccuucauacaguuacaagcaguuuauuuggcuuauuaguuguuuaggauuaacuccugcuuugcuuaucuuuucuguuguuuucuauaugcuguuaccucuuuuucucuuucucuuugagauuuuucuccucccauccccgcccaaguguguguguguguguuuuguuuugcuucucauuuugagacaggguguagcuggucuagaccuugcuguguagugcuagcuggccuagaacuugcuauguagacaaggcugguuuugaagucacagaguucuuccucgcucugucucuugagugcuggaauuaaagcauguaccacuaugccuagccuauaccuagccuuuauaccuuuuuaaaaauaacaacuuuagaugccaagcuaauuaucagauuaaaaaaaaauuacaaauggauuaaggaucuaaaaucagaucuacauauguuguugucugguucaauauuuucauuaugaaaugaaaugacuuuuaauaguuuuagaguuuuagauuuccagaaucauugaguuuucugguuauuggcuuuguucugaccucuaguggaguugcacagcugucagguacauguccuuccaaacacagacuugcucauggccagauguguucagcuuuuauccacuucgugcuugaccagccuguggacuuagcagauugggcucaguguucuguauauagccauaagucagguuugcuaaucccauugcauaaacucaguagcgucuauuugauacaguuacugagaagaauguaaguuuagauugcaugucucuuuaugguucucguuuucuuccuauauuuuguugccauguuuuuaguuacacaucauaauuuuuuuuuuuuuuuuuuuuuuuuuuugaggcaggguuucucuguauagcccuggcuguccuggaacucacucuguagaccaggcuggccucgaacucagaaauccaccugccucugccucccaagugcugggauuaaaggggugcaccaccaccgcugggcuaauuuuuuuaaacuuuaauuaaguuuuacuaugaguugcuuacccacuuuuauauaguauuugcaaaauguaucuuuuccagugucuuaaagacaguauuauguaucuuaagcauagugucuguagcccauucugcucuguaguugaggauaacuuggaacuugugauccucuugcugggacccuuuugagugcugggauuccagaugguuguuaacaugcccaguuuuguguggugcuggagacggaaaccagggcucugugcaugcugggcaagcacuuguugaguuauagucuuuacauuucaacuuuucuguaucuuguuuuaaagaaguaacucuuacagauguuacuuauuuuuuauuguuauuaauuuuuuuuccagacacgguuucucuguguagcccuggagaacucagaaauucaccugccucugccucccaagugcugggauuaaaggugugcgccaccacucccagcuguuacuaauuuuuguguguaugguucaugugcaaaggccagaugaggaugauggugccuuccuuuagcauucucuuacuuguuucuugagacaaggucacucgcugacccugucuguaggcuggccggcucaccagccccuccuggaucucccuguuuggccccagcaguggggcucuaggcacccacagugcaguagagccagauuuccauguuacuuuguagguuuugucgugcucuuuauuuuuucuuugugcuugucaucucuugaccuuuaauauuuucaguuuucccuuuguuuacuuggcuuuaaugucaucugcauuauauuucugauagaaaucgugacaaguauacaguuaacaaaauugguaacaccuuuuuuugucuucuaauacaaggauuaugagugugguuucagcucuauuuacugauacccucacugucauuuaugauggcauacuugagguucugcagagauugcuucaucuuauacaggguuccugaauuuuuccccaucuuuacugaucugauuuauugucucuuugaucuuacaucuaagauuuuaucuccuuugacuuaaagcacaucuuuuagaaauuuuaguaauaacgaaggcaagucuuuauugucuaucugaaucauuugucucuuaaagauggguauuuuuguuggauauagaauuuuuuggcuggcaguuauucuuuuaaacacauuuugaauauuacuccacuguuaacuggcuuccauuauuauuuguugagaaaguguguuauuuuucuaccuguuucuuugaaagaaaucuguaguuuaucuuggguuguuggguuauacuuuaccuucuuuuguagaguugucuuuaguuauauugcugaacucaucagccuguuaaaaaccgugauuugucuuacucuuaauuucauuuucuuaguuauccuauuaaaguugacauuucuguuuaauuuuucaugcgccuuugaauucuuuaucccauuucagucauuauaucauuaccagcaucuccucuuagacuuugaucuucacuucuuuaaugucucaguuuuguucuuuucaucaaccuugacaauuccugcuugaugucuuugggugucaucuuuucugucgguuuaacaugucucugcugcucggcagucagugucuguuuggugccaaggucuuguaccaugacuugcuuacuuucuuacauucaugguuuguauuuaggucucucccucuguugcacugcauccucuugccuuuccauaucuuagcaugagucuuguuuugguucuuacugaucugguugauugucacuaaucuucacaugugccgggcaugguggcacagccugugaccccagcacucaggaggcagagaacaaaacaacaacaagagcagguuugccauggcuaauugaaaggagcuucugaugagucaggcacuagagcuguggucgggauuagcaagucguuuccuuagugcuuaccuugggauuuuguuuauucccagcagugcccaauauugcaaaagcucccuucucuuuccacauaaccaccagucugcuuccugaaacauggcuucuuccccaaauuccuacucaccuaugccuucaggcugugguuuuugccauauucucuuugcuguuuacuuuacuuuccauuauuuacuuccaacucauucuucaaggcaaguucuuuucagauagcuucuuuuauuccuucccugguauucucuccuccuuuuaaucuuacuugauuaagugccauauuucucacuuggugcacaaaaaaaaaaaacaaaaaacccuauaguuuucuuccagauauaauuccaagcucuacuacauugucaucaucaucaucaacuucaucaucuucaacauuauuuuuucugccacagccacugcugcugccaccucugccaucacauauguuugaaguuuuacaguggaccuuguauuuuuuaaguucuuuauaugaacuucguaauuguuauaccugcuuucuaggguauauguacuauuaccauugucucuacuaaaugaaagagaaugauuaauuuguaagcauaacuagucagugacagagcuaagauuuggggucccauagugugguaccaauaucuauuuaacaacugugcuuuacugcuauaaauuuuuacucguucagucagcgaguuaaguuagcuucagaauguaaccuaaaguggggaauuauuuaggcgcucgguuucaagauguuuuauuuuacaguccuugucuauguugauucuggcucucuaaugaugcagaauaucaugguggugggaacaugugguaaaagcuacugacuuccuggcuugacaggaaggagaaagagaagaauuggggccggggacuggguguaacuuugauggggauacuucuaguggucuacuuccucugacuagaccccacuuccuacaauuucuaucuccucuguuguuuuuguuagggcuucuuaagugcugugauaaaauaccacuaaaagcagugugggaaguacauuagucugguucucuagaggaacugaauuuauagaauaaauccuccccuucucucugugucugucugucugucuguuucucuauacacuauacacacacacacaugcacacacacacugugugugugcgcgaguguguguguguguaccaugagugugugaauguguauauacacacauauugcaaggacuguaaacuaaaacaucuugaaacugaaagccaaaauaauucccagcuuuagguuauauuuugauaacagcuacagauacacacacauauacacauauguagagagagagauuuauuagaauuguuuucagacugugguccaacuaauccaacaguggcugcccacaaaguucaagaaucuaguagucguuuagugcacaaggcugcaugucuuagcuaagacauagaugccagcauuccaaagaagcaggcucuaaugccagugaaggaguggacuugcuagugugagugagaagagggaggggggguguuggggggcacuccuucuuucauguucuuuaucuaggcugccagcagaagguaugguccagauuaaagaugguucuucccaccucagaagaucuggauuaaagguuuaucuucacaccugaaaaacccagauuagaagagagccuugccacuucauuacuuaaucaagaaaaagauaccucaugggugugccugguccuuuggguuuuaguuaauuucagauguagucaaguuaagaaccaagaauggccaucacugagaggaaaggguuuauuuccuguaacacuuccagggaacagucaauuaucagaggaaaucagggcagggacucaaagcaggagucuggaggcaggagcuaaaggagaaggacauguaggaaugcugucuccuggcuugcucccucaaacuugcccagacuuuuuuauggcacccaggaccaguagccugggguggcaccacccacaaugggcuaggucaucccauaucaauuauuaauuaagaaaguauacuauaagcccaccuuaggaggcauuuucucaguugagaguccccucucccaaauaacucuugugucaaguugacaugaaacuaacuagcacauccccuacuaguaucaccaaacucaagaugaagaaacuuguaaauacuuuaagugaccgaaaggauugugcucacuugugcacuuacacucucucuguaucuguaucuguauauguauaugauguauauacacacauacauacauacauacauacauacauacauauacacacacagauauaucaugcuagcuacuuacaugcuucuuugaauguaaucuguuuggaugaguaauuaaauuugggcaguggcacuacagugauguucuguucauugguaagguuuuuuguuguuguuauuguuuuuuguuuuuguuuuuaaaaagcuuccugagucuccuuuuuagucuuguaguuuuaaggaguuucugcucuuaaagaaaauuaaaaaagaauaaugcaugcccagugaggauuuuauuaaguauguuuauuuaguauagucauaaucacagaagaacaggagagcuacugaagcugaagacauaagcuaaauaguuugaaaauuauuagcaacuuaguguacuuuccucugaaugacauuuuuaauuucuuuaggauauuuuacuuuuuugggacuucugauuuccuguuuuagauuuuugucagaaguaaacuuccuaaaauauuaguaacuguuugccuuucuccuuaaagugauguauauuuuuaauaaacauuuuuaauuucucuuugaaaauuuuucucuagccugaaaagguagaucagcuggugaguacucgccaggcaugcucgaaacccugagucuuaucgcagcucacauaguguaaucucugcucuucucaggcaggaggagcaggaguucaggucauacucagcugaauugugaguugaggacagacugagauacaugaaauucucuuuuaaaaggaggaugaaaggagaaaggggaucaggaggaggaauauaugcuaauuuuuacauauugcaucaaaugggaaaaggcagguauaccuuuaaucccagcucucaggagguagaggcagguggaucucagugagcucuaggguagccuccucuacauacugaguuccaggccagccauggugagaucuugucucgaaaagcaaacagaaaagugaaauucauucuuuuucuguuauaauguuccugauuuauuucuuuguguuuucuguuuauauuuaccucaucguuauggcaaguuuuacccacugagccagcucccuggguuacucuacuucuuugugaauaauuuuauagucuuuuuaaauuugaaagucauuuuaaagcuuuuauaucucccuaaauaaauaaaacuagauaaaauuuauuauuuugacuauauaauauguuuacauuugguuuuguuuuuuguuguuuuguuucucugucauauuacuacagcacauuguaucuggaagcgggaaaagguucccagauguuuugaugaagaagguuuuggucaggaaggcugaguaaagcgagguuccaugugggguaaagggguguacuagaaacacucacuaagucaguugugcuugcugcaugcccuucuccuuccuaucgccaugaaguacaagugccagcuucucagagugacaggaguuggaggggagacggaaccuggacuacauguagcccaggaagccuggaaguuaccacguugcccaggcuggccucauucuuaaggcaguacuugugcuuccgccuucaaaguacaaggauuauaggcaggagccaugacaucaaguuugggugcugauguauaaaggaacuuucuuuucccacuaaguuuauaagguuccaaaggcaaagaaagacagacauccaaggguuguauaggguuggcuacaacagcuucaugauuagcccagaaaagaaagcuguuagggggugguuuauguuccaaguaugcaaguuauggagaagagacauuuuauuauguuuuugaacaagucucuguuuucagugucaggggagaauccucauugagauagaaaucagggucaaaggacagguucaugggggagcaagcgcucucaguuaaguuauguggauggauggaaaagcagacugugacccaacaagaagcccagagugaggcggcuuuccugcuugcuugauucacugaucuaguuucuuuaucuuccucugcucugucgcuauuacagaguugacucucucccuaggucuauaaauagguuuaguaguuguguacauuauauauugcauguguauaugaaaauguguccagaguaauugaagucacuuuuuuucuuggcuaaugucuguuuagaagcaugaaacauugcuuacacgaccucuagaauacuccuucuguuuccuuauccagaauuggguucuagauaucauuuauaaacuuuugacagaaaugaguggagggggugauaaucauuuggaguagaguagauguggggggaagugcaaucuccauuuuaagacaguagcuaguguaguaacuccuccaggacgaagaugaaaaguauacugaggaaggauucggaagaagagcaaaguggaaucugagucaucgcccuacccacuacuuaagauauuugugaguuugaugaaucuccuuaauucucuaaauaggcacuucuccaucuuaaaauagggaggugcaguccuuaagguuguucuuaggauuaaaugaacuaagacacagcagauuuauaacauuuggcagcaucaauaaaugcagucccauugcuacuggcaguaccuucaucucuucgucaguuggugccuaaagaaaauuggaauuugcauuuuaauguguuuuuucuuucucugagauuguacuauaaaguaccuacaccaaagcuguuggcauuuguguuuccuuauuuuuuuuucuuuuguuuuuguauucugguaacaaauguaugggcucuuaaguacuuuuaaugggaagacacuggaauuaaaaaaucgauuauuacaagaggcuaaagauuaaaaguaauaaaucaaauagagaauggugaugagaaaucgccagggcagauauucuuccaggcuuucauuguucuuccuuuucuccguuuguauuuauauugaugacagaaguuauuuuaaagguauuuuuaagguuguguuucgaugaaguaagcauauauucaguuuauuuaugaauuauuuucugcugcuucugguuucuagccuucaauuguccuuacuuucccucuugcaaggcauuuguugaagucacauacuuaaccauugagugcauuaguaacuuuacugcagcuauugcacucaucccaggaacaucccagugugcucucaucuaauaugggcugcugcugaugcguuuuguuccuguuguuaugucaacuaauaauuuacuauuuauauuuggguagcauacuaggaggauauauauauauauauauacacauacauacauacacacacacauauauauacacauacauguauauguguguguauuauauauauaauaaauaaaauaaaauaaacucuuauuuucuaugcuugcagauggcuuguucaaucaguauaucagucaacaggaguauaagccacgguggagucagauuauuccuaagagcaccaaaggugagcugcacugccuggcuuauucuguuucuucuuuauagucuguuuucacuagauggucuaaacaugcuccuucucuguuaaugaaagcacauguuauuuaacuagauggcagaauggauuauuauacauaauuuuuuucuccugaggcuagcaguugaacucugaucuuguucguguuugguagacacucucccugaugagcgauaguccuagcccuagguuacuguaucuaaacuugucuuuuaaggucuuguuucaucacuaugacaaaacauggagcaguucuauuuguucuucacacagaaugcuguuccaaacugcuuuauagagguauguaacaugagagcacacugcugucacuauauaugcuccuggagaccuaacuucugcaaaauaucuaaacacaguggaccuuuugagaauaaaagggacaaaugaugaacuuauacacagauaauaauaagguugacauuauaauucuaauuaaauuaugugcaguauaguugcaucuuagaggcacuugaguacuugaaugccugagugauugcuuucaugcuuucuucugggaggcggagauccuuagggccuuuaugucuaauagagacugguuuguuuguuuugauuuucaaacucagaaucugauucagaguugagucuucuucauuaaccccuuauuuuuguauggugggauucuugucacuguauuguauauuguguugacuugucagauagaagcaauguuuuauugcauaaguuuacauuaaagaaaucaggagguauucacuugguucuuguggucuucauauguuuccaagacuuuaucuucccuugugagaaaccuuuuauagcuuuaaucauuaauaaacauugaaauuuccucuugaaguauguugugugaacauacuuauauuuuuauaguccuauguaaggugauuuuauuuagacacauauuugcaaacagauuaaauacguaaaacacuuaauacuaaaaguuaauuucuuaguauuuuuuuuuaauuuauuuuugagagaaaacagacuggcuggaggagagaagagggcaaggccuuagugauaaugaacggccuagcugugacaaaggagaaagaauuguugaguacagaguagaugaaagauuuuggcuuuguucugguuucuguauacaaucauauguuucauagugacauuuuggucaauaaugaugaucccaggagcuuuuaauugagcugaaaaauucuuaucuaguuuaaguacugagccuuuucuguaauuauguauuuugaaaaauguagacauuguaguugccuaaaguuaauacuuaguguaguaacguguuuugccauauggcuagguauaaaauaggcaauccauguagauuuguguaaauauacagauguauacacaaaaacagaauucaccuaauagugcauuucucauaaaguauuccuuaucauuaaguagcuuaaaacuguauaaaaguugacguuucaguuauuuuauaguguuucuguguaguuaguacagaguuagauaaugucaauuuacauacaaaaaacagggaagucuauuugccaaacuacuuuauuucaacuaaugggagauuuauuuauaaaacuuuaggccuuccauauaucagaugugauauuagcauccuguaaccuuagagccaagaauguaacuccgugggugaauccuugcuuauuauuuguggggaccuguguuugaucuuaagcacaugugcagacacacuguauccuagaauccuguaacuguuugaauauuugaaacaaaaguauuuuuucuuuaugaauucuuuuuacuuauuuguaauauuuugaaggagucaauguggaaugcuuguuacugcccuuuagagugggguuacuccucuagaauucaagguuuuauuauuucuuuauagaaaauauauuuucuucuucaggcgauggagaagauaacagaccaggaaugagagggggccaucaaauggucauugacguccagacaggugagucccguuagcagcaguccgucgucauccuaaagcugcgugcuguauguaucagugccuacauuuaagaucguuuauaagaguggacacuucucuuuccauuaugacaagguuagauaguagucacuaaacugaguagcaaagacaagaagcacuaaaacuugacagugagcgaggaggcugcugugcugaugaaguuagauacccuaagagaaacuuggccuuucaguaguuauaguguauaaaccuuuacucuguauaaugccaguaguugcucaaacagcauuuuacuuuuuucuaagaguauuuauaccauuuuauuacuuuguugugcugccuuaguacuugaguaaaaauauuguagauucauauuauuuugugaauaguuagaaaaaugcaguuuggaaacuaagucugacuauuuucaaaaacuauuaguaauaagacugaacacuuuacacuuuguuaaauauauaguaacuuuagaauucgagaguacuguuagagucuuuggaaaacuuuucuuucaucuugcuuccuaauccgugccccuucuugcaaauacucgccugaccuacagaaguaggcuugaauagcacggggccucuuaagcgcucguuucccuguaucagguuuguuuauuaaagaggcaaauuguauauagacuguuuucuuguuauuaacacauuaagagaaauuguguggagaaaccccuuaaauuuccucagcaaaaugcacuuuguuccaguuugucaaccuugacacuuaaagcugaccuucagcaggcagaagcuccagagugcuuacuccccugcugucugugggaaagagaccauacgugacagggaaugugcacauaugagaaaaagaucauuuaaaaauagguuauggaauuugaagguggaaaagaaagauugaacugauagcaaaugucaggucagaacuuaguuuuacaaugucacugaagauuacauuuagcagagguucuucuugggaagcucagaaggugaagguguggacaucuuuccuaccguaaucuguuuuaugcacuagagacagaauuguagcaguuucuaaguggguuucucuagucucaagaguuuauaugaguuaauugaggugugagcagggcuggauggagugcagcauggugcugucucaugccuguacuaggcgugucaguuaggaguaggucagauacagaauacaguagaagucacgcuccuuuuccagcaaggcuuaaaagggaaaaaacaaaauagccacaaauagcagugagucauguauggaaauaaauuaaaagccaaguacagcuaggcauaaugguguaugccuguaaaauaaguacguuuuauuuuggcuuauuugaugugguuguaugccaaagcaguuguuccuucccaguguuucauguaccuuguuuucuuaaacauucagguuaauaguuucuaaguuucaguguuuuuuuccagucaguaguuugaauagaagcuugcuuaaugccagauccgaggguaaaguaaccauagaaguuuauacuuaaauuuuaauauuuaauugccaaaacuuauuccaucaugaaccauauuguacuuuccguaguagcagauaaaugugaugcugugucuuacuguaucuaucgguauguuaauuuuauuaacuauagucucagaaacugauaccuguuuacuuaauauucuuuaauugugaguuggguuucaacugugauuuagguaaaacagguugugugaaaagacguguuuuguuuuuguuuuuguuuuuuaagcauagaaugucuuauuuuagguuauuuauucuucccguguaauuauugcugaauuuuaggaacuuaaaguauaaaucccauggcugcccucugaguagguuauaagacucagguaacauauaccauucuuugauaccugcaaagaagcugguggaguugucgcagaggcucuccauaacuuucugaacccuggacuaccucuguagcaaccauauuaaagugcuucaaaaaaaaaaaucucaguuccccuuaagcuuuuuaaugacgugaauaaaguagaguuuggguuguuaacugcaaucagacauucauucauguggcuacaauucugccuuuugugcuauguaugauuuguguuugagugugagugugagugucacaauguguauauggaggccagaggacaacuuuguguagucagguuaacucagggcaucagacuuuauccacugagccacuucacuggcuccugccuucuuguugauacuugauuuugugucugacuuuuuggcuguaucuguuaggacauaguugauacagucuauaguuucaaaaugggcaaacuuguuuaauuguagugugccaucuuguggagguuuaugcaaucagcagccugauuuacuaaguauagugguagauacugcaguugaguacuugaagcaaaagccuguuuuacuauacaaaaauguauacaaaugguguacaaaggccaaauucuuuacuuguuuuaacauaccucccuuauuuuuaauucauguucaauguguaaauuauagcacuguagauccaugguuuauuugguucuaguacuaaauguuauauccuuuguacccaagaauuauaguuuaauuguaacauuugugaaauaguaauuuguggauugauuggugauugccugaaauggucucuuaaaggaaauuggcuugaaauuuugaaaauaggcuacuauuaaucauauugccaccgaucucucucauucccuaugucuuucuuuucagucaguucugcagcaaguucagauccuaaccaaccccucuucuuaagguuuucuauaguuccuucaguguuugugggauuaaguuuaagcccugaucuagucacugccugucuuuuuaaacuuccugucuggccacuaccuuuguguccuuauuuuuuauacauuuucuuuuauuuacuuauuuaucauauaguuuaacuucuuugaaugcaauguauaggucuucacugugucuuuaugaaagguaaccauauuuagaaauuaggaaacuagugguucaaggacguuugaggucacacagcuguagagaguggagauugaagccugacuuuggaguuuaugccuuuaaaacacugcugucacgcugucuccauaucauuguuacucauuuuacuuugcuugaacagcuuuucugugccucguuuacugugccagaacacaaagcuacucuucccccaagucugugcugugucccucagccagguacucuucuguccuagauugccuguugugcuuuugccuucauaugggacuuggucuccucugcccuguggucacuuacauacccuguauagucacauccagauuguaaguuuuucaaggcuaaggaacuauuccaacuuuguuuucagugguuuguaaguucaaaucagugcuuuaaucuuuucaaauagauauuguuggagugcuaagagaaauugauagccaggauagccuauauuccuuuaaggggaauacugaacagaagaugguugcugcuugaggaagauuguguuccucaggauauccacgcaugucguuacaggacuuguaugugugggcauggacuuccaguaggccggauucccugcuaagauugaugcuuuuccuuucuuuucuacaccguacuucuuuccauaguucuccuuagauagcuucauaguuuaaaccuuuuuaucuuuuauauauuaguaacacuuuuugguauuuguuucugggugauuuaucuuugugaaacuuaagugauuaggugauguaauuaaaauuuuuuguuauaccucuuuuauuuggguauaucaaaaaauaaguuuuuacagaauucauuucgcuguacuauugcuucaguugggccacaaagcuuccauggacaggaaugacaucuuggcuugauucuguugggauguuugcccugugccagauuuuauuuugcucagcuaucaaugaggcuguuguggaaaugugggcuuucuuugcugugagaguuuaugcguacaaagagaccugcuuuucagaaagaacauugagaacucagagccuaagaggaaggguuauuaaaguuaaugaaccaggguaaccuuauccagagggugcccagaaguacuauaaaacaaaaggucaauugcuacugcuauuuuaguuauaugguccuccuucuacaagcuucagaaauuaacaggguuaauugcuguuauagugaggucuuggcauauaaucuuaagccagaugaaaauucuuugauuucuucuuccuguaaaauuaugugucuggacauuacuguaugucauuuaggaaacaaugcuauuuaacuaaugauaauagauuguuuuauaguuacgaaauaagacagauuuuuaguaguuuaaaauaauuguuuuauaguuuuauagugccaaagggauuccagguauugguuagcuuggauuccaguucaguaauacaguuguuacugugucugggauucuuagaagcugaaagguaacuggagguuuguuuuuguuaauuuuuccuuuuuaaaaauagaaauguucauuuuugacaacuuucagaauguuuuuauauaacuuagaucugggggauucccaacagaguuuuguaauaagauuaacaaucuccugccauugguaccagauaccuccgaaaaauagcuuaggggggaagaaaguauuuauuuugguucacaguuuuagagguuuuaguccaucaugguggccaugaagcagagggagggagggaaggaaggaaggaaggaaggaaggaaggaaggaaggaaggaaggaaggaaggaagggaggaaggaaggaaggaggcaacauagacaggaaacuaagagaagauacaacccuuaagaacacugcuccagggaccuacuucuagcuauacccaccuccuacaguuccuagaaccuacugaauuugugcuucuuagccaugaccaagccuuuaggagucagccuguaagggcuagaaguucaaauccaaaaucucugcuaagacucaagcuuuuaaagauagguaggucucuauaaaauaaguuagguaaacuucaaacauaaaaugacaagaguaaauauuuucauuuccaaaauggaggaacggacuuacagaaaugaaguuuauagccugucuccagucuccaggguaugugagagcccaguucuaagaggguugucuucucaccauuugaugguuaaaacucacagggccucucuuuaaggcuagcuuuucucauugccugcagcaguccucaguauaaucucauguuccugaaacaucuuaacuuccugguguucauuuguaucuuuggcuucguccccacagcuucaugcauuucccuugcaggaacucuauguacacauugucucaccucuaagccuuucuuugaaaucugaguagaaaccuucaugauuuugacucuagcauucuauaugucugcaaaaccagcauuagguaaacuacaccaaagucugcugacaguguaagagggcucagggugccuggguagaucggcauggugaaaucaucuuugggaaauaacuuccuuuggugugaggucauagugcccuagaggcucugauuucucaaugaaaagucuucuaauguguuuacucuuugcaguggaugggcaucuggccaauucccaacauguuccuguggcaucuuuccuauugucucaaccuggcuucuuuugaaauggcaccaagcucuucagaaaccaugucuucauguuucaaacuuguguaguuuuucuaaacaaacaaagguuuucaaaucugucuacacagucacauggucuucugagcuccauugggauuccagcuaagcucucccucugccauccuaguuguucucuaggcuguugcccuaaacauuucuaagcucuuucuacaaaccaaguucaaggaaccacauggccuuguuaguggcaacaacaggccuacuucucuggaaucagguuucuucauuagucaaggccuuuugucacugugacaauacaccugacaaauuuuaggggaguuuuguucaguguaggaaaggguuggcagaacuacucacacaguggaggccaggaaagaggacaggcugccagggcagcauaguaucuaaaagguuacucuuaguaaccgaccucuuacaacuaaggccuccuccugagaguuccaccaacuaggaccaacuucaagaaaagccuuuggaagacauuucaguuuugauccaguuagcacuagaacucaaccuuccuccaguggacuguucuuacucugagagcaggugaagcauuuauggacauuuuacuuagaaaaguugcuuaaaauuugaaauaauaugagaacaugacaaaaucuuagaugacagcccaacucuaacuagaaagagcuuucuagucaauuuagaugauagcugccauguguauagucuuaaaacagacacuucaaugggugaguggcuugacgguuuguaaucaguagguacaacauauuuacaaagggggagauacuuaacaaaaggaaaggcuuuauauagggaaggaucuaugauauaguguuguauaaagguuagacuacacagggaagaagaauaacaugaggaggcauggacguuacuaggagccaauggggagguucaaugagacaaauaauuuguuacaguaauaaaguauaaaugcaguagacauuucagagugacaauauauuuauuucuuaagguauuagauuaauauauuuguaaaauguuagcucaguucuuacaggacuacuaaugcuguuuauucuuaagauugagcuaguuuuaaccauugcuuuggcauuuaggcgacaucaccuuuaaugugauccuccccaucgccuccuaguaacguccaugccuucucauguuauucuucuucccuguguauucuaaguuuugauauuuagaguuuugaguaaugcugucagucuuuggucacuaaaaugcugcugcauuguuaagcugauaaauauaaacugcacauggucuaacacauucuuaaacugacugcaccaacuucaucugggacacuuuaaaaacauagaccuuuuaucuacuaaagaacuuuagaaucagaauccugggggacauggucuagugaucuaauuuuuaaauaaauuucucaaaauacaguucugaagcagucuuugcacauacuuagguuuaagaauggcuggagugcauuuugaaagcuacacauuuaucacuguaaagaugaugacaaguaucuucuuaaguguguucugaaacaacugagugagucuggugccuaugcccuuauccuuaaggcuuucuuaauacguacuuuuuuugauuuucauagagacuguuuauuuguuugguggcugggauggaacacaagaucuugcugacuucugggcauacagugugaaggagaaccaguggacauguauuucuagagacacugagaaagaggcaaguuccuagucuuuucauucaucuaccucaugguaggagugugguuauauacuuucugcaugcuuauuuucuucucugauguuucccuauaguuguagcaaaagaauuuugaaguaagaaaaucauuaguuuaaaaacucuugcauuugaauuucuaucccuggcucaucaauuacugguauauuuagccaagucuauucuguagaguuagauagcaauagguuucuguuguuguuguuguuguuguuuaacuuuugagcacuuuaccuuagcaguguaguuguguagcaucuuuucaggccucagcacucuacucuuguugcccacauuuuucccccgugcacugguaagaauggagcacaaggccucaaaguacaguguuacugaguuagucuagccuccaccaucuuaauuguauuuccucuggaaagcagucuuuuggugucuacuuuugacguccacacugucuagcuuuuuaaaaaaaaauuccuuuuguuuuuuucuuuaugaguguuuugccagcaugcauguaugugcaucacaugcaggccuggggccugcagaggucuuaaaaggucgucagaucccccugagcuggaguucuggaugguuguggccuaccaugugagaggugcugggaacugaacccagauccccugcaagagcagccagugcucuuacugcugagccaucucuccagcuccuugucucccuguuuuagccccucauuauuucacugcacagucguguacagucaagacagaaauaguuguuuauauauaguauagaauguuggcacaugaugaaauugacuaacaaugcauuucuaagaaugacuucucuucauuaagcuagaccugucaguuuucauaagcgauguuuaaguaaaauacuaccuauguauuuguguuugugccuacauauguauaaaugaagcauuucuauaaugaaaauggcuuucauuuauggcuuugaauuaaguaauacaugguuauauauguacauguauauauguauguguauauauauggaaaaggaaauauucaucuuugcccucaaaucauuguagaauuuuuuauuguauuuuccaucuaagcuguuucagauuguagacuggaaaauaaacuauaacagaaagaaaugaaaaaggccuaacucaaguaauacaugguuauauauguacauguauauauguauguguauauauauggaaaaggaaauauucaucuuugcccucaaaucauuguagaauuuuuuauuguauuuuccaucuaagcuguuucagauuguagacuggaaaauaaacuauaacagaaagaaaugaaaaaggccuaacucaagcccacugguuuuuguuuaggaaggcugauuggacguaucuggugaugugccuucaggcuuugaacauuggguacuugcuuacucaggcugcuccaaagauuaaucauuuggggaauacuuauuuuuccauaaaaccuugaaauucuaauuucuuuuucuaaucccaaguacauuaaaaacaaaaacaacaacaacaacaaaaaacagucuucaaucuucaguguugaaggaucauuuucugaaauguuuuuucuguacucaacauacauaaagacgucucuaaggucaauuuacuuauucucuguggucuugaauugaguuaauauaucuguaacuguuguguuaguaagcauaggcuucaucuuaaaaucuucccuagucacugauuacgucacaugcaugccaaaggacuacugagucagugcuucauuucgaaugcccuuucuucuccgcuccucuugaugcugcucuuuccugccuguuccuuuccucccuucccucuccacucccuaccuuuucuaacuuauaaaaucgccuaggcuggcuuugauugugauccuucuucaucuuccuagauuuacagaaauguacgaccaugcugagcagaaucuuagggguugccuuaaaguuugaauccagcugugucuccauagggaaguucaagauuaaccugugccacacaucuagacccugccucuaagcaaauaaacaaaauuagugaguuauuagucuuuuagaaacauuuacuuuggucucuguugaguucucucuacguuagugacuaauaggccuucaauguugcauacuaguaagccuuuauuugcuugggaggcaguaggucggcugggugcacucauugggagacagcuguugacuagccuaggauucuucagcugagacuacauggcucucuuuugcuuaauugcuuugccuaucuguaggcugacugggacuuguucuuggggcaagaacaagacugccaggggauaaagccaugaacuauucaccaagcuuguuuuucucuuuugugaaaaggagccagauaacuacauccagagucagugugaggugggauguuaaaggguauggggaaguauguauggaggggagccaauaauaaaacaaggagucuacccauauuucuuuuacuuuagugaaagcuuccauuagucaugcagguuuagcccucaccgacuugccagcaguguacucgacuguguaacaaccacaucuagccaucccugcaguucagccgugucuccgcuugucucacuuagcaggguuugcccugugugucucuagccucagucaguguguucucgaaagcucacuugacacuuccccuguucauuguagccuuucuugaggcuaaguggaauuuaaaccucuuuugguguuucaucugaauacugguuuguauucuuguuuucccaccuagggucuaggcaugaagcauauuauucagaauuuacuuuaaacaacuaauaaauauucuuguucuuuugaaaguaaauagaugagguaaaucaauaaaaaguuaguguuggaguagagcaaaagaaugaauacaaaauccaggccaauggguauuugggugugaggcuuuaucagauguuuuguguuugagacauggucucacuagguagggcagucuggcuauccuugaacuuugccacuuccuagcuuuaccuguucugugguggaacaauaggcguuugucacuauguccagcucauucuauuguuuuuuuuuauaccauauacauuguaauaugaaguuaaaaaucacagugauugcuuugaugaaaauauuuucucuuacuuugaagcuaauaaaauguuuuaguauuggagcucagguuucuuauaguuuguuucuccauuauauagaggccugugguuguuugaauaaaauuggucgccauaggcucauauauuuaaaugguuagccaucaggguacagcacuauuugagaaggauuaggaagugugucguuauuggaggaagauugucacuuggguggacuuugagauuucaaaagcccaugucaugcccagagucuuuuuucucuuccucucugccuacugaugagggaggauguaguucucaguuacugccacagcaccugccugcaugcugccaugcucccugccauugaugacaaugaacaaaccucugaaaugauaaagaagccuccaauuaaaugcucuuuuucauaagaguggccuugaucauggugucuccucacagcaauacaacagugacucagacagugccuaaagaccuuuagucagucuaucuaugaacugaauggugaugcugcccuaguuaaauagcucauuguuucuaacauuuggcaguuacuauuuugcauaccuaaguuuuuguaccaaugaguauagguuguuguugguggaaucucagggugugcguuucaaaagcaugauguacaaucaggaagcaaaugacuuacucacuugaauuuauuuaaacauguggcuaauaaagcacuuagagaucaaaagcuaauaggaagacugaguucuuaaggagaaaauaauuuuaaauguuuauguagcuaggcuaguaugcuuuuauugguuugagauguucuuuaaaguaguuaauaaugaaaggaagcuagaauguaauacuaaaagccuggagauguuacuaagugguagguagaggacuugccuuguauaagagccuguauuucuuggcacuacaaguaagcacaaagaaaaacauuuuuauuaacccugauccaccuuuaguauucuuuccaggcuaacaguauuaauacaaaugaguuuuuuugguuuugguuugguuuuuuuuuuuguuuuguuuuuuuguuuuuuguuuuuuguuuuuuguuuuuuguuuuucuuucaagacaggguuucucuguguagcucuggcuguccuggaucucacuuuguagaccaggcuggccucgaacucagaaauccaacuaccucugccucccgagaacugggauuaaaggcaugccucacacaaaugaguuuuauagugagagauguccucuuagaaaaggcuggguuaguuuuucauaaagggaaugcuggaaaauaucaucuaugcauauacacacauauuuuaauugugucucuuguuuuuuaaacaucucugacuucauaggauuagugagcaagaagguauuagacagggcucuacuuacuggauauuuauuuguauuagugauuuuucaaaucuuaugguuuuaggauuccuucguauacuuaaaaaacuuacuuguguuuuuuucaguuuauuuagguuaugcuuauugagagguacuauauuagaaauaucuuuagccgggugugguggcgcacgccuuuaauaccagcacucgggaggcagaggcaggcggauuucugaguucaaggccagccuggucuacaaagugaguuccaggacagccagggcuauacagagaaacccugucucgaaaaaacaaaaaacaaaauaaaagaaaaagaaauagcuuuaauauuuaucaauuaauuuaccacaacagcuguacauauuuuuguuuucaaaaauggcauuguuucagauuuuuagagaucccauuaaugacuagguuagucaaggacagcuagauucuuguuaucuguuuauauauauuuacucuccuaggacuugcuuuacaugaaaggaaugaagaggauuggaccauauauagauguauucgggacaaggggauggaucuuuagcagcguuuccaggcaacugcauauugcuuucuuuaaugucguuucucaaauaaacaaauguuucuuaaugguaguuugucacgugguccauaucacuuagcacuuuguaucuguuguguuaaaauccauggucuuguuugcugguuggauagauuuuauaaaaccuauacaugcuuuuuuacuuauguguuguucaugugagaaauacugauucacuucuaaauguuggccuauuuuaucauaugauaucccaaaaaacaauuguucauaucucugucggucucaaaggaaaagucuuugagcacugagaaggugucaagaucaaggacaguuccauaguucuaauuguuacacaaaacaugcuuuauaccauuggcaacagauuugguccauuuuacuucauuucugauaggguucuuuucuuuugagacaaugucugucuugaucauaauuucugaauaaacauacuauuuggguguuguuguuucccgagacagggucucacuuauguagccuuugcuauccuggaacuaacuauguagacaaggcuagccucaaacucacagaaaucugcuugcaacugcuuccccagggcuggaauuaaaggcuugugccacuauaaccagcuuaauaagcauacuuugauuacaguuguucucccaauauaguccagagguaaaacuacuguaugaacuuggaacaccagcaacuauauaaauguuuuuucagacaaccauuccacagaaaaauggcauuguuucguacuuuucaagucucuuuaauguuugaugcaauagaaggaaguugaagugguugagccacgucugcugcugcauucagacuuugggguaucagaaaaguauguaguccauaaaugaguaugaagaggcaaaugguuaacuguuaucaugggaagaacuuggcauuauagacugccugaaguaccccagagagaggcauuuguuuggauuaugauuuuaccaaauuauaguauaauuuuguuauguaugacuagagacagugucacaugcucuuccucuucuuuaccucauaacuucauugcuuucuaaugucuuucccauuucaccauagaccuugacuugugaaguagaguggugagagugagcaucgcuguccucagaucuuaguuguagaauauuuauguguugcugcuuagugccagcuagguuucagguuuccuuuaucagauugaagcacuuucuaguccucuuuugcugugguuuuguuuuguuuuguuuuuuguuuuauuaugaacauguauugaauugugucaaaaauuccuuuuguauugguauuaauauuuuuuguucuguuaauguaacaaauugccuugauuauuucagccauaaaauugguuuugcauuccuacaagaaacguuuuaaugaacuauucuauucaaaauugcuggaucugguaauaagagauggcucagcaguuaagagcaugugccacucuuucagaggacaugaguucauguccagcacccaccuggcagcucauaacugucuauuuucucaagauccaguuccuuccuggucuuuguggcaccagacaugcaaaugguauacauguguaaaugcaugcaugcaugaaacacaaaauaaaauugacuuuugaaggugcugauccuauugauagauagcaucauguucacaguuacuuuuauguauauguccuuaagauuuucucacuauguaucaauuagcuuucccuuccuuuuccuuucugcuuuuaacucugcgagcuaugauauugguaauuuaguuugugugcuguuaucugcagaaaacuaacuuagaggugaaauagaacagacuuuaaaguggaauuugucuaaaauugacaauuucuuguaugaauacuugauaaaauuuaccagggcagauaucugaguccauuguucuaggaagacuuuagaaucuaggaagacuuuagaaugauaaauucacuuuuuaugugaaaggacucuccauuuuuauuccaugucucauaacauuugguagguuauauauuuuucaaggauugugucuauuuuaucuacauauuuuauuugucaaguuuuuaccuacacuguuaacuauugucaaauuguacuugcuuucuuuuuuuuuuccccgagacaggguuucucuguguagcccuggcuguccuggaacucacucuguagaccaggcuggccucgaacucagaaauccgccugccucugccucccaagugcugagauuaaaggcaugugccaccaugucugggucuguacuugcuuucuuaauaaacauuauuucccuuguaauuccuguuauucuuuaguaauauuccugaguucauuucuaguauugguagaauuuucucucccuaaaagccuagcuuuguugguguuuaaaauacugccacucuuuccaaggaccuaaauauuaguuagcauucucugguuguuuucuauuuucauuucuaucaccuucauuucuaauuuuccuuucucugggguacaguuugucauuuuaaugguauuagugauacuuggacagaagcaagaguuucuaucuuuugagaauuaaaauuuaacauuaaggaaaauaccgcaugggcuuccggcauauaaugucaucuuuguuucugagauccuggaagaaacuuucccuuaaauaaaauuucuaccuuauguaugaaaucuuagcaaauaaauuuccaaaacauguguauuagaauaauuccuaugaguacaaaagcacagaguccaaucagcuuacuuucucaauuacuguuacuauugucaagccuuuuucuuguguaauauucccucguuuaaucaaguuaauuacauuauguuacuucucuuaaaauuuugcuauuuuguguucugucuuauucuaggaccuuuuuauuuccugcagauuacagccaggcucuuguuacucagucagcagcuuuccugucucaccaucucagucuugagcauauacauuguacuagcaguucgauuuuugcuuauuucucucuucugaggaaaaacaacuguuuauaaaagugaaaaagaaagggcuuucuaauguuuucagucugguuacagugggacucggauaucaucaucucuuucuaguuuugugauuaguaauuuagacucugugaaguagugauaauggcuuccuuauuggguuuuguaaggauucagugaaacacaucuaucuauccacaguaauaauggaaacagaauuuagcaaguaugcagguugguuuuaguuagccugacacaaaccuagacauaucuggggugcuggaaucuuuuuuuuuuuuuugaaguuggauuuuuuucuuuucuuuuuccggagcugaggaccgaacccaggaccuugugcuuguugggcaagcgcucuaccacugagcuaaauccccaacccuggggugcuggaaucuuaauugagaaaauguacuggcuaguuuuuugucaaaguugaaacaagguagagucauucagagaaaaacagucaaacuaaggugacugauguugaucuuaggcaugugcgccccccacccccacccccacgcacacccuuccuuauacauauauaagauaauacauguacaucuuuuuauuuuuguucacaauacuuuuaaagaucccauaugccuuaaacuagauuaauguguaauagggacuugaguuguguguucaaggaaaguaaaacacaauguugaauaugauaugauggauauuaaaacaaguaccagaguggauagaguaguuuaugccuguuuccuggcagauuuaaaacacuuguaggguaaaguuugugucucccacugauacuucugcuuucuuuuagaguauuaucuagucuagugucagauccacaucaguugacuuguuaggaguuuuaaugaaguacacugcagaggagggcauuucuacgcuuugcuuuuugauaucuccuuuucuuuccuccccuuucuccagaaugguccgagugccagaucgugucauaagaugugcauugacauucagcggagacaaaucuacacauugggccguuacuuggauuccucugugaggaacagcaaaucucugaaaagugauuucuaccguuacgacauugacacuaauaccuggauguuacuaagugaagauacugcugccgacgguggaccaaaguugguguuugaucaucagguaguagaguuaauagugcugagugaccuuugcucuucagggcugcucuagacaugucugcagugcugucucauugaugucauuggcagguaauaagaugauuucaggaagggcaagguuauuuuuauauuuuuuaauuugguauaagauaaaauauuaagcuauuaaucuuaauauuuauguaauuguuaauguauuuaaaacuuuagagaguagauggagcaguacuagaaaaaacaaaucuagagcuuuauauauauaguauaagaauuacaacuuacccuauuaauauuuuuuguucuguuuuucuggaagaaauuuaaaaucauuaguuaaugaguuugcaaucuagaaccuuccuuccaguuaagcuaaaauauacuuaguuuuguuuguaaucagaaacuugucacagagcuauguaggaauuuggcauguucuagauuaaguuuaaacucagcauguaaugguguauggacaaggcaaucgugacuagugauguggaaaccacuuugguuacuauggauguaccgcucuucaucauccuuaucauaggcaaagggaacaggaacugcuuugaacuuuaugggcaguuuuacuuaguuaaccuguuuacaagcuuucagacuguggaagagacuuauggucugcuccacugugucagcuaguguuguguauuacuugggaaauaggaaguaacuauagaauugugcugguuuccaccuucagccuacagucuaacauagcagcuaauuccaagccuuuauuguuucuuuguagaccauuuugcuuugcuuugaaauucuuuuuauaguuuuguuaauguguggcugguacagaauggagaaaagcaacuaaauggcagugcucucauucaguuuggaacugugcagggccuuucucauugaguuucucagagccaagcucauccuugacggcauccuugggguucuucugggacaaaagacuaaaagauguuaggcugauucugguugguuaagaacagaacaucagcaggugauauuaucagggaacaguuuaucuguuugauaaaaauuuguuaauacuuuaccaaaaaaguacugaaguuuucaaaaauuacuuguauagguugaaaauagaauagcuuagcgauagucuggcugaggcgcaaaguuguauaugacauuuguuugucugacugguaaaauuggauguuccuuggaaauuggcuaguauuacauaaauaauacuaggcuuuuaacugauuacauggugugaaagaacagagaggggaagaaaccggacuuugguccuaauucagcuaaucagugauggccugugcugcugcugagcuagcggcuucugucucggccuccaguuuacgcuuuauuuagugaguuagaacuuacuaacuugugucuuugacacuccaaaaaucauuugugguaucaugaugcuuuagggcucaauacuucacauucaaaauuuagaagaaagugggaaagauaaaaacauguuuaaaauuauuuucucauuuugacuuuuaacauuaaaaacugaaauucaaauacuuuuuauuucuggagagcauauggcagcuuagcucgcagacauuucauguuguugcuuugccuaggagaauuccaacagaacggguuuuuuaaaccauauguaagucacguauccagaaaaauggggagccagagaaaguucacaauuccuuguaaguuuaauccaaaacaacagaaaacuuugguucuuguucuaaagcccacacauugcaauugcaaugaagagagguugagaugcaggggacccuguaguagcagacuccucaguggcaagaacgagcagccacagggagagagacagagcauuagccuguagcaguaucagaaagcacaugaugcugaagaagcaguguuuucuaaaagggaaacacuuugacaggggcaacacuguuccuuugcaguagcuaaugagcuaggaggacucaaaucaugagagccagucagugagauggcuuaguggguaaagaagcuuguugccaaguuagucuccagcaugcacaggauggcaggaaaaaacugacuccugcaaguuauuaucugacauccuuauggauacuggcacaugcaugcacucacagguauauaaucacacucauauagacaccucgagauagaccaccucuaaaccagaguuagacaagacauggcuucccagaagcacacaucuguucaaugacaccaggguccuuaagcccuauugucccucuucuauaggagcucugugaaagcuguuggguccaaggaaaaccagcuuacuuaaacguaaaaaauuauaagcaguuacgagaccagaucuuuagagaacacguuaaagaaaauaauggaggggcuggagagauggcuuagaaguuaaauauacugauugcucuuccagaggcccugaauucaauucccagcacccauggcuuacaaucaauuauaaugggauccuuugaccuuuucugguaugucugaagacaguaacaguguacucacauacauaaaauaaaucucaaaaaaaaaaaaaaaaaagaaaagaauggagaaaaauacuuccuuuggaacaaaaguaugaguuuuauuucagcauucuagcaguuuaacaacauaaugaagccugaaacugaagauaacuacacacaaaguauacauugaaaaaugcacaugugauaaccaaaugguaagggcagauggaagaaaccacauagaaaucagaaaugagggccgacaagguggcucaggguuaaaagcacuugugacucaagcuuggugaccugaguucaaucccugggccccugggaaaggugaaggagagaacuuacucuguaguguucuugccagaccacugugcacacacacuucaccucacaguguaaaaauaacaauaaaaaucaaagaauacauuauuuuuagaaauggagacuuuuuuauauguguaaauaagaauagggaucauagugguauaaaacagacauaaaauauauuugugagaggauuacagagaagacugucaaaugaaagccagccagcuaccucuuaagacauuaauaacacuaaauuuaaaaccaccauuuuuaguuaguagacaaaauuaugaagccacuuagaauuaaaaugagacuggguguacaucuacuuccuguucuguuuuggcuuucuauaacuaugaugaaauagcugaagcauuucacuuagagaaaaagacucauuuugucuccuggugguggauguuguagucuagguggcaucauugcucugggauucugguaagggcagcacauuaggacagagccauguggcagagccacacuauuuacaugaacugaugugcagaagagaaagggcagaucagagucucccagucuucuuugugcucacaauccuaauggucuaaugaccugccaaaggccacagcaucugucaguaaagccaaauuauuaacauguagacauuugggagacacugcccauauuuagacuguagcaaaugucaagagacagaagagcaacuucuaaaaagguguucaagaaaaaaauagagugaaccaagaacuuuaagacauuaguaaauggaaugugagcuagccaggaaguagcaggaaagaguccugugaagaucucugucuuggccuucuuucuguaccaaaguggguaauugacagagcagacagauaaaggugcuguuacaggggacacauuagcaaugauucugugaacaacaguguucuuccuucagcacgucaccaguuugugcaagcuuuccugaagguagacggcagccagaucaugaccagccaguaaaaucaggaaccagaggcauauauacccccagccaaaagugaguuauggguuagggcuaaauagcaggguauccucuggucugaugaaguagcacuuagcugugauaauucauaaaaaaaauuagaaaauggguaaaauauagaagaagaaaauugggacuguccacugcuuauugggcuuuagaaaauaucaaccugacagaguagacaaguaguuuuccaacuuuuaaacaguuaggguuuuguuuaucguguauggggggacgggggcgggaggagacaggaggugguggcaguuucauuuuguagcccuagcuggucagaaaauuacuauguagaugagacuagccucaaacucaaaagagauuugccuuggccuccugagugcugagaucaaaagcgcgugucacuacacccacuaguuguucaaauuugauuuacaaauuuuuauaaaagcaccacaauuuaucauuguuuuuauaacuauuuuucagagauuaaaaaguacaaaauaggaccagaagauggcugggcagguaaaagcaugcacucuugcagaagacccauguuuagccccgagcccccauggccgugucccacaacaccuguagugucagcuccagggagccagaccugcuuuugaguuccaagggcacuuuucacacauguguauaugcccaugcagagacacaggcacacauguucaaaauaaaauaaaugcuaaaaacauagauuaaaaacuaaauaaaaauauaaaaugaagaacuaauuaauuauuaacuagguaaacagcaucaagaugccuggagugaugaaaauuuguugauaauugauucucauuuuaaaaaauauguaucaguuuaggaauacauaauguauaaauaaaaguuauuucuguuucauguccugugugcuggaaauguggggaagacagagaaagacacacgcagagagcaugcuagaaucuuuucuuuuugcaguaguuuuuuuuuaauuggccuuuacaacuauuaagauagcuuuguauaaaaauuaaaaaguaauuauaugacaaaagcaguuuucaaugggagaaaagcaucaaacucguagcugccagugcugugcuucagugaaagcucggaugccacuuagcuuugauagcugaacuugagcuugacuuugagaugggauuugauuguuaauaucuuguaacaaacaucucuuuccucauguuauuuuauaaaagguucuaauuuuuguuugaaggaauguaaaaaaaaucaagguuguuuugaaucacauagcuuaagucaauaaaaauuaaauuuauaauguaaaaagaggcagaguucuucacacuauggaaaucagucuggagauauguuugcagaugucuuuuguuuuuugguuuuguuuuguuuuguuuuguuucagacaagguuucucugucuuggcuguccaggaacuugcucugucgacugugcuggccucaaacucagagauaugacugccucugccuccuaagaauccuaggauuaaaggggugcgccuccacuacccgcuugcuguauuauuauccuaggacuaaaggggugcgccuccaccacccgcuugcuguauuauuuuacaacauagugugaagaguuuuguaaaaugcauguagaaguuaauuuagcgauaucgcuaaugugcaugcuggguaucugcucuuauuaaacaagugacagcaucucaaauaggaagcuuuccuaggacugaaaggccaggguucuucuaaggauuaagaagaacuuauggucaugaacuauccauagaggugugaucauuaugcacuccuagugaaaaccauggaucauugugacuuugguaaaaauguuuauaucauagcaucaagaaacagaguuccuuaacuugauauauucauuucaauuuugugaugaaugaaaauucaaaagguguuuagaaaacuauccugaauuucuggacaguauguguguauaauaauuaaggcauguauuuagcaucauuaagagcaaaauucaagguuucuuugagaaugugaaagcauauauacuaaugucauuuuggcacauaugaaaggaacaaacuaaaacuguuguaucuguugcuuuguucuuacagauguguauggacucagaaaaacauaugaucuacacguuugguggcaggauuuugacguguaauggcaguguagaugacagcagagccagugagccacaauucaguggguuguuugcguucaacugccagugucaaacuuggaaacuucuucgagaggauuccuguaaugcuggcccugaggacauccagucucggauuggacacugcaugcuguuccacucaguaagacuaugcugugcaucuauuuugucgugugugucuuuauaggaaagagucaguaagaaagcaaagcuuuuucuagaaauaaaugauuaauacagcagugacagagagaauagaacaucaggagugaguugucccuuagucauuuccaucagcuuacaaacuccugaagauaccgcuggaugcuuuuauaacugaucuuacugcuuggcgagcuaauggauaguuagcucuguuuuaggacuuaaucauuugcaaacuuuuucuuagcaacuagaaagauaauuuuggcuuuuuuuuuuuuaauuuuggauugauuuuguagaauuuaaccagcuuauugguaaaaucaacaaaaagacuaacuuuugaagcauauaaugaaauccuuauuuuuaugaacaaaugugguauuuagcaggcauguuuuaaaaauauucauuauaugaauuacaacaaaggauauaauagugaauuuccauguacagguuuguccauuugaucaguaaacaaucuguauguuuguaauauaguucuuccaccuuaucuucauuccuugucucuuuuuuugugggggggggggcgcgacguugguugguugguugguugguugguugguuuuuucgagacaggguuucucuguguagccuuggcuguccuggaacucacucuguagaucaggcuggccucgaacucagaaauccaccuaccucugccucccaagugcugggauuaaaggcgugcgccaccauuccuugucauuuuuagggcuuaucgcauuuuguuguguggggaguauucucaggaggacuucagcuaguauguccuuauuuagcaggcacuucguaucugggggcugugcauccacaggcucaaacaacuauugguugaaaauuauuuaaaaaaaguuugucuccacugaacauguacagacuuaaaaaaaaaacuuuauuuaaaaacugcucuuguguccuauaguuuauaguuuauauuaauauuaagaguaauguagagggcuagagagaaugcucagggguuaagagcacugacuguucuuccagagauccugaguucaauucccagcaaccacaugguggcucacaaccaucuguaaugggauccgaugccuucuucuggugugucugaggauggcaacaguguacucacauacauaaaauaaauaaguaaaucuuuuuuaaaaaaauaguaauguagagaugauuuaaaguaccuaagaggauuuauuuauuuauuuauuuauuuauuuauuuauuuauuuauuuauuugcaaauccuaaaggacauuggggccaucaggaugaggaccugugcugacacuuugugacaacugcaccuacaaaugauacuauucuguaugacagacugacacaaacuuaaaaaugguguuuaccauugucauaucacccacaacaaaagcaguguauugauagugcuagucugcauuuguguuguucugauacugagugauguuuuuucagaauugguuuguugaggucaggaucccauuacaucugugcgcugcauuccucuccaucccuaucaguaccuacaccuuuauuuucuccauauacacacuacuuacuccugcuuuaaaaacaaaucauugauaaucuaugauguuucucauccucauuugacucauuauacuguuauuacgucuuuuaauauguuucucuaucauauuuucuauaagcuagcuauuucucccuggaggcuugaucuguauucgcuacccuuucagggggaaaccaagaagaaacacaucagcacguuaccaauacucugaucuuagaauaucaacaggcacuuaaugucuaguuguaauguuuuuuauguguaccaagaaguuuaggaauuuuuaguuugauugaucacuuaugaaauuauauuuccuauaauauuuuaccuauugcuuucagcagccauugauagucaucgucuagaguucauuagauaucacaaagugguggguuuucugauguucuuguuucuucugaauuuauuaacuauaauucuucuuuagcauuaaagaauaacaaaauaucauccuuaugucucgaauuguuugguuacucuaaaaugaaaccauauaauauuugggccaggccugaugaugcacaccugugaucguagcacguuggagacuuaagacauguagaccaugcaccugagcuacacacaacaaguucaaggcuagucuggaacacauagaaaaacccuaucauaaaaaaaucuuagugaauguugggugugguagugcuugccuuuauuaugaacagagacaguaggaaucucugucaguuucaggccacucuggccuacacagugaguucuaggucagccagagauauguaggaagacucugucucaaaacaaguaaaucuaagcgaauggauggaugucugauuguuuuguagauuugcauguuaauggauucagguuccaaaguuaaccagugaagucauaagaaguaucauaauuaugagcucaugaauuuuuauauacauauuuuagauuaaaugcugucuuuuuuaaucaauuuuuuuguuuguuuuuuaaaucugucuuuagcuauuaggagcuucuucuuuacccuuauauacauauuuuauuuuuuuggcaaaaggccaaaucaugaguucuugcuaauaaaucuaauacaaguuaauuuuuuuucuuuugcuuaaugauuuugauuuuuguacuuguauaucuuuuaugguuaaaaaucuuauuucauguguguuacaguauguuucaucugugaaauuuuccaccuaucaaagcugacaacaaauucacuaugcuuccaaaguaauugcuuucuggugaauuuuuaauuuaggacuucgacuauaagaguauauuauggaaaacuaaauuaaaaauaaguacaauauuucugaguuuggcuagaauucuauguauaaagccauagcuuuuauacagauagauuuuucauuuuuguuuguuucuaaguuuaauauucuaauaaaacauguauaugguuauaaaauaaaacuacaagucaggguacuuuuugagaacucugguuuuuauuucagagguaagaaguuagauuucuuccguauggguagcuauccuuucuucuguuuugauuuauccaaacacauuucuuucuugcuuguucacucuuacuugugcucucauaguucuacaaaaggcagcagccuugcuauucagcuuuagugggauaccuuagcagugguaguguggagagagcugccucuuuccucuucaucugaacaaagcagugaugugugguaucacuugggagacgacucuuguggggauguaaagugugaaggcucagucucaguacuucacuagaaaugacagcucccuuuucuccuuuuuauucuagaaaaaccguugcuuauauguguuugguggccagagauccaagaccuauuugaaugauuucuuuaguuaugauguggacucagaucauguagacauaauuucagauggcaccaagaaagacucuggaauggguaagaauauuucuuaugcuguaacugcuuauuauagaaaacuaauguccauuuucuucucuuuauaaccuucauacuuucucuacuuuaauugaaauaauucuaaauuaaagguauaaaacugucuaauuccacuguuuaaaaacacgugauuuauucuuccuuauuuuaggaaaguagacuguguuaauuucugaaguaagcgugugugucugggcuuccuggggcaggcuuugugaagaagcagcgucugaagaagcauccgcacuugcagaugccuguggucacuguagugaccuguaggugagacaggagcacaguggaguaugacugcucugccuggcaaaugugcaagcuuaucuaaauaggcucuccuagucagaagguggcgcucuaccaaccagguucauguccauuguccuggcaugauuaguaauacacugcacacacuauuuuuaaaagucacauuuugauaauuaacaguuaacccauacaguaauugcuuuaccugugauuacuauauccagaagaguagauuugauuaaggcccaguuuggcacuggaguuagaauuuagaucagcuuguuuuucauuuuaacugccauauagaaaagggacucucuuaucgaugguccuuuuacaaaaugaauuuaaaguaccuaaguuggaacugggaagguagcucugucaguaaaaugcugcuacacacgcugagaacccaaguugagaccaccagcacccauugaaaagcuaggcauggugaugggugucuggaacaccugugcugggggagugaagcagccagaucaucggagcuugcucagcagucuagcugccucagugggauccugucucagauaaucguaagggagagaacaauagaagaaaacaucccuguguugaccucuagccuccacaggcaccaacaagcacauguauuugcacgcgcgcacacacacacacacacacacacacaccuuaccaccccaccuuaacccccacaaacacuuaccaccccacaccuuaacaccccccccaacacacacacaucuauauccacacacacaaauacauauguuguuguugucauuuaugggcacuauguuagaguaacccucuuuuaauuaaaguuguuuacauagaagaggaaaaagacuggucuggugagauggcucgguggauaaaguccuugugaugcacaccagguggucugaguucuauccugggaucuuaugauggaaggagaacuguguccuagaaguuacccucugacuucuugcagacauaauguaugacaaguagccuaucuacucacacacaauugaaauaaaaaucucaaagaagaaaaguuauuuucuuuaaaacguaacacuaaaggagaaaauguagagucauuuggcucucaggaucuguacucauacccuccuuacuggaguucaggcuagagguuuguuugcuguguucuguucuuugugacuaccaguaaaauggacagucuuacaaccuagucucugauucauuggccagggcuacagaccugcaacccuagaguuuucccaaccguaaagaacaaaguaaauggaagauguggaaauaaauauuugaaaauuucugcagacccaaaacacugaucuucagauuguaaauggcccucuacaaauaaaauaaaauaaaaugaaguuaaauuucagaaaaccaaaaggucuccuugccagaucaucaaggcagaucauuguguauuaaggugcauuuuuguauucuguuagaaagaggaccuccuaaacucuccuagaacaaaaugaguugcacucaaggaaacaggacuuagaaggacauagaaacucucagugccauuagauacuacaagauaaagaaaauucuuggaaaaguuacuaaacuggagauacuuuuguagccaaaauggugaagaaaaaagggaaguuauuuuuagaucuacuggguaaauccauguuuacgcucuagaccuaccucuuagcaguuuaaacaguugcagaaucaucucucuaagcacaagaaguccagaguagaccaugagcgcugaugcagugauucagcccccagguucccuccugugcugcacugucuuuaguaaaagugguagcuaucuggagacaaguucaaacaugccuuuccuuccaaagguggccggcagggauugcaaaauuuguccugacaacucccagugggauucugcuuagauuucauuggcuagaacugugaaaccaggguucacuagagagucuggggaagcauguguuucggguaugaagcaaaaaggguuggaaauagcaguuaucucaagauaggaaacugauagaacuuuuauguacuauuuuuuuagaaagauacuuuauauacuaacaaaacaauaaguaucaaaagagaaaacacagaagcuuuaaaaaaaaaaaaaaaagaagaaaauccaacauagaaaaacaaagggggauuuccaagauguggcccagugagcaccaguguggcacagggguucuagaucaaaguaggcuuuuaaagauuuauuaauugauuguauccaugcaugugcucagggccuaagcuucaugccagccgcagcagcuguaguuauuucgaccuuacuguaugcuagauuaucuuuuauugaugguaagauccugauaauaauugaacauaauucaacuacauggugauagagccaagacuaaagauuucacugcacugcaccacuucccaaaacugaacaaaagucucacagaguaauaauaguggaaacaaagcuacuuaaaaaauuuuuauuguaauaaauuuaaugguuauaaucugaaaacauuuaaauuuguaacaauuauauagucauuugcaacauuguuaucuuuaaucaguuaugacuaccauugugacacuucucuugugccuuuuuuguuguaacuacaaagguaauaaucucaugguugagauucuaaaacaauaacaacaacaaaacccagaaugauacaaaacaauccaacuauucagagauaaucuauuaacauuuugauguaucacuuccuaaucuuuaaaaagggugauuguauccaguuuuguuuucugacauuuuaaauuuuacauagguuucuuuuggugaugauuuuuccuuuaucauaguuuuauugcuaugaacuuaaaguaauagaaaggcaaguugucucauucacuaguuauugcauuugucaguucuuccaaaauuaaaauuacauguuugcuguguauuaauuuuuaauugguuuacagggaauuaaccacacaaagcaugcaaauccauucauuaauuuaacagcauuugccgggcguggucuagcacucgggaggcagaggcaggcgaauuucugaguucgaggucaaccuggucuacaaagugaguuccaggacagccagggcuacacagagaaacccugucucgaaaaaaaaaauuagcagcauuuguugauuguuuacuagcauuuaagguuuauuagacccccucucuucaaauaguucauugacuuccauuuuccaaagauuguuuuaagcacuaaggaucuacaugaggaccccagggauuaagcuaacucaaaaaguucguauuccagugaagacuggcugcaguugcauccuuagugcugugaagaaaagaaguuguaugcuuugcuaauguguagcaugagagaggcacccuuaauacacuguaguuugggaaagcaucucugaggagggaauguuuacgacuggaaaugaggaggagagaauuagaaccaccaaacaaugauuuuucuuccuccugaauaaguuauuguaagguuucauuucugggucuagguuggauuucuuuugaggauaucucuguuaaguaugcauuuucaaaguggcugauuuuuacaaugauccuaagaauuucauugcucaaaaaguuccaaacuagaauauuuauuguauguucaguguuuuacugagaacuuuucuggcagaguugaacaucugguuugaacuagcugguaaaugugcccaccuaaaacuugaagaguuaugcuuggaauugaagaacacacagacucaguugaccuaacaguuaaacugaaauuaauauuuuacuucucuguuugguuuuggggcuucccagccauucucugcugcauuacuuaugaaggacagagccauuugcuuugcuuugcuuugcuuugcuuugcuuugcuuugcuuugcuuuguguaugcguguguuuguuuguuuguuuguuuggucugcccccaucugaaccugcuccuucccucucuucccccuuuccuuuuuucccuucuuuccugcucccuuucuuaugccuucccuuuuugucccccccccccccguuuauuuuauuuuuacuuucuuaaagaauuguuguaccuggaggggacugagaaccccaguuggagcucucaggguucuauuucaguucuuagauaaccuuaccugaugucuuagggugugcaucugcacuuguuaauuaccagagugauagcugaagaaaaaggcggccuugugcacagccucuguguuagcugaggugaucuaauccucuaguuuggcuggucuuguuggguaucuuuguuuucuccagugcuuuguuuucucugcugcguuacuuaugaagggcagagccaugggcugaacauuuaauauguaaaugguuucuggccacuuacaggugcuaaccaacaagcuagacaguaggacuagaauuaugaauaugggcucugucuucguacagcucuuuuugugaauggagaagauaaagaaguaagcugaucugacuuucugauuagagcuaauucagauuagaggaauuuuuuguuuuagacagccugacuguaugaggggcuauggcucagcuccgcagcccucuccuugccgcucucuucuuccugcacugcuaacuccauuagcacugacuagugccuuuaggcaugccauugcuuuugccucugucccuucugccacacuguccccugguuuuccgucuuacuuccaaacucuaauuuugcucacucacaagaucuuaccuuguaaauuuuggucucuugaaauuguuucccaacucuccaagacaggcuaggcauugaagcguaugauucuauccuucauggcuaacgcagucaaggggcagccuugacucugcauuccagaagcuuuggaaaacucugaggagggacacauuuuauucagaauuucuuuaaaagcauucagacucuuuuuuuuuuuuuuccuuuuuuuuaaaaauuagauauuuucuucauuuacauuucaaaugcuacuccccaaagccccguauacccucccccugcccugcuccccagcccacccacuccugcuuccuggcccuggcauuccgcuguacuggggcauaugaucuucgcaauaccaagggccucuccuuccauugauggccgacuaggcuauccucugcuacacucuuacauacccuaaaucucauguuaaaauauaguguacaaaguuaguucagaaaaccucaucaggaagaauggcauguuguauuguauaugcauagaauuauucuuacuucacuuuaacuaguauacacuuaaauuuuauuuuauuucauuagagcacuacuuugcaagaaaaaauuuuuaguaaugagguagaacacucuuuaaaauccuacauuauccaguguuccuagaaaauagcacuuuuaccuauuauguagaugauuugugauguucuaagccaauggaguguuuauuagcuguuuuucugaagcuuuuguauuucaguuaauuacuauaauuugagauggacuuaauauauaauuacauguuugugcuucacucaugugggugcuuugauuaaaacugcauuuacaaugugaguuuuacauuguauuguuugaaaucauagaacaagcuuuuuaacuauugagaucccaguuagaggugauauagcaaaauagcuucucuuuauuauauuuucugugugucaaauacuguaagaucuucaaccaguguucuuuauaauuauuuaaauguauucauuuggauucagcaucaggaucugaaacaccuucagcucuuauuguuuucuaacuugauucaacucuuguuuucuaacuuguauauaacacuuuugcauuucccuuagaagaaaauuauaauuuaaauugguggauggcuguacuuagaagggauuuuuuaaaagcauuauuagcaucguguuuaacaucaaaauucaauaugcuaaaaguuggauuuauuucuaaauugccuuuguuguaacacugaacacaagccuuuugguaugcuuguuacauggaaccucucucuguauuuagcagcaguugugaguuaugcauaggugguuuuugagacacacagcuuuagaguuagcuguaggcagugguagagugcugccucugcuugggugaggucaggaaugugcauguugcagaagugcaaccuucccauguugcagauacacaaucaagcauuggugggaagagguccuaggaaggagcuuucauccugcuacugugaaagcuugcugguuccuugcuuuggucucuaaguccugucuccucugacuuucauacuugcccuucuuuauucaguuguguucucuugcagcagauuaauguguuugguacaguuaauuaaaucagaacacucggucugaguccucaacauuagcaccuugcauaacaucucuggacuaauaaauaagucaucugaaaaugagaggauugggccagcugagcugaaaaaugucauuuuucucugccacuguaucagauauuacucucuuuccucucauacaaggguuguauaaguuaacacauuaguuuauuuuccugaaaaccuuaaaacaaaaccauacuuuuaaauuguccauaggaauguauuauuaugcuauugacauuaaagaaaacaaaaagauguaagaaauugcuuugguuugacccuaucuuaugccagcuuuuaagaccaagucaggcaguacagagacucuaaugacuucuuguuauucuuacuaugaaauacugguuggaaugauaauuuuucuugcaucauuuuugaggcagggucucaugcaucccugaccggccucuagcuggcuauguagcuugaacuuuugccuugacauuacaugcgugcaccauaacaccuaaucuguacagugcuagagauuggauacaugccauauguacaaacauacauguguacaaaacauguauauacauaaaagaaaaugcacauuuuucuuuaaaagaagaugacaacacuguuguugccuaccgaggagccacugucucccugaccccuuuuuuuaaaucuagaccauaauuuuguuuaaugacaguuacccagucucaggggagaaaucauagcuaauucaagccagucguuauccuuucauuuuuaacucuugugugugacucaagucuagcuagucacacauagcaaaguguuaaaaggcauuuggaaaagcauccuuucucaugacaguagagaggugcuaagggagugcucuccaucucuuggaugcucuaugaaagugugugacacuuagagcuacagcuggcaacuuuaagaaaagaggagcaggccaggaacucugcagagaugugaacauagcaccaugauuuagucagugugcuaagacaucccuggagcugguaugaguuaacuaaauacuuggguuuuucugugucuuggguuuaaaaguauucuaccaaauaacccauggagaacuguugcuguuucauguuucuuuggaaguucucaguuguucuuugucuaugucuuagcuauagaaauuaauggcuguguacuuuggaagcaaaguagagaugagauuaauuuauuaauuaauguaauaacaaauaagaaauugaaaggacuucaaaaauauuaguuucuuuguccccuuucuaagguuuucuucuaaguaaaaauucuggcaucacugcuuaucauguggucaaaccaaggaaggggaaagaaacgaauaaauagucagacuguaacggcuucuuacuuccccucuuacuuguaccuuuucccuacaaaaaguaggaaaagugaagaauuaucacaauuuuuuuaaacaaaccaaaaauaacacacugacagauaauugcuguguaagucuauuauuuucucagacaaguauguauucagaaugugugcaugguuaacuuaugaucucagacaaguaugaauucagacuguguucaugguuaaauugagguaucagacaagcauauauucuguaugugugcaggauuaauguguggucucagacaagcaugcauucagaauauguuccagauuaacuugugaucucagacagauguauucagcauguaugcaugguuguuuuuuguuuguuuguuuguuugucuguuuguuuguuuuuuugagacaggguuucuuuguauagcccuggauguccuggaacucacuuuguagaccaggcuggccucgaacucagaaauccacuugccucugccucccaagugcugggauuaaaggugugcaccaccacacccggcuauguaugcaugguuaacuugugaucucaaacaagcauacauucagaauguauguggcauuaacuugugauuuaauguacugaucugccugacucauuucuuucugugggucaguuuguaaagacugguuaaauuucuggcauuuggucaagcuuauuaaaagcagcugaauugaaaagcauuuaaaaucacauguguuuuaaaucucccauguugcacaacccuacccccuugcucagcaucucugccaucuauuaaaaacuacuaaagugagaagauagccuuguuuucucuugggaauaauacuauacaugaccagauuaauaguuauggcauguuacggugaaagguucuuuugcuuuuuuugaccuuuggaucuuuuggaauucugauaugcuguuuuuauucaguccaguuuuuaguuuauuauuaugaaagugguacauguaauuaauaaaacaauacucaaacaauauaggauguuacagugcaaaauauuauuaccaaaguaguaaacuaacacagucugcuaauuuauuuauccaaauucaaccuaagagaaguaaaaaugagagugugaugguuugaauaugcuuggcccaggaaguggcacuauuaggagguguggccuuauuggaggaugucugucacuguggggcuugucuuugauaucuuccuagcugccuggaagacagucugcauucuuuuggaugaagauguaagacuguuagcuccuccagugccaugucugccuggauacugccauacuucccaccuugaugauaauggacugaaccucugaaccuauaagcuagucccagaguugccuuggucauggugucuguucacagcagugaaccccuaagaaagagaggcaaguaggguuuaagaacucaguuuaaguggcgcgcacgccuuuacucccagcacucgggaggcagaggcaggcagauuuccuucgaggccagccuggucuacagagugaguuccaggacagccaggguauacaaagaaacccugucucaaaaaaccaaaaaaacaaaacaaaacaaaacaaaacaaaacaaaacaaaaccucaguuuaagugacccaaaggcucuaucuucaaacuaccuugaaugguuauucuuagcguaucauuauagaagcacuuggcaguagcccauucauugucagaauccaaagcagcauuaugcaaugcaagugccuuuguuacuguucuauugccuuggcaaaacacaaugaucaaggcaacuuauagcacaaggaguuuaauuuggagcucacauuuccagaggauuagaccccauggcugucaugacagggaacauggcagcaagcaacuaaacauggcacuggagcaguagcugagagcuuccaaccucauccacaaacgggaagcaaagacagagcaguacuagcaauggugugggcuuuugaaaccucaaagcccacccugcaccccaacccccagcaaagaguuccccuaacugggaauaaaggauucaagcacaagaggcuguggggccauucucauucagacugccacagcaggaucuccugaggugaaagcagaaguguacuggccucugagcucacuaguucauuucuucucuuucagcaacugccuuguguuuauccccgguacaguccuuguauaggggcuguggucauuguugccuaggcuucacucucuucuauuucccauaaacccauuagugugggucccaguccagguuuggccucugaauccucuccuuuauacaauccaaaagaauauauugcucauucucugaagaacauuaccaccucauagaucaacaugaguagacacuagaggacucuagcugucucaagaagagaucaguaaacucacaauauauguaaucaaauucuuaaucuuaaauucugccuuagcuuccugagugcuaggauuauagggguguauaucaccuugccuccuugccugcauaaaaugaugcuguaucaugguuuggauuuguauuucuuucuuuuuuuuuuuuuuuuuuuuuuuuuuuuuugguuuuuugagacaggguuucucuguguagcccuggcuguccuggaacucacuuuguagaccaggcuggccucugccucccaagagcugggaucaaaggcgugcacuaccacgccaggcuuggauuuguaguucuuaaggacaaugauguugaguagcauuuacugugccugcugaccacuucuguauauucuguuagaaaccuaagacugaguugucugucaguuauuuacccuggccaugggccuuuuaggucuaugacuuguacaucuuuguccccauucuguagguuaccuuuccaucuuuaaaaucaguuucacucuuguucuggugcucacucuuguguacagacucacaugugugcuuccucccuccuccuucuccuccccuccugcuuucuguguaugugugugcuguguauauguucuaccuuugacgcugagaacaagaagugaacaaagcaaccucugccuuuaugccaauuacauucuagagcaagagggaggcuguaaagagugucuauuguguaauucaaauggcugugagguguguuaaaagaugaauacagugggcauauagugcaaauuaaagauacauacaugaugaguucuagucugcuguuuauugugaauauugccaucuuaaaaugaaaguauuccuuucauuuuuaguuccaaugaccggauucacacagagagcaacuauugauccagaacugaaugaaauacaugucuuauccggacuuagcaaagacaaagaaaagagggaagagaaugucagaaauucauucuggauuuaugacauugugaggaauagcugguaaggaccuugucugugguguaucccagagauacauaaugaagcugguuuauuuaaaaaugagacgaguaggaggcuugugcuaauuugugauacugaaagagcacuaaauuuuuguuauauauuuugagacaaacuuauuauauagcccuagcuggccuuggacucacaauuuucuugcuucuacaugggauuauaggugugagcuagcccaccuggccuaaaauauuaguacuuuaaagaaaugaguauuguaaauaaaaucaguacuuguguguauagcagcaucaaaggacugggauuuuacucugcccacuuuacucuggucacuuccuuuucuggagauguaaagaguuuuaugcuggucuagguucugccaccaacuagcuagauaaaguugaagcuaauguucuguaaacaucuccauguccuaugcugaugaaggaauagguuugacuuagcauuuccaagucacaccuugucuggagcaucuggugagcagacgcuacauguugugcuggggaaacaguugcagaagacccagcucuuguacuccacucaacagaacagagacuuccaagaacagcucugcuuucuguggcuggauacuugguaacugaaagcuguuguuuucugagaaagacguuguuugcauucagagcaagagugcuugagucuucuacugugagcacacaguaaaccaccucaucaguccgugugcgugaacaguuccuguuucccaguacaagauacguaguucuugaaggaucggaauuaguucuaaauaguguguggccuuucgugagaguuacugccuuugcacucugacaugaacaaguguccauuuguuucugcugauaauuuggcauuggcaguuaacuuacugguuuuaguuguauagacaauauggcugcuggugauucucugaagugcagugucuuaaaagcagugucuucuaggucuugugucuauaagaaugaucaagcuacaaaagauaaucugaguaaaagucuucaggaggaagaaccauguccaagguuugcccaucaacucguuuaugaugaauuacacaagguauguuggccacuuugaucuguacauuuucagugaaaugcagucugaaagcaucucugaauaggucuuauuucugauugauuuuaagugcauuugaaugaaaaguuuuaauacagagguaggaauuuaauagaauguauggcaggcauuuaauauuauuuuuaacaaaccccccaacacaauagggauugaauuuagggcuucacacaugcuaagcaagcacaguaccuauauaucugucucccaugauuuuacuuuuuauuuugaacuggguaaauugcccaggaugccuugaacucucuguagcccaagcaaagcuuagaauccuccugccuuagcuucccaaauagcuaggauugcaacacuauccuacuagccccaguuuuuccuaaaauccuugaaaagaauauaccuuuuguaugguccauaauucgugacacuucuuaucuuauguuauuuguauuuuucuaccccacucuggaacagggucucacuaaguagucuaggcuggucucaaacucaagcugcuuuugccuuagccucccaaauguugagauuacagguuuacaccauaacguuuucccuauuuugagauaauaacuggcuucuuuaucccucuacagaacagauaaauaaccugugcccuuguuuauauguugugaauaucugucuuaguucagauuuuacugcuaugaacagacaccaugaccaaggcagcucuuauaaggacauuuaauugggucuggcuuacaaguucagagguucaguccauuaucaucaaggcggaagggagcauggcagcauccaggcaggcauggugcaggcagagcugagaguucugucuucauaugaaggccuauuggagaagacuggguucuaggcagcuagaaugaaggucuuuaaggccacacccacagggacacaccuacuccaacaaggccacaccuccuaauagugccacucccugggccaagcaaauuucaaccuuuacaauagccaaguauaaaauacaguuuuuguauuuugaaaaggagcagacauuagcuuuuccaguuauauaagagaucauuucaucuaucuauuucugguauaaguaaccucuaucuuccagcauuauaaaagugauuuuuguaucauuaaguguucagaguaguuucuguaacuauuuuucacucaaauuugauguguaauuuagugacugggcucagauaucuugaaauuuacuuuuguguuucaacuauagaugaauuuuuaauaucugugcaauauaacuuaaaaccagauaaacaauaacaugagaaggaauacaaguucuuacucuagaguuuuccagcuuaagagguuaaugaggaauuuucauuuaaugggcuagaaauaauauuuauuuuguaauaucucgcacaugcuaagcuaagacauacaaauguuuucauuuuuagggaaauguuuuaauauuuaauguaagcuuagaauaacauuaaaauuacucuguaaaaucucuauuagaauucuuuuacauaucuuguuuaauacuaaucgaacaauggaauaauauucugaaaguuuuaaguaucauccacuaguuggcauucaaguuaaagcaaaguaagaucguaaaguuuucuguucuuuugaucuucaaugauuuuuuuuaaguauugugucagaauuauuuuaaauauacuauuuuuuaggucaaucaacacuuaauuaacuggauagcccuuuuauuuguaguucucuaagaacuauguuggauuagcuuauuccuacauugguuuuguuauuaucuucuauuaugguuguaauuaugauaguaugauuuuaauacaaacauagguuaggaaaauacuuuauaguaaaaugaaaaugggaaaaaaaaucaugggaaaccuuugguaagaauguaucaguuuaaaagauuaucaaaugaauaaggcaaagagaguuaacuauuauguacuccuaguaaaagaaauuucauuauggccuuuguauagucuuuuggguguguauguguucuuuaaauuccaguuugcugucugugagugguuguuuuuguuuuguuuuguuuuuguuuuuuuauagguucauuauuuauuugguggaaauccaggaaaaucuugcucuccaaagaugagacuagaugacuucuggucacugaaguuguguagaccuucaaaagacuacuuacugaggcauugcaaguaccucauaagaaaacacagguauaaauauaauuuacuaaucugggcgugguagcuuacaccuuuaauacuagcacucaggcagaggcagacggagcucaaggccugcaugaucuacauaguaaguuccaggauagccaaagcuacaugugagacccugucugaaaagaauuucuuuauaauuaaaagucuuuaauuagcauugcuagcuacucuugguuugaccuagcugugggauagagguagucaagugcuauaaaugcacuggguuuacaaaugcuuucuucuuucaaaggaagauacaaaguaaggauacauacagggguuaauuuuuuuaaaagcaagugaaauuuuggaagugcuaauagaaaaaaaucacaucaauugcagaauaauuaugaaauugugugacugguuagacaugauuuauuccaaucuagcaagucacuaaaaauguaguggaaauguacuuguuuggguuacuagcagucguaagugcuaguaaaagcuuguagauuagguuaucauuuacuuacuacuauauguuagugucugaaucuuagucucguaauuagauaauagagugaaaaacugccauugucauuauuuugucaaaguagaaaacugagggaauuuuuaaauggcuuauauaacucauaaggucacucagcugaacugguaaacaaacaacaaguuuguuuucuguagaaucuaaagagaggagguguggcuuuuacaggcaguaugacaaggaauggacuauuaauaagguuuaaccauugaggucuuugagcuagcugaaacaacugguaggggaaaguuaguuagcuuuucaaagacuucugaugaagcccagagaagugauucaagccuuuaaucucagcacuuagcaagcaaagucaggaggagcuaucugaguucaagacuagcaaaaagaauaaauaaauauuuuuuaaaauuuuauuuauuuauuuauuuauuuauuuauuuauuuauuuauuuaaugaguacacuguagcuaucuucagacacaccagaagagggcaucagauccuauuacagacaguuaugagccacuaugucguugcugggaauugaacucagaaucucuggaagaguagucagugcuuuuaauuauugagccaucucuccagcccguaaguaaacuuuuaaaagacaaaaauaaauaugcauucaagguccuuuuucaauauuggauguuagcucucagcucaaaugccgaaaguaaccauaagaaagggcugaggcagcguguucuguguuuuuaugccacuacuauuacuccaaguaaagaacauagagaaauggugggccuuuaaacacuaaauucuguuucaagggcuuuugugggcuaagcucugagaugaguuaaccauucagcuugacugacuccagagauucucccugucuccaccucccagcaagugugcacugccuuuccaggcauuugacguggauucuggagaucugaacucaggaccccaugcuugcucagcaaguacuuuauccacugagcuaacuccccugccuuuccuuuagauugccugcaaauaguauuugauauuugguuauagcuuguacauuuuuauuauguauagacuuuauuuaacugaaaauuaggagucuuauucucuugagucacugagugagugaaauacuauaaacaguguuaauaugcuaacaagugccaaucauauaaugcuguauggcauucuauuuuauaugcaauugacuagucuccuuuuauuaaaaccuuuggauuacaucagcucacuagaugucuuagguaauucuguaauauuauaauaaauuauauuccaaaaggugauauaaaugauggguuaucaaaguauucuccagaaaguuacuuuuuauuucuucuagaaauauauaauaggucauuuguuuaacacaaucaugccagccuaaauuauuuuaauuguuaucauuuauuuuucuucuuuaaagauauucuggaucagggauauagcucagugauagaauacuuuuccuagccuuaguuuugcuucuuagcauugcaaaauagcaacuauaacaccccucacuccccaccccugagacuggguuucucuguguggcccuuacuggcuugggacucacucuguagaccaggcuggccuugagcucacagacaucugccugccucuguugcccaagugcuaggauaaaaggugugcaccgccacuauucaaauagaacacuuuugaugggcagguaggucauaguuuauaagaagaaaugaguagucaagucauaaagagaaugaaaauggauuaauuauuuacucacuuuacaucccaaucauagccccuccccucucuccucccuuucacacccucacacccaccagcuuuuuuuaauggcaugcuauuucuuuuuuuuucucuuuucucuuuuaaaugauuuuacuuauucuuauuuuacauucauuggugcuuugccugcaugcaugucuauaugguugcugggaauugaacucagauccucuggaagagcagccagugcuuuuaacugcugagucauuguuccaguccuggauccucuaaacuuuuaaaugugugguagaagacuaccaaaccuuaagaguaucagaucaauucauaaaguaacugaaauugaaagaaaaguuuaugaccagccauuugcuccugugggggaaagaaccacugacucaucucagaauuuaaccacuaaagucuugacugaauguagaggaaaggcccaccauuccugcacucuuagauaauaguggauauauuauauaauaguggauauaaguaacacagcacgugccagcucaguccucucugaugguugcuuuugucauuuguuccaguagugucuacuguuaggaaaggaccuugaaugcauacuuacugugucuucuucccguccucccuccccucuuuucucuuucuucccuucuucccuucccucccccuccuccuccccuucccccuccccuucuuucaguauuaacaucauguuuagcaguugagaauaauuauugacuaaaugcaguacuagacuacagaaaccaauuuuggaaacgcucuuuacugauuaugagaaccucgaguagaaacaacaacagagcccacaagcaagagggaagauuguacuuucaggaaaccgaguucucuacugaccuuaguagaauggaaagugaaauguggguuuauuucacauugcaggggacugggguaugcauaggauaccucaguuaaaguagcuauuuuagcagguauaaaggcccuccuucucgugugaugcuggagcagcuccagcgacuuuauuguuugccucauuguccccuacuguucagcuggcuguucugaauuuguuuucucuagggccucagagccuagauacauagcuagucugugagucuaaggaagcaaguuuaguuuauaacaacuugguuuugaugugacacauuggggucuuuuaaaguuauuaugugaguguaugcacacuuacaugugugugcacacugugguauauguguggagaucagaggacaacuuagggaaaucaguucugaggagugaacuccccucaguaacugagguggugaagacucugccuacugaggcaucuugccagccuucacacauuucauagggaacgguaaggagcucugccugccacagacauccugacagcacaguugugucuaugccacagggcauuucugcugccucucugcagagcugacaucuguacgcucuuacucuggaugcucaaaaacaguuuuuuagauauccagaagagaucaucucuaagcaguauaccuuucuucaaaccuuaaggccauuucuuauaacugaaaguaauugcuucccuuguuuuguguuuucuagguuugaagaaaaggcccaaauggauccccuuagugcucugaaguauuuacaaaaugaucuuuauauaacuguggaucauucggacccagaagagacaaaagagguaaagaaagauggauaaauguuuuucuuguguaagugcuuaaaggaaaugaagaacuaugaugcacugcccuuaaggaugcucaguuggauaaaauaaaagugaacagcuguagugcuaaacugcugcacuccagcauugggaagguuggugcaggaggaucgaucacuaauuaaaggcuagccgaaaugacaagguaucucauuacaccaucuaucugaggggaaagaaagaaauugaacaggcacauuugauucauucaaaauuaauuuuuagguauaaaauuucaaauuacgggcuggugagauggcucaguggguaagaguacccaacugcucuuccgaagguccagaguucaaaucccagcaaccacaugguggcucacaaccauccguaaugagaucugacgcccucuucuggugugucugaagacagcuacaguguacuuacaauaaugaauaaauaaaucuuuuuuaaaaaauuaaaauuacguuaguucuguauuuauggaggaauuuuuaaagucuaguuuuuauaaaucaccaaggguuauauauaaucgugaaauacacacuuuucuguugauguucaagaucuuucaagaucuuucaacuucccuuguuuguauggagaaucagguuuaacuuuuaaacuacuuuauauuccaaaaaucugaguuauuuuuuucccuguguguauguuuuauguuuuacacauuuucucauuuuuaacuucucauugaccaaagguauuuuauguguucauuagaugugcuguuaucauaagcaucacuguaugauaccuaggaccagggcaguaacuguugucugccauuguaaaucaaagcauggcuuuuguuuccuucagucuccagaauauuggauaugaauugcugaugaacuugcaaaaaacuuuauacaaauuguauugauuucaugcuuuuguaaaucucagaauccugcuuuuuguuuuuuuaaacuaauaaaauggaguaguucaaaaacaaucaccaaaaccaaaaccaaacaaacaaaaaacaugagaaagaaacagggucagcuaguaagagaggaccuauauacauuacauacaugcauggaaauaugaugaaaccuauuauguaauuaacaugcuaguaaaaauuauguauuuuuuuucuagaaaaggcuugagaaaaaaauugccaaaaucaagccuaccauuuucaaaaggacauuauaauaaaggaguggggaaaagcaaguuuccaacuacuauacaacauucuguacuaauuauacaauucuucuguuauguuuccaaaauaguacucucauucauuuaauagcuuguguugauuccuuacacaaugccaggcauucucgguguaggaaauauauuuguaaauagaacaagauccuaguccagaacauauuaaguaagcuaauuacaaacuucauuguaauuugguggugguauggaaggauaacguugaaagaagaguaagugagcaggguggagcccauaccucagauuucagcccuggagagacuuuguccagcugagguaguagggcuccugacugagaugggagccugauuugcauaugaccaguuugaaauacccaugggacaaccaucuugagguguuuagguggcaguuaaacauuugagaaaccuaagaaugaggucuguaauacaauuugguauuguuuaaaauuaucaauuuacuuugucaguuuguuaaaagaacagauuucucuggaacuucgccauaagaauccgugaaguuuacuuuucauuuuaaaggaguuagaaaagaaaaagaaaaacucaagauaaaauagaacauuagugaaauagaaaaacauacuauaaaaaauaaaguauaaauauaguggugguucuuugacaaacuaaaauggauaaccucuuauuaagagucaugaagaaaacauaaacugugaacauaacaugaaaaagugaagucacuagaaccucagaauuaugaaaaaaguagcaaagaguugcaaugaacaguguugucagcacacugaggaacugggcagaccgccucaaaacauguaauuuaccaaaacucacauuagaagaaaugagaucuuaaagaauucuacaauuguuacauaguuuuguuuguaaugaaaacuguucuggcacaauacuucagccucaaugucucuauaaguaauuuuauuaaccauuuaagaaacaaaauuauagccaggcgugguggcgcacgccuuuaaucccagcacucgggaggcagaggcaggcggauuucugaguuggaggccagcccagucuacaaagugaguuccaggacagccagggcuacacagagauacccugucucgaaagaccaaaaaaaaaaaaaaaaaaacaaaauuauaauucuacauaaauucucagaaauuagaugaagauaauuccuaaaucuuugggggaagugugagagcuaaacaaagauauuacaagcaaaaauacauagacuggaacugggaaggcugcuagcugcacuuagaagagugugugcugcucuucgggaggaccuggguucaguuugaagcacccacaugguggcucaugaccaucuguaauguaauccagggcauccagcaugcucaucucgccaccgugacaccagauagacauacaaccagaacauucauaugcauaaauaguaaaaaauaauuuuaaaaagaaagauaagucugaaauauuugucacauuuuggauucuaaaagacaauuggcccuuacaaauauuaguguguaaacauuauaugaaaauauaaaggcauccaagcagauggagcuaggaggaauaugaguucaaggcuaaucugggcaacgcagugagugaaagaaaacuguuuaaauagaaaauaagagaaaaacagcagguuuuuuaaucuaaauguggugagggcuuuuguuuguucuuaguuuuuguuuuccaauauuuggugguuagaucuguacaaugcaugcauaaaaacagaggcuaauaaugaaugaaaagucucagaaguuguuucucuuaagugugcuagcuggcuaauuugccguauuuuuuuuguuuguuugguuuuuuguuuuuguuuuuguuuuuaacaguuucaacuccuagccucagcucuguucaaaucuggcucagauuucacagcucuagguaagcaugccagcaguuuaucuuuucguacuaacauuugguuggauuuuggucucuuauauggaccaugaggugaaacauauccacacgagugcacacagcguuugccagcggcuaaaggguacccacccucaggcaccguucgccagcuccugcuugcaguuugcaguucaugugccacuugguacaggcaaauggcaacaggaguguggucaaaacaaaguaaucucugcagcacugcugaagucgacgcuugcucgggugggcucaugucuucuuguucuuugggaaguuuauuaugccaggaauugacaaauggaguggggagugaaauguuuugaaagucaaaaaacuaucuuuuuucuuuuuaaugaagauuguuauuuguugauaaauuaauuccuuaaguucucuuuaaacuuucccccucacacuugucaggcaguggucuccauuaagaaguacucuuacuuagugcuagugaguuacguggaaaacaguuuggcgcugggauugaaggguaugaaugaaugauuaacuaagguugucaaaucccaauaguauaagaaaugaucacaggaguuugaaaauuaacuacaugaagucaaguagccuuugcacagauaaugauuaucaucauaauaaacagcuuauagaaucuuugaaaaucucuaccagcuauacuucaggcagcuagaauauauaaaaagcugcaaaguuucaguacacacacacacagaaaccuaauaaguuaguuaauuaauuaauuaauuaugccaaccaauaacugggcuaaugaacugaacagacaguuuucaaaagaagugcaaauggccaguaaguguuuuaauuaaguuuucaauauaguuagcuacuagggaaguaagugcaaaugagauacuuuaggcuccauuucacugcagucuucacaauggcuguugucaaggaaacaugacaccaaaaucuggcaaaggauauagggaaagaggaucucuuuucaguauugguggggauguaaacuggugcagcaguuacugaaaccaauguagugguuucucaaaagcuaaaaauacaaguaugauaugauccagcuacaucauuccuggauguggauccaaaggacucuaucccaccccagaaauacuuacacaucuuuauucauugcuguucuguucacaaagaaaugcaaccaccuuagucugucaacagaugaauagauaaugaaaguguguugcaugcacacaugcacucuuaaucauccaugaagaaaaaugaaauuugcaguaaaauagguagaaccagaaaaugguguacuaagugagguacugagacuuggagagacaagcacuacauuugucauacacagauccuaacuuguaaauuucauguguagauugauagaggagaugccagaaaacuagaaaggagcagugagaggagaaaaaggaggccucaagaagggagggggaguaagagaacacaugggauauaagaauugaauggagagucugggggcucaagggcacagucagagaacagggcaagaagaugccccgaggacugaucaggcagcagauaaaauaagcuaggaauguaugagaacacccagaggaaaccuguuauuuuguaugcuaauuuaaaaauuaaacacacaaagcacacacaaacacacaaagcagcuaaacuaggcucucauacaauuaagucucgugauucuguagaaguuucagaaaucggagcuuuacgcuggugaguuuucaaggguauuuuuuauuagaacaacucaggauaggcagcuccagucuuuaccacauuucacuuuuuuaguuccacacuguccuagaacuaaagauucuuucuuugaaacauaagaaauuguagcucugaaguugccauugugauguauaguuauauaugaguacauacuaacccuguugaugccagugcuguuaguauuugcccaagaguuguacaguaguguacauaauauacauauugcucucuuauuuggaaucaaaugacuccuggauggcauuaguuuaguuuuuaaauugcugguccuuugguuuuuggcuaaaaauaagugauuuucagaauaaaacagagcaucacuaugggauucuggugcuguucccugggaugggaaagaguagcaguguucuugggauuuugcccaccguuuucuguagcaaguaauugagacaucucuaacaauuacgguaaugcuggcuucacuucuaacuccagaagagcgugagaccauuaugguaagauaggaaauugaaagaagaaaauggaaaacuggcagucccuaacuccagaguauguaggacuccacaggcuaaauuagcaagcaccauaaaacaucauugcaguggaugugucuuuaggcuacaaaacauugcagccccaucaugaugaaaaacuaggagaaaccaggcauaaacguugcuagaaaguucaugccucucguaauuuuauccuuugaagcagacuuagugguacccggguaauugugagucugccauugguuugaaagaguuuaugcccugauauguacagauugcacagcccgggucauuacucuuauuuauugaugggcagcacuaaacugucuuuggcuaguguuuagccauuaaggcaagaauuucuugacagugauuaaauagguuaggauugugucagcaaauauuuuuaccauguagcuuaguuccuuucuccuguuuuucugcccuguucccugccagagaacauauucugucaagaacaguuuguuuuccuugaaguauaaauagcuuguuccuaguagagccucuccucucucaagcagucacugucuucucauggcugguacagggugguacaaauaagagcgauggugcugaggagcaagagccuggcgccaguacugccuuccucuguguucaugcuggcucaggcuuuguaucagggagugucuggguucuugccuguaaaugucacuuucauuuccucagaugaagugagaugagaacugucaaaccaagcugugcaaguacauggcuugggcugaacccagaguguuuccuucuuuguucucucucuaagcguaggccucuagccuucguacaaucuaaucuuccaaacugacuuaauucagucugcuucucucggcuucugacugaacugcucugccuggccucacgcuaauaacucuguucuaaucuucuggcuccuucucacuccccugcucacucugccuucaccugcgccuagcuuguucucugucaccugauucucaaaaacuauuccaguaaaauggccacacacacacauacacacacacacacacacaccacccuggacaccacacacugcacuacggcguauccuaucucugauucauucugucaaaucuuuuucugauucgucacuuugccccucaacuagauaucacuuucaaacauggcugcuuccuuauacaaacuaaccuuacuuucauuguugaagauuagagguguguacuaagggcaugucuguauuucagccagauuauacuguaauccaagggcaugucuggggcauguuugcauucugcccggaucauaucuuuggaugugaucccuuggcagagcagccauguugcuggauuaaaauuccucuauaccugcaccuuuuacauauauugaaaaggaaaauacugacuauagauuaaguguaaguccugcucuaugucuuuacucaacacuacuuugugaagagacauguugauauauuugauucugauuauucaaaguaauuauguuuuauaacccacagggacaauaaauuagugaaggcaaguugcugcucuugugaaaaauuccgagaauuaggcuucugcaagucucugcaacagacuauugcauacauuuaucucucaguauuucuauuuaaugccuccuugucuaguguaccuuauguauucacuaccauugaacucguggucaggaagaccaacgccugacuaagaugaagcuugucuaacuugcucucuaggaaaggcauagcccaccuuccuacgcuuagaaaccuacacagcaccgacugcagcucgagcacaugaaguggugaggucaccaucagacaucacagaaucugaaaaaugugccuauccugcugcucuaggcaugucuauaaacagucacacaagugcacaagcguggcugugcacuuacaaauaaaugucagugauaagcugacuguaaauaauaaugaagauuuucuguccaucuacauauuuaagcauaugguuuugaaugugccgguucuguuauguaguauaaaccguaagaacauacgcuacagcaugagccuguucuuguccuuauaaaggcauggauacugaggggccuucauaguugaacaguucaucugaugguaguguuguuaaguuucgauuuuuuuauugguaaauagugaugaaaguaaagauacuuuugaggacuaaacgagcauaacacauugcccuacacacucaguaaaugcaauaugaguaaguagacagauuuuagaguccccucacccacgaucugagagaccuuacuaaacaccuccauuucuuaaaugauucuaagaauguaguuuauauguaaaagccuagcaguaguacacaggcaguuagugugacugauuuuggauuucucaaauaauuugcuacuacaaagaaucauagcuccuuggaaaaugacugacuccagagcacuguuaagacuaagauugaggguuggagaggcggcucagcaguuaagagcacugacugcucuuccagaggaaccagguucaaaucccagcacccauauagcagcuuacaacugucuguaacuccaagaucugacauucuuacacaggcauacaugcuggcaaaacaccaauaaacauaaaaugaaaaaaaguaguuaaauaaaaauucuuuuuaaaaagaguaaguuugaaaucuuacuguauagaaaagugaagaaaugaucaaaaauuggugggucuauuucuuacuggucaaguaggagaugaugugaauaucaaaaugagcaagagaagagcugagggguacacacugaccaaacaaguaaguuaaacagagugccaguuaggaagaaucacagaaugucccaguggcuuaaaaaagugcuuuuucaguaagagccaucacugagcacuaacgcauagguccuggagucugaggaacacagcauucacacagugcugaguaaucuccccguuaguaguuuuaacuucagagguugaacuaaaaguugaucagagaaauuugccauuggcugaguuaacuguaugaucacgguuaauauuguugauacugguccagacugaaaacuaugugcuuucugagauaaugcccggagaagggugcagagucacucugguauuccaccaagacuccauagccagcaucugaucauacaacagucgagacaaaauuaacccaaauuuaacacacacuauaugacuuuucuaugugcuucagaaauauccaugccauuagaaaacagagaagcugcaaaucugauucagaucaggagacuucaaagccaaauguagaauguguccuuggauuagaacuuugguuagagacaaaugaauaauaaaaagauuauuaaaaggucaauguuaaguuuucugaguuuaauauauaguuagggugaaagacuuagcacacggcacuguccuuuauucauuccccaaccccaccaaagaauauguguaggacugggacgggguggaagaggaaggggaugguuggucauaugaauggagauucuaugcuuagcugaaaugaguucaagaauucaggagugaaacuauagaauccacaggugcuuccacaaaaagguuaggaguuaggcaugaauacauccacaguaggcacagugucaggccagacacuaacaacagacuuaucaaagugaagggucugaaugagugcacauuagacuuuuaaaaccucugugugcuugaaauguuuugaaaguaaagcaauuuggaaaauucagaaaaaagcauaauaaagaaacaggauuauaaucuuuccgucacaauaagcuucauuaguaucuugcaguauuuacuucuguucauuucugugauaugacaguaggcuuugguaagcuacacucaaaggaagaaacgcuucccccucaaacuuaaaacaacaauaauaauuaaaaaaaaaaaaaaggaaugaaccauucuuggggcauuguuuauuuccuuccgggaaacugguauccuugauagucuuauguucuauuuuuauucuuuauaagauuaaaacaaauuggaucuaaaaauguugaguggaauuaauccaauuugcauuuucacugaaccaucacagccauggugguucuuuucuugauggcacaacgggcuaacaugucccagcuagccauucaguauaaugggaaaaucauuuaucgcuuacguauuuaauuugaaggcuggagagauggcucagcagguaagaacucuggcugcucuuccagaagacccagguucagucucuagcucccacauggcagcucacaacuguuuguaacuccaguuccagggaaucuuacaucuucacacacacaaacaugcaggcaaaacaccaaugcacauuaaaaaauuaaguauuuaauuuguguguuagaaaucugaaacagcuuaggucaaacugaccaaaaugggauauugguugcugugaacucaaaaguaaauguuugcuguguguaaagaaagggaagaguccuauguauuaacaaacacugucuuggaaaaaugccucuguacucugguauuuguuugcauaaaguacuuaauuauucucauuaaauaugcuuaguauggaaccuguuacauaguaacauaauaauggcauuugcuaagguacccuguguacacauuucuuucucuugguugucuauacuuuuacucaguucucugauaauacgucugccucuaaagaucuuucugauuuuagccuguuuuucuaaagaucucuuaauugugauuuuguuuuauuuuuauuacccuaccaaaaacauuaauggaucagaagcacuaaagagauagaggaaugaaguuucuucaaugaaguaguagaggaauagucuagcaaaggagagauuagaaaucgguuuuaauuaaguaacggucuuucugcuagguauuuucauguaauugcauuuacucugcaugauagucugugaaguaaacuggcuucacaaaugugcaccagugaggaaauggaugcugagcaccaaggaggcuaauagugccuaguccacacuggcuaggucagugauucucaaccuguggggccugacccuuuguggggccaagugacccuuucacaggggucaccuaagaccaucagaaaacacagauauuuacauuauuauuccuaacuguagcaaaauuacaguuaggaaguagcgaugaaaauaauguuaugguugggggucacuacaccaugaggaacugcaucaaagggucacagcauuaggaaggaugagagccacugcucuaacuaaguguuguaguuuuaaagcuuauuuugauuuucccauuguacaugacuaauaucuaagucaguacacacuaacuuuuuuguucuguauugaauuuuugaaauaauacauaaauuuguuuuauuuucuucaacaggcuuuucagauguggaucauaccuaugcucaaagaacucagcucuuugacaccuuaguaaauuucuuuccugacagcaugacuccuccuaaaggcaaccugguagaccugaucacacuguagacuggggagugggauugaagaauuacugggcucagacauggagaaggaaccagcuguucugugggcagaggugacgcugcagguacugaggacggcaccagaguuuugaaggauccuuauuaucacaaguuuuaacccucuuccuucauaccugaccucaauccccuuuuccucuuauuucugcauuaggcuaauaaagugaaauugauauacuucccauuuaauuauguauauuuuucuuuagccuuuaagaauuaguaaguauuaaugaaaauuagccuuuuuucuggcuuccaaguuuucaaaguuuauuuuuaguuaggagaacagcacuacugguagacuuggugcuguaggaauuugggguuuugcugcuggguguuuagccuuuguuucccuuuucuucucuucccccuucacuuuccccacaucaccgcuguuguggugccgacucugacucccucccucauccuuaacuggcucuguguggcucugugggacacacacaggugguguauguuuaggugauguguggcuguugacuuuucguguauuaaacauagagcaguuagagggcuugaauuuauacuuuuugccauacuaccaaaagcaaaacucaagauuggcccagacaccugaucaagaauugauauuucuguauugaaauucuguaguggacauuacaguagccauuggcauagaaucacagaaaccugaaacccagccuccuacccagaaauaagaguguuccaggugaccagcaggagaggugcuguccuucccccuauuuuuacugauaucucuguugggauuuuaaaggaaaugacugcugguagagcuaugcagaaccuacgcucucacucuccucugagugaacuuuuugucauaguuuuaucuggacaauagguuccagagcugugcuuucauauuuuucugauaugugacccuacuauuuugaagaguaauaguuugugguugucuuuuggcauacaauuuacaggcauuuuaguaauaagcaugugggccagacuuuuuuuuaaauggauaaaaagaaaaauauguaacaccaagaguuuuucauuaaacagaaaaguauaagaguuugcccuuuucauuguucugguuuuguacauacaggaauaggagcauaccuucacaucagaugcuggggaauguagcauaugaaacccacaucuggcuaguuagcauucacguuuguucaagugugccauaggcagcugguaccacuguguugaaaacaggaucugcccuauccgugugccagcuguuaggagugugugacuaugaaauugaccuggacuuccaaaagugucauguguaggaaggagaccuugauccauccuucccucuguccuuacugacuuuucuggguuugcuuuugaggaugaaugggaauauauuuuugcaguuguagacuuuuuagcuucauaagcaucccaagguaaucaguagugacuuaauaaacauguaugccaauaccuacccugucagaaguaugcaguauaaauuaggagguaccaaauuguauaagagacagaauaaucacuuaccuguacauuugaguaaauccauucuauucaaagacuucgcagcuuccuaacgugauucuccuaaguaacagccaagaacaagaacaaaaacuguguagcuaacagcguagccugcugagucucauuucaagaagacagcugcaaaucaguaggugaccaaaaaaauuuuuguuuuugaacuggaaauugccaaaauauagagagcugugucugaguccugagagcucuggcaccuuggcaauacagccaaaugggauucugcugccugcagccugccuguacaugcuucccccagccgccaagguuuuuucuuucaauuccucugacucuauuauuugggugaaauucaguucuuaaccuuagugauucuuuccccccccccacccccgccccuucuuuucucuguuuuuauagugccugcuuuaauuccauccccccucacuguaguuuagaauuuuucauuuuuuacugccaaguuuaaaugauugaauccuaggaaaccacucagagcugccuaaguacuaagaugcuuuagguacuaaggagguggaugacauaacugacucaggcaggucagagccugugccuugggcauuaguggggcacuccagggguaccuuuaggaaguguagggauuacacauccagaaccaagauuggcaugcugcucgccacauccccaugacagcucugauugagaacuuguauagauguuuauaaggaguaacagcagaauauuauaauuuaaacaauaaaagguaguauuuaaugaaccaaauaugugugcuuuccuaaaaauuccuuucauauucuagcuuagccccaaauuaauauacuuagcuguagauacauucguuaguggagaacuguuccuugacagaauccccagcuucugccucaccuccaucucccuuuuuuagcagaauauauggcuuuccaucagaaauaagcuauugauaacugaugcuacuuucacccuuguguucuguaagaauuuagauugcaagucacuucacaaaugcauuuacauuuuacuuaugaaauaacaugagaccuuacuuggccaguuuguuugauucagaguuaugucauguuuuuacacacaaaguaauuuagaauuggauuuccacuccuguguuaaaggugacaaacaacauuaaccuuuaucaaagucaccuuuuuugauaugguuuccaucucuacuaaaacugaccuuucuguguucaaggaguaaaaacugacagaaaacauuggaaaguugggucaguguuuguuguaguaaagugugucagauuuagcauccagugcuuuguuuguuuauaaacaaaugaauguugagugaaauauguauucuguguauaaauguuggcagcuugccauucuacuggcuccccacaucugccuuaagaaguguuauauagaaauacacaguaacaguuucauguaacaaaacaggcuuaaagucggucuguagauagaagcuggcuggagacccuaaccaucuagugagagucugagaugguugcuuaauaagucaacaagcacuuaaaaagugguccugauugcuauucuccgcguuauauuaagucuuaugguaauuauauaaagacauuaccucacuauuguuuuguuguauuggaaaauugugaaucauuuauuuccugugaaacaagugugaaacccuucacugacugucaugugacagcugggaauucugcuaugaagugacuucguggguggaagucaugauagugugcacuuuagacaaagucacaaagcucuuuaaagaugcccuuccuaaaacuugcuuucuuaaaauuccuguuaaucuacagucucaccaucugcagaaauucuuaccaauuuucaccaaguuuuagcuagucugugguuuaggauuuacaggcucuacaagaaaaaaaaauucuauaguugcuggagaugugucaaagaggucuguauaugacaguauuuacagauuaagauguugggcucuuuaaugcaguuuuuguuuucuguauuaagcaaauucuaauuuuuauaugugguuuuugacuguggggguugucucuauaguuugucuuacuguugaaaugacaugguuauccaaagccucuaguguccgucagguguguauucucuauauagauguaucagcuggaggucagagcucccacuuguuuugaaguucuguggagcugacuaguaccgcgcagugacaggaaucguuuacuuguuuucagggcggggguuauugcaguggauucuuuucuucaucaaaugcgcuucuuguuuucuuauuaaaugcuaucucagauuuuauuuuuagaugauuuuuuaaccuuaaauucauucuauucaccuauuacugugaauuguguuucuauuuauuuuccuuggcuaauuuaacuuuauucguuacuuccuagauuuuucuauggcacuguuuagaacuauuguauugcuuaaaaaaaaaaaagucaaaucauuguaaaucauauaugcuucuguuuaugauaagagaauaaugagauuaaaaaguguauauuaguaaagaaguaauaacauuuagauauugcuauacaaugugugugccauuuucuuuuggggauagugaucauuacuauggcagcuuuaauggagacgucugauuuagcuucuuuuccugguucuagaaacuguugucauagaacuguuagcuguauccagguucugaagagagccagcucauggagaccagugcuccaccacacuuaaauuugccgucacccuaucuuuguauuguguuuuagccaagcaccaauuuucagccgggugugguggugcaugccuuuaaucccagcacucagaaggcagaggcaggcggauuucugaguucgaggccaucuggucuacagagugaguuccaggacagccagggcuacacagagaaacccugucucaaaaaacca

SEQ ID NO: 2891 - RNA, 3987 nt, Mus musculus
aagcuagugauaaaauuguuagacaguaucaugucuaccuuuuaaccuuaguacagccaguuagacuuucuaguacucagggagaaugccuucuggaaaaaauuccugcuacugacugucuuuuucaaaagucacagaucuugaaguggaauccaguucacaacacagaaagcacaggauaauucuaauuucucuucugcauucaagagcuuuguaaaucgggcuggagagauggcucagcgguuaagagcacugacugcucuucaaaagguccugaguucaaaucccagcaaccauaugguggcucccaaccaucuauaauaagaucugaugcccucuucuggggugucugaagacaucuacaguguacuuagauuuaauaauaaaucuuaaagaaaaaaaaaggaaucuuuguaaaucauaucugcaaaugugcaguucccaaacacugccagguuuggaaccagaacuccguguggauuucaucugacagcuauggaaucaacaacaggaaaggccguagugauggguguuuaguaaggacgggaaccaguucagaggcuugugaaaucgcgugucuuucuuuccucugcuacucagagagacucaguaguugcuaugcgugcgugugcacugacccaagaauucugacuacaacgaagaaugagcgugagcuagugcauguucccaaagcuaagcacggcaaaaagcucuccauuguuaaccuagaauaagucuacagguucaauacuaggaaaaaaguuaucaaaggagaucaaagcuugugcuuuucugaacggccuugggaaaguagcauuuuuuuuuuagguaguuaccauucuucuugaaaauacaggccuuaauacaaagcccaguuuuaucuuuaaauuuuaaaacuugguaaguaguuucguauguauggccaguucccugauaagcccacagggaaaagcuauaaaugaaagaucucaccguacagcuuggaggcucccagagagcuugcuuacucaucgucucugagcucuuacugcagcauagcccugaacugucgugcgugugagccucaagcccagcagagaguuuugauacuugaacuggcugccacacagggagucagccccauuacaucaucagucuucauuuucauuuacugcuuaguggaugccaaguuaguuggccaaaaggaaauacaguguguucccuacgaagcaugccaguguaaggguugcuucagagagccuauuggaaacuucauuucucucccuuguuagcaagucucaagaaaguccaacuaggacuagucaugcuacuagguggguguucauuuacuaaacccuagacuaagaugaaagugguuaucguguacuucaaaacuguacaguuuuuugccuaaaaauguacuccuauacgguccuuugggcuccuucucauuaguguugcaggcauagaguaauguuaugcuuuuagguguucuacccauuccuauagugaugaaugagauuggagaaagaaccuggaguuuuugccaguucccuuuacagcugcaaagcuuuucagauucaguugcagccaaagacuagaaaccauccagaccaugagggccugcaucugcaagugaccuuuaaguuauauuugcugugcaauugcugcauuggagcaguggccgcugaaaacagaugugugcagcuucuuguauccuuucuaaugcguccauuucugaagucacagagcacgugcaccuuugcagagucuuggcuuauuuuugcaucuacaugucagucaugcuugugagaacacauggaaaaguaaguuucagcccagcccacuuacugguaaaugucaaacuccaaaguaggugaugugugaguuucuaugggggaagaauuuuuguuuguuuguuuuuaaauugggaugaggagacacacaugcagcaagcacacagugaggaagacucgggaaagcagaggacacucaggaggcugaagccccaaacaugucuuuuuguuguuguuguuuggugagagaaaaagaccauguguuugaugcgcuucagaggucacucaugaacagugcugcucuuuccuaaccagccccuuacccuggacagacugcugcuacacucugauuaagguggucugccuuuugauaugugugcaaugucuuuuuaaaccaaugagauuguauaguauuaguuacccuucaugucuagccuucugcuuauuuagagguugcaaaaugauggguuuucuuugagcagcuuuuguucaggggucuguauaugcacuuucucuuuuagaagcaaaaacauuccucuugaccaccacucugaagucacgcacagcagggcccucagccucacaggaggaguacagggaggcugaggaggacuuuuuucuuaucuuuaguuuugagaccaugcaguguuccaucucugaaaaagacauacuuguaauccacacaagaacaaauguuagauuuuuuuuuuaauguccgcuuuugugaguucgaaguacuuaguaaccagaaaugaagaugucuucugauaaagagcuucgauccaaagcuugggugggaauuaacuucagaaaguuaacagcuugacuacagaguacagccucaucuuccaggccuaccucagucuguacucaucuggccuggacacacccuuggaucaguuuauuuacaugcuaggguguuaaguaguccuugugaauuuuaauagcacuuugucauuauaaaacuaugccuauuacagaaaacuuggaaauaacuaaguagaaggaagaaaggcucuuuuuuuaaaaaaaacugacaaacucccuucccaccccccuuuuugagacagggucucacuuuguagcucugacugucuugaauuguguagccccagccggccuggaacucagagaguuccugccucuaccucccacgcacuggcauuaaagguuugugccaccaggccuggcuagcccccucaccccuccuuuucuaaaagacauuguuuuucuuauuuuuccuuaucaaaauggccaaagccaacaaaggcuuuugagcaaauauuaauagccuuucugucuuuggcuacuggucugcagggaggaccagguugcaggcuccucccugcuaacguucguugcucaagcauuuucuugccauaaauaauuugaaaguagucccuuuaucucuaaugaugaacuuuggagaaggagaacucacugcagcuauggaguguuacuuguugagguuguuggacaugcuaucccuaagacugaauuuggguggccuuuaggcagcaucacaggcauaauggaacgcagucacacggugcacagacuucauugggugacgaacuuuuuauguggccauaauuaaccccacacucagaaggccgaaagcaaagcaaaagaaguacgauauaaaagaauacaaggaguccguuucccuggaauaucaccuuaaaugcuuaaaaaaacaauguauagacaccagcaaggaacuaguuuuacaaguuugacaccucaguuugccaaguagagucuuccucuugauguguaguggaaaaaaucaccuuguugaguucugccuuccaccccccuucuguggccaugcauaccccaccccaccccagacuggagcaucagaaacaguaucauggaaggccagcaugugugacugaagcauuuaaacagcgcccuugggucugagcucaucucuuccagcucugucgagcucugcgaucuuccccauccccaggcuagcgucauccucugguuuagcuguugucuaauccuuguggacuuucuaggauuucuuucugguaaaaguaauuuucugaccccagguuugguauguguuaucacuaacucugugaauaaguaaaugagugaucacugcuaaacaacugcaguuauagaauuauguuguauguauguacauaaggagaguguauuuuguuccuuuucuuaauaaaaaguuacauauggacac

SEQ ID NO: 2892 - RNA, 44496 nt, Mus musculus
accagcuuacacaaaagcauuuuuauugacaguguacaauuuuccaaaauagacuuuauaagaaaaugcaauaguuaacuauaaucucucaauaaauuccaguguacuuuagaccccuguccacuacaacauacacucccccaaucuccugggcaagcugguugacauucacaaacagaaaggcccccacaaaacagugauccuggccagugguggguuugcggcagaccgagggaagcaucagacaccugacggugacacaggcuguucuacacagggcuucucccccucugccuucaucuaugcagucccuuugagccucauucugcuggacauuccucaaggaguuuucaaaauuaauuccugacaggaaaacaaaaacaaaaacccaagccccuagaaugcuuauuuacaccucggaccacaugauuccagagccccaaauauggcugcuauugucccuuguguucucccagccccuccagggucaucgugaggaaggcuggcggucuccuauaaccuuguaccuagaaguugcaguccuuaauucccuguucuugagaaacacgcagcacagggugggcagugugggaugcguguuuuccucuugucccugucccuggggagacucuuugugucuucagaugugauuuccuguagggagacuagacuguaucuccaaaccuuuccccgugaccaucacagaccauucucaacuccagccugaacugcaguaggacugcgacuuggcaggggagguguaaauccacuaucuccaaggcaaauacguuuguuaccagccugucuuguuacuuucuucauuuuuaaaaaagucaucucuacuaaauagacauuuacauucuuguucagaaguggggagggaggcuuagcuaucucucauagcuaucaaaucuuuaccccaaguuuacucucugaaaguaguacaagguaaauaaacauguggcucuuguauuuacauugucaaaaauaugcauagaucuugucaacuucaacuuacucuccaaaguuucaccaguguauuguccaaaaaauaggcaaagaccaauagaacucaaacacugauagagugggcuggcucacucuaucagggaagauagaagugaguguccuagaugagucuggguccuuuucugccgggcagacugcucagugccccaugcucaccugccucucuugacaugcacgugggagcacaagagcugcugggugugcucaggcacagccaucgggcccuugggguuugcagcuaggggagaaccauuugccacugaaaugaagagcucugguuucucuuugguacagcuggcucuaaaguucccuuccucucccuuuucucugacugggccugagauucugaguuaacagcucuaaaaacccggucauaaccacaggaagaugacuuuuauagaugcuagcagcaugucuugcugaacagaugucccagccguaagagcaagugaaggccagguaauaaaaggcuacacaauuugagugcacaagaaggaacacugggccagucuggucagagccauggcuguuccuccagcccagacacacuaucuguugucuaauauuacaaucauagcugacagacuguaggguugaaaucugugaccaguuugcagaaaaagcauuugcggucugucaaauggccuugccccauugagaagaagaaauccugucugccucucggaccaugacagaaugaacccacuggguggcagaaccuaaugcagggaucaaacagaccuaauuccccccccccccccaguuggcacuguuccccacacuccccugcaaaccuuagagaagcaugccaaggggcuuguugaguucuucuuagccuuuuuuucaagcuccugugaaacucacuaggagccuucccugacuucugucagccuuuucuuucucucuagucuguaucucagagagacagugguaaagauggacucaggcagaggacaccugucugccccccuagcuccccuuucaaauaagcugcuccaaaccagacaguccugggaacuuauaccacaagaauacaaaccaugggccuaauucaaagcuccacacagggccccuuccccuuucucaggaaacccaucaucacuaugcugggcccucgcaaccuuggacauggcugccugacaccgcugagccuggacaaauccugugcuagguacuaggcaugguuuuauguucccugagaggccaucagaaaugggacagcuggaaugccacaaagcacaccagacacaaaagccuggcuccgugcugggagaguaggccaagguaucuuaaaacugcacaaucugggccuuucuccauguggcaaaggagggugcaaaccgauggaauuagcucacagucuccacgaucugagcuuuggccuuuggcaguaaggagcuggcgcacacacacacaacacaccacagcacaccaacccaagcucucagcaacuugaaaagucccugagcuuccuguggaauaauaauaaugccugguagguuagaucgauugucuacugagacacauuugccaaucagggaccaguugggaccccaggacauaucuguuccuagacaacugcuaugugacacuagguuuugaggagucacccacucagcugagcagugaacaacaaaaaaggagcagaagcagacggccagaggagauuuuugagaagugucuucuagggagugucuuaaaugauaggccagucucaguacagaaucagcugccaugaggaagcuauuggggaagccaucagagcaugagaugccuuugccugcccacccaccccuuaggcagacuccauuagauagugaggccugugaguuuagucccaaucccacuaagaaaggcaaggaaaucagaauguagaacaagaaguucaaagccaugcccugggaaauaaugggacuaaagacuaacucaugagaggugggauacaacaagcuagccgaggccauguuauaggagauggaaauuggggaccuguccuugagaccauagaggcuugguuuucuuuuccagccugcccaccugcaagugucuugugccuuggggaaugggcacagaugaacacaguagugugucuggaugcaauuaagcaccagacugagggaaacaaccuuugucaccaaagggcuguguggccccgugcaagucaccugaccucuuaaggccucaguuaugagaugagagggugccguuccuggaggagcuccagagacucgcauggcguucuccaucuuccuccugccuuccugcucugggcucaggcacaaguagguuauuuuacaugagggaacuagacagaaugugacuuuguugaacuugaaaaggaaaauuaaggcccuguagggauugugaggagggagacaaccuucggaguccauucucccuccccagucuuucugucuucaggugggaagauuucccccucccuguccaaauggcacuuuggguggucuggagcucugcagugcaguugggguggccagcagacagaucagaggugugugucuuccuccucaucuaggucauccuuggucaaguuguccagagggacgauccaacugucccccagcuccccauuaagguugaccaccuucuucuccugcaucucagaaggagucuccaucacuuccaagguuggguugucaugguaaccauucuccacugucugcagcuccucugugagccguugcuaaaauggggacaauaacacaggaagacggcaauuuuggagugcugugagcuuuaauaugaaacauuuccccauucaacccagggaccucaaguuggccagauuaaauucccgugguucacuugugggggcagagaccacccuggcuacuagccugaccaucucaugaguacucccccauauccuaaaauuaccagcugcuuucuaccuucauuccguggcagucugugacaucauggagagagauuucugaagacauuuuguccuugagaucuuuuuucucuucuccaucccucuccauaaaaaccucuguuuuucuacaucauuccauaauaaauaacagagaagaacaacauaaauaaauaaguaaacaaacaaggcuccuucagagcagccugacaggacuuuucaguggucaaggugaauaggguggcccuuacagaugugcagacaguagucugugcucugagauccagcuguggauacacacugccaucacucaugccucggucaaugcacgaggucaauaggagugggaacugucuuaaugcucucauuaguuuacagcuaggguggagacccacagcagaacagcacuguaaaguugagacaggguccugcuguguagcccaggcugaccuccaacuugcaaucccccggcaucagcuucccaagugcugccauuacaaauguacgccaccacuacaccagagaagaugugguucuaguugguugggugaaagaagcuuuuuuagagcagcacuugcccaaggccauauaugauauauaauauauuuagggaucauauccccuaagucuccagaacaggucugcaagggaccauccccacuaugcagacgacaaggcuguagacuuaugauugacuuacagacauugacuuacagacacggcuuaacccuaguguuucugcucuugcuuccacauuugagucuccagcguuagagacaagcuagcuugacagcggggacaagaaccuguucgaaggcuccaggcccacuccuguggagggaccgagugagagacacauuggguaacugggcuaccuagaguaagaaaacacucaccugguccuuccucugggagauccgcuggugacagcagccguagagggcagcaacaaggagcaggaaggaugccaugcagacgauggugaugaugagcggcaggcugaagcgguccucauugaccucuggaggcccuuccuuccccagcuucaugucacugacuccggccuggccaagacacagaacuuaagugacagaaaacgggaguccagaccguuugucuccacuccagucugugugggucugcugcugcuauccuaccacccgcccuguucauaugucugccuccugcaugcuuauacuaucaaaggaacuccucaccagaaggcacugggcuuaggacaauacagggcaaagcuccuuaccucugucaggucaucccaucuguccuucaguagcucauacacggccuuaggagaaagcuucgcugugggagagacaagagacagaugcugccuccaggguccagcccagagugaaaugucagggguagaggggguacccaaggggaggaugucccucgggucugcugggaugguggcuggcuuguauagucuuaggugccuccaccccuaaccauccuucuguggcacucccucccacacaggguccgguccccucacccucgacucacucucgauaaugauucucuucacugccaccgccugguuaucuagaauaggggccacauguagagugcacaaauccucagcuggcuugaaggacgcuuugacugagugacacagcaguuccacgaguuucucuuucucauccagagggcuccuuuccuaguguaccgagagcacaagugauucccaggcuuugccacaacagcucgggcuugugaggcugcccccugcccgcucagccugcaacagucucuucuccacccuucacuggugcugcucccacgucgccaggaauuaaguuaaggacucccaggcugguccuuagccucucagucucguucugaacucuuuucccauccccucagccugggcaucuugucugcaugucaccccccacccccgaggcuuccccuguccucccugcaagguuccuaaggcucuggacccaguggcuguauuaucaugccucagcugggagugggauuaaacaggguacagcacuccuccauugccaggggagagaggcaaucccgggauugaaaucugccguucuccagccucuuguugccaccucaggcugauagggaaagugaggcaugcagaauaggcagaaggggguucuggggguguccacaggguuacuuacacaaaccuaagcccaaagaagacggaaacagggcuuuagggaugaugcugaaguguauaagcuacgggcugcagaaaugucugcaaaacuggcagugaccaguagagggcagccaccuccugcaccaaggaggucaagagcuaugcagugcagccccaccaagcccugggucccagaacacugguggugugaagggagcuguacacauuucuauaccuucuuauauggaacuaugcaggagaccagggacuaugacuccacuaucaggacagagagugauugcucagaucagaacucuuuucugaggcccuagagaaugaacuggggaccucgagcgcuaaucaaagcuuucucuagcacuccuguuacuuuuaaagagaaagucucauuaaguugccagggcuagccucuguuacacgcuguggccaagacgcgacuuugacuucaguccuucugccuuaauauccuaacuagcuggaacuagaggccugagccacaggcccgugugcacugccugacuuagauaaaucugaagcguagguggggaacaucuacucccuuugaggaguugaugggcagggugggauguagggugagcuggggcucgggcacguguacucacgcaaaggcuggcucuugugagguucagaauaaggaguuccucaucuggccuuaugggagguucacaguuuagcuggaagaggucaaaagaugaagguuuaggcaggaagucaccugaucuuggauucuccccuuggugggggugggugacacaggggaagggcacauggcaaacucaggcauggcuagucaguuucucagacaggaguaccuggcugcccaggggucagaauagaggaaacggcaaacagacaacuuuuccuuagaguguccagccagggacccugagaaggccaaaggaaaggacuucccuugaguuucucaucccacccucugcuagaauuaccugguaauuuccaaaggcccagaugggagagggugugcuggggccuggaggggccacgggagucccauuagagaugaggugugugaacucuucagucguaguucccacuguagacgccauagacuguugcaguguggagacgggcaauguagugaugccuggugucuggcuggugaggggcugaguggcuucagaggugcccaaugguucuguaacagacaaggcaaaggcugaggagaacacagucuuuacuggcuucaugauucucacaagcugaaaccaguagcuaugaagaggaaagaggcagaaaugaagaagugggguccugggcuccagggacagaaugaguuagacuuggaugaaguaagaacuaaguaggagucacaggaacuaugcuacaauuaccucucugaggcacaggugggccauagcuaacacacugcgcaggcucuguaggagggguugugcuuuguguuucaaagacuugcuccuuuaggacggucccugcuuaucaacagggaaacugaagcucggugacuuguccaaggucacagggcacaaccgcaaaagaggaggauuucaacagaccauucugagccugugcaccugcuauaggguguggcccugucccccagggcauaggcuaaugcucagaaacucucacucaggauuuuaagguuccugagccggccauagauucugacacuaauuuaaagacuggcacuuuaaaaacuaaauaagcagaagcagacauaagacaggaugugacagugcacagcuuuaaucccagcauccggggggcugaggcaggcggagcucuguaaguuuggagccaggcuggucuacagaguggguuccuuccaggccagccagucucagaaaaggaaggaagggaaggacagaggaagggagagagggacagaaggaagaagggagggagagagagaaggaggaaggaaaggaaggggccagaaaacagcaguaugcauaccaugccacaagucccgaaagaaagaacgaaagcucgaaggagucagccacccacccuccugucccauuacaugggucccugggguccaacucaggucaucagguuuagcagcaagugccacaugcugacauuuauuuauuuauuuauuuauuuauuuuuacuuaauuaaaaguguauuucuuacaguggauugcuaccaagcaaguuugagacgcaguuuuagaauucucuaacacccugcggccacaaccuguggcacaagccugggcauagauucuggcuucguugaaucuauacacugcuagccucuaucacugcuaaaagggguauccaaggcuaggucugaugaaggcagaagacacguagaaggguuaaaacucagcauacaccgauaucuuccaacugacugguaguaugagaaaaugcacugccaagucucccccccccccccccccccccacacacacacacacacacauuuuaccugcauuuuuugucuacggaccaaaugugugcagugcccaaguaagccagaagagggagucagacgauuacaaaugguugucaagcgccauguguacgcaccauguguauguugagaauuggaccuagguccucuguaggagcaaccagugcucuuaccagcugagccauuucuccaggccuucucaugucuuaagaaaaacaaaagcggccugacauggcagagcacaccuuuaaucccaguacucaggaggcagaggcagguagauagaucucugaguuugaggccaaccuuggucuacagaguaugaguuccagggcagccaaggcuacagagugaaacccuuucuugaaaaaccaaaagagagaaaaaaaaaaaaaaggaaaaagaaggaaggaagaaaagcaaaaacaaaaaaugccaaggaaugacuuacuguguguagugggcuuccaugucaguguagaguugucagugcugggcguggagccagagcugcugggaacagcagcagggguaugcugccccacaggauggcucgcugugcucggugaagaauccacaggcugcugagggcuuguuguguugucuguuguggggguagaaagaagcuuugaggugguauuaaggucaguaggcugagaagagacguugauuagccccaaagugguuguuggggcugugguaaaacugucaccgcucuugccuccagaggaggcuguuuguccacugcuacuggugaaggccgugcuacugggagagcuuguuuuagucuuguccaccucggagacacuggaagucagauugccaccgcuuugauugcucgugggguuugggguggaggucggcauagauggagauuggguugagguugugaaugguguaggguugcuuggcuggguugaagcaaguguagaugccacugggugaccaguugugacuucuguugauguuguggcacuuugguggcucuggacagugcuagauuugauagcagaugugcuagucucauuuccugucgauaaagacaacacagaaucaagccagguguuagccagagaguuuguggacuucucuagcucauucccaagugcacgagcuuccuacccaucucuggcauucgccuugcugaagccugcauccuucaugagucuacaguuacaucgucccucaaguuugccaugggauucugcagucccacccccaaccccaccccgcagcucccagaugcccugccuuccaaaacauuacaaguaccgacaaaagccacauagccuuuccacggaugauacagccaacaaggacaaauggaugacagacugcgguuacccaaauguucacaaggacccucuguggacugugcuagggaaaagcagugugcuuggguuggguuuagcuuggcagcuuaaccuaaguggggaacgggucaaggaagagaggcuuuuuauugguuuaaaagaauguguguugagggcauugcuauaaaacaggacuuguagugacuuguguggaacaagacccagaaccuacaaccccagggagaugacaugaagacaggacaacugaauaacagacucagguaacuucaggaagaaugaacaaggaaagaaaauggagaggggugggaguuggggaugguggcggcgagagaagcagcuacccugcgucucuugcuguguuaagacaccuugaucaaaagcaacuccauggauaagucuggguuugcuauggauuuauaucggggaguuaaaauaagaccuuagaagcagcauauccagucgcaagcauggaggauaaccaugugaguccucagcugcuacucugcucuguuggcauccaugccugaaggagggugccacaaugggcugggucuuccuacaucaauaagcaaucaggauaaucuuccacagacaggcccaccaggccaacuugaucuugauaaucuauuacuccacgaauacccucuucccaagauggcuccagguuggaucaaguuggcaguuaaagguaaccaacagagcucagcccuugucaacuugacccgcaaauucaucacuuuaagccgcuaacagcagcacccuaaggaccauuaagcuaaaaggaaggaugugggagcaagaagcaucuccaacagagaaaaacaggacaacaugugaaggucucaaguccggggaaagggacuacgggaagacacggaugucugcauggagcuuagagagugggggagggggcgcugagacugcaggucuuagagagugggcugucaaaccgaacaguucugagaacagaacgagguucucuuaaaaguauaucccagcccaggugugcugaggcagucuuuuugcugaggcaaaagcaggucgaucuccgagaauuccaggccaggcuggucuacacagauccagaagagccagggcuacauagugagaccccaucucaagaaaagaaaauuauauaauauauauauauauauauauauauauauauauauauguauguauguauaauauacauauauaaauauuuauauaaaaauauauuaaagauuauauaugugugugugugugugugugagagagagagagagagagagagagacugggaucuugucuauuuauggaauauauauauauauauauauguauauauauauauauauauauauauauauaucuccuagaucaaaugaucccuaaguucagaggccaaaauaaggccuuuaaucuuauuuacauggaagagauaaagcaccaugcuuucaccuuuguagaaugugaucuaaagggagaaagucuacagagaggaccaguagggugucuaucagucacccaggggaagggcugguggcuggagcuagacacuacagacaagcaaugguuggagauucaugacuguauuugaaucgagccaguguggggaaggaggaaaaucagagacugugagaggguauaggugauucccgguuuuguccuucagcagaagggaggcuguguggggaaggggugccguggccagccuacauuucuguguggacgacuccucacccuaugagacaggccagacacaggcugaaaaugcugcccaguauucccuguguccacaagcaggugucaauugcaugggacaugcaucuagcugggaagggaagaaaucauaauggcacagaaggagaccguguucaagcgcaaacaguccugacaggugaugcuagugaguaucccaagcuccgcugggcaucuugaaccacagucugaagaggggauguguuucuccauaaauaggcaagaucccagucucucucauacaugguauggcaccaucaagccuugcaggagccaaaggcagucaaaaaucuauaaaggggacaguauucugguucaugaagugacauuugugggacugacugcuauauaugacugaagggcacacauaauagaaugucauauuuaaauuaaaaaagcaaucaacccagauguaguggugcauaucucuugucccacuacacaaugaguucagggaauuuggaccacuugagacaguuucaacucucuccugccacacgcaaacaaaucuagagccauauugcagagucgggggugaguuggcauguccaugugaucaugcaucugcauguacacguaugcuggugugugcaguacaugccagcacauguggaaacugacaaccuugggcaucguuccucaggagacacccaccaggucucucacuggccuggaagucacugguuagacaaggcugagguggggugaagaggcccccugucccagcccugaauuauaagcaagguuguggggauugcgcaucgcaucggucccucauguuugcauagccagugcuugaucuucccaacucucucgaugcgauacuuggacuggggauuucccaacugauagcaucauaacuucuugucacccugauacugucagcaucgggggaguuugaagaguugcagaaucagacaggaacucuguggugaucugaaugagaauggcccccacaggcucauauauuugaaugcuuagucaucaggaagugacaccauuugagaagaauuagguguggccucauuagaguacauguggacuuguuggaggaagugugucacugagggugggcuuuaggguuuaaaaguccaugccaguuccugucugugucugucugucuaucugucugccugccuguaugucugccugucucugucucugucucugucucugucucugccucugcucucucucucucucucucucucucucucucucucucucucucucugcuuuugggucaggauauuguucucagcuauugcuccagcaucacaucuaaaugucugcaugucugcauguaugucuguacgucuguaugucucucugccaugaugacaguggacuaaccucugaaaccauaagaaagcaccccauuaaaagcuuucuuuuuguaagaguucccaugaccagcugggugguagguagaacacaccuuuaaucacagcacucaggaggcagagguagggggucucugaguucgagcucuguguauguacauagugcauucuaggacagccaaagcuggacagagaaacccuguggggggccgaggggguacagaagaguugccauggucauggugucuccucacaacaacagaauggugauuaaggcagggcucuuacaauggugaacagaggaaaacagcuucgcaaucuggagcuguggacauuuugaacuggagucuccucuguuauaggcagcugcucugugcauuagaguguucuagcaacaucucuggccucuguccacuagcuguaaguaacagacacacauaucugccuccaacuccagcaacugaaaaugucccaauacugccauauguccccugaagguaucagugacuucccaaugaaaaccgucuaacaugagagaacagcaaacucgauucauaaagccccaaccgcacagaacaaaaaccacagguuuucuaagaucaaagagaucuccguuuggcagcugagaggcugagaaggaugaaagacaauagacuguucuugccuugcggguugccaaaucccagcauuaguuuaacugaucaccucaucaggucucuaguaacaaaaauggaccucacauggggauacaugcaaaugaaccaaacuacccauaagucuccaucucugauggcauucccuuguuaguagagucagccacauugcuauaugguaaauccaaucuugcuuaggacucccagaaauaccagcucucaaaacacaaaaauaacuuuugcaucaggauaaguuuaucaauauagguacuuaaucagagacccaguacuccauaugcuggcucaagguacccagucaguaucauuuaucuauaaucaugucauuccuaaaguggugggagguuagagagucugcaaaguaaggaacuacucuugcgguuguguacacacacaugcaaauacacauacaaacaaacacaacaugaacaaaguuuuguuucauuuuuguuuguuuguuuguuuguuuuuuaaguauugguuugaccccagcaccaugugcaggcagugaugagcaccuauuuugugugccccguucucgugcccucuaacucuguccucuuagcucagauagcacaacuccagacaaggcuuccagcaaugcuucccacauguucuaagaugaacaucucauuguggcucucuaaucaacacacguuauaaauaucuguugaucauguuuucagaguuuuguuuuuguuuuuagugguuuauaaaauaguuauucuuucuuuuucuuucuguuucuuuuuucuuuuuuuuuuuuuaaagauuuauuuacuuuuauuuguaugaguacacugcagcugucucagacacacaccagaagagggcaucagaucccauuacagaugguugugagccaccauguaguugcugggacuugaacucaggaccucuggaagagcagucagugcucuuaacugcugaaccaucucuccagcccaacuuucuauuuuuucaacguuuguuuuuggguggcggaguuuuacucugcagcccaagcuggcugguaacccaggaugacccuucuucugccucagccuccuaaauacuaggaucccaagcaugagacaccaugccugguuuccugugcguguuauaacugaugguggcuuggauuacauagaacugagagugcuguuagcacaguguacaguuauauugugcuucucccuccuuagccagcuauguuaaucacauacugaucccaaccaguuuggacccaaacuugccugaauguagagacggaauagagcuuccaggggagaaagauauauguuauucuauauucuaggcaggaagaccaguuugacaaucagcacaaucugaccaaaggggauuuagaauagcagauaagcaucauguauauuuuuaagauuuauuuauuuuuggugugucuucaggcacaccaaaagagggcaucagaucccauuauagaugguugugagccaccauguaguuaguuacugggaauugaacucaggaccucugguagagcagccagugcucuuaaccacugagccaucucaccagcccuagaaucauguauucuuaaaggccaauuguaagagcuauguugaaugauguuggaggacacuaccacuuauccaguucccaggagucagugcgcccacacacaagucccuccaauggagcagauuccucucguaaagguggcuucauaggaguaugacaguacuguccccagcuccagagguuggaagccggcagucccacauucccucuuucucaguuccuggcacuccuugacuaauagcugugucacugcgcucucugacucaucaacacauggcuuuuuuuuccuugugugccucuaguuuugucaagggaggggaaccuggaguccuaacccaaauccucauggauaccaagcaaacauucuacuucuggguccacuaguuuagagucugcccuacuccaguaugugguagaauauggucacacuuugaacccugcgauuguauuauuuacuggaaaaaaaaauguuucuaguugugguguggcucagcccuuagcacacaccuugaaccccauacaacgaagguaaaguuaguuuguagaaggaagcagccaguuuugaaagugaugaaucagaaaaggauuugacagaauaggaucugccugccucuuagaagagagagaaagggaaacaacuuaagaaagcaguggaggggcuggugagauggcucagugguuaagagcaccgacugcucuuccgaaggucccuaguucaaaucccagcaaccacaugguggcucacgaccauccguaauguaaucugauggccucuucuggaguaucugaggacagcuacaguguacuuauauauaauaaauaaaucuuuaaaaaaaagauuaaaaaaaaacaagaaagcaguggagagagaggagaggggagagagagagggagggagggagggagaaggcaguuuuacugggacagauguacagagaaagguugcagggaaagagaaaaaaaaacuagacacagauuaagacagaccuagaaaggagcgagcuuauucaucaguaacacuguaggccuagauuagauuguauggaggcuagaagcuuccaggacugggcacagguuagcagacugaggcaguaagccuuaaaggugacaguuaaaucaggcaaauaaaaaauacaauaacaccaaugugauuucacaguaaccuucaaugacuguaugccucgggucacauucacaauguucaugguaaagacuugaaugugugucuauaauccugggauaacuaccuccuaaauuauucccccauauuccaucaaaccugugacagcuugcuugaaauaccaacuuuucauaaccuagaacccucuaagaaagcuucaacugagagacuggccuauaggcauaucugagcaauauugucuugauguaggaagauucagccuauugugggcagcaccauucccuagaugggggucccaaucuaagcaacauaggagaaagcuagcuaacaacagcaaaugggaagcaaggcugucacuggugucaacacugcgugccuuagguaggucagaaacagugucucacccuccucugagguaaccugggaaagccacuggucugccaccaccauuucacaccacuaauucugugagugcuagaaaccagauucauuucugagaacugcggucucuggggacacucuacauuaacuuuuaggaaugggccuggcagggaaucccuuggguccuauccauccuccuccugcuuuauuauucaguagcauguagagucgauggucaugagugaaacccaggagcucuauguuccauacugugcccacagcaagcauguuccuugcaucucacagcaucugaaggcuacugcuacuggaaaugcagcugcagggaacacacacacacacacacacacacacaccuggaacauauguguuuuagccacaugcucaugagcccgugaaacagccacgaggugauggagaaagaacggacacacacacgagcccuggggaccaauggagucagacaggcagccccgccccagccacaucccacuagugcagccauagccuugacccucagugcccaugcaugcuggguucuuccuccugcuccuucuaaaccacuggcucuaacccuucagguacugccugugaaaggcacuagggaaagcucuggccacuggaagaauguucucuuccgacaggcucuccccuaauacgcuaugauccugaagcauucugugccuaucagccuaacauuaucuagaagcaggcuagacaugagcauccuacuaggggaagaugaagauccauccauccugggaagcaugagguuugggcccaccauguaguaggucgggcuaagcaugcugaagaugguccugcacugccauuauccuggucuuucuuuaggacugaguaaauucuuguuugaauuuugugcugccauggguggaauccagggcccgcaauucgaucgugaaaacugaacaauggaaugaacuaguaaugauaaaaaucaaugaaacugaaacuaaaauucaacagcaacaccaaacacacagaauaguuuuguuuugauggggggcgggggaguguuucucacuauguagcccaggcuagccucaaaccuaccauauuccugccuucucuugaguaacugggacuacauaaugauguacaaggacucucugggacugagccuagcuaauaucuagggagaggaagugggggcacaccccaauccacaguuuccugaguggggauuaaucagaacaucagagaagguccccgccccugccccacaaugccaccaagggccuuaacaauggaaugagcuggguaaauugaaaaaggcagacuccuaggagcagauaaaaacaaaacaaaaccgaaugcuacaggcgcuagagagauggcucagcagauuaaagcagaagcugcucuugcagaggaccuggauucaaugcccagaacccacaugguggcucacaucccucuguaacaccaaucccaggggaucugaugaucuauucuggccucuguggguaccaagcauggaugcggaaaaaauaaaucuaaaucuaaaauaaugaugcuguuucuaaagaacuacagccaugcagggagacaaacaggcauuucuggaguacaccccagccucuagugaacuaaagguauccauaguaacaacagcauuuaaacccaagcccgcuggaccaacacaccuuucacacuuaagauacaggagagcaaaggcucugacuuggccuauggcagccacucaccuacuguguacggagcugccucuucaggacauguucugugauguggugccccuaagucuugcuuuucaccucauccccuccguagggucauccuguucuuuaucccuuagcucugcuacacuguauuauuucaccagacgguucuacuguauuuuccucauucguccuaggcugugucuaccaucagccucccgugagcaauguuucuaggaacauuuguauguacagauuuuacaugagauguauguuucuauuucucuaaguguagcaaugccaagcuguauguaaacucuguauuuagcaucuugauaaacuaccaaacuauuuuccaaacuggcugcccaauauugcauaagcagggguuuuucauggaacuugccuuucuauacagccucacccaguuuaucuacuuuugucaugaucgccacuucaacaguuaugggcugguaucucagugccuauugauuagccaaacccacaacaccuacaaaggacagcacucaaugaccaagugggauuucucaugcauagcucagaauuuacaaaauauaaauacccauaauaacaaaauaaaauaaaaaccuauaaucaucuuaauuccaauuuauauuugaagauuuauuuuuguuuuuaguuauguguacauguuugcaagcguauacacauaauaaaugcaggugccucgaguccagaagaggacaucggauccccuggagcaggcuuugggagcagccugauguggggugggaacugcacucagguccucugcagcaaaugcucugaaccacugagucaucucuccagaccccucuuauuuauucauuuuuuauuaauauacuguugcugucucccgacacaccagaagagggcaucagaucucauuaaagaugguugugagaugggugaugguggugcacgccuuuaauuccagcacucgggaggcagaggcaggcggauuucugaguucgaggccagccuggucuacaaagugaguuccaggacagucagggcuauacagagaaacccugucucaaaaacaaaacaaaacaaaacaaaaaacaaaaauaaaaaacaaacaaaaacaacaacaaaaaacaaaaacaacaacaacaaaaacagauguacagauguuugugaaccaccauguggcugcugagaauugaacucaggaccucugaaagaggagucagugcucuuaccugcuaagccaucucuucagcccccucagaaaagaaggaagaggaagaagaaggguggggcgacaguaugcaagugaacuaggaauagaggaaaauguuccuuaccuaauaaauggucaaaugaugucuccuaauaagcuauggcauacagaaacugggagagacuggcugggugcuuugggaaaaacagaucuauccuuucuuacccugcuuccugaaugcaagaccagccaaucccauagaggggggaguguucaaaacaacagaagcacagcaacaggggcaugccuaugaccccagcacucaguaggcugaggcaggagacugcuggaacuuugagaccaaugugggcuacagaguaagaccccaucccuccaaaagaaaaggaaaaaaaugccaaagauacaucggaagaaaauagauagagaagaugcucagccuugguccuuaggcaaauccaaauuaaaauuacagugcagcucuacauagcuacuagaauugcuaaaagcaaagauuaagggcgaacuccauacgcaguagaaaugcaaaauuagguuagcacuuuggagaacggguuauccauuuguuuuacuauuuuuugcaggacugacaauugaacccagagcccugaauaagcuaagcaagcacuccaccacugagcuaugucuauagaccuuuguuuuuuaaacacuuuuauuacuuaugugugcacauacgagugugcaagagcaugugugcauaacauagcacacguggaggucagaggacaacucucagaaucugagcucuccuuccuguugguuccagagacugaacucagcuugucagccuugacagcaagcaccuuuccccaccaagucaccucacuggcccagcccuugauauguuuuuuuuccuuuuuuuggagacagugccucacuacauaauccaggcuuuugguaacccuauaaucccccccuuucuucacauccagagugcugggauugcaggcaugcaugaacacagcagcuuaaaauacacacuguaggugugcgugugugugugcgcacacgcaugggugacuggagaacagcagaguggcuagagagacugaagaaggggaggggcuuugugagguuauuugggcaacugcagcacuguggugauggauaaggagaagcagaaccaagcaccucaaaggcguggcuuucuuugcuguacauggugaaauagucaagugggaugcugaggaaaccccaggaccaaugaagucuacggaaacaaagucagccacauucuagacguguccaucacacagccucacugcauagaacaacuccccucugcaguaaggagaacccagccugagcucucuguguuguguuuaauuaccugcuuaguccaacuucacagguaaaaucaguuugaaacucauaacccgugccuuugggugaaacacacuuuuaccacuuaaaaacacaaaguccacaguucucuguagacugccgucaaaaagcuauuguucagacagaucgcagacaagcaagagagagguggaguggagaagcuaaacaaguccugaagucuagagaugucagggugagcucaaguuuuuaccucauucauucauuuacucguuuguuuguuuacuguauucauucauucauucauucauucauucauuguguggcaaggagugucaggugaugaguuuggaggucaguagacucucuccuuccaccgugugguuccagggaccaagcagcuugucagacuugccagcaagggccuuuaccucugagccaacuugccagcucacgagcucauuuuacuguuuuguacggcuaguccgaugaauauacacgacugcaucuucuugcucugccccauggcagcaccuagcaggugugacaaagcagcagcacacaaccugggaccagacugugccuaccuaaugucauccuccaggaacacgcaccaaccagggcuccuggagaaagguuugcgcuucuaucgcugauggagcagcugagcccagaacaucuuguaaugccaggacaagugaggaagacaacaagaaacaaagagcaaguccaaaagacagaaagcagccaaaugagggauccacccggaggagccagucgugggccguuugaaaacaauaaggcgucaggaugaaugccuggguguggguguaggggaccauaguaagcaaagaccagauccuuauagaaucccaaaggguccaguuauccuccuccaagaagucugcaaaagcaaccacaagcaaaacagacacgcucugcuugcgacaacuucccccaaaggcuugugcuggauauuugguccccagaugaagcaggucagcagaugaccaagggugugccuuggagggguguaucuuugcccugccgaguccccucucuccccuccccucccugaagcucugccucaccaccaguucagacucacagagccaagcgaccaugaaccccucggaaaccaugagccaaaauaaacaugucuuccuuuguucuucuuaauuuguuacagcagaaagccucuaacucaagacauuucacagaaaaaugagaaacaguacauauaagccaggaacaucaagaaaugucacuagcuaaagaagugcaaaauaaaagaggggguugccauuucauaucccccuaaucagcaaaaccuguaaauccagacaagggguaggcagcaagaauauggaguaaaggucagaagacaugugcaaagguaaacccgcuuugccacccagaaccacuguccaguacauuucugacacauguacaaaggaauguggugcaaagacagcuccuacggaugaaggccgaugaggucaauucaaagacuggucuuuuuuuaaaaagcauauggauuaagugaaaaucugcacaaauacucugcaaaauagaacacugggcaugugcaauucucucaacuuuugguucagcaacuuuugauuguaccacuccaugcuuacccuaaggaguuccagaaacaccuccaagguugcuuuuuguauuggccccauacagacaagaauaaauguuuaccaauggagguaguaauaagaugugauugcagucauguaccugaauacuauagaacaggaacaggggugacuuguguuuacauuuacaauuacauuaauucauugaaaauuaaaaguccaagacgacuucuuauuugagagagcaagcacgccauguuccagccagcaucagcaggcugcaacaguaggucugaaguuaagguccacuuagaugacauagagagacaaggcaaaaggcaaagcaaaaagugacgcauacuugauuauaccauuccaaaacugccaaaauguauccuuagggauagaaacuagaaaacacuuguuuaacuuuacagagauucccaacacugcauucugggcaauuaccuacagugggaaacagagacaacaaggguuccugccaucuguuuuucaggcaagaauagcugcugagccaugagccuagcaacaucugggaggggggugcuggaaagcagaggcacagggcagcuggaagccuccugaugagggagccuauggagagagcacagcugggggcucuagguggagguggggagaggcagcucaggcagggauccucuucugcacgggugacuggucuccuucuacugccucucugaguccuugagauauaaagagagcuacauuggugccuggauaugggacaucugcaucuuugaaaggucaaggaagaggaugacaaacacagaccucugcccguuuguaauuuggggacagggagaucuuacacauggcaguucaaaugcucauauucagaacucuccaaguggucccuaucuaaugacagcagcagcugcugcaggggcugcugaggaagugaagcugaugggaugguuaugggggaggugaaggaagggguaagaaaugcccugggugauggugaugcacaccuuuaaucucagcacucuggaggcauuggcaggaggaucugaguucgaggccaggcugaucuacaaggugaguuccaggacagguacgcagagaaacucugucucuaaauaaauaaguauguaaagaaagaaauaauaagauauucccauugaaaauagcaaacaagaaccuacuagaaaagugguucucaagccccagccagcaucaaaacuccaggaggguuugcaacauuccaauguuuacaccaguucugggagaaacagacgauagugggacaacuugcugguuucuuggguucccacuguuggaugcugcuggucagaggaccacuuucagaaacauuauacuagacaaauaagacgugauuguuggguagcauucgguggcaacauaaagcacaauuugugaguguaagaugaacugagucagccgugugccucugcuccagcagcggucagaugcuuagaagcugggagagaaagcggaggggaaggaccaccuggaaagaggagaacaggggucugugauagaggaccagugagacccaggguggcuaagagaaagacagacuauagagcucaauuccugugagugacguggguucaugguccgcccucuauaaccacaguggagggcuuggcagcuaugaacucuguugcccuugugauagaccuggcuucagcucccagcacuccuagggagccucacaaccaucuauauaacucccguucuaagcuacacggacaccggaaaugcauaccaugcucauacaaagcaggcacauaaaauacaucuaaagaaaaaaacaaaaaacagaaaaacaugcagacuugcaacccagugaagaucccugggucuaggugacuugaagcauauagaaggaucagugcagacuguaugcaaaugcuaugccauguaauaagcgacucuaccaagugggggaaggacagggucuuagcaccagccuccugcaagugccgaaggauggcucugcacaugaguuggggcagagggacagcgaucggcagcaagaacacgggcugguggugagauucgaaguguggaaaggaaauggccaaauggggcgcagauggaaaaggguaggcaaacagguuagacuguuucucuucuuaucugagaagcuguccugcgauagaggggauggaggacagggcagaugcuuggcgaggaggaaagguuaccucaggcugggguagcugcugccccagcaggguggaggacggagcaaaagaaggcccuuucagccugcuccccagggagaggugggugcugcuuaaaccuuccauaagggcuggcuuccuccuguuccuggcugcucccagaccugggacugacuccacuauuaauagcagaaaaggaaacuggaaagaaugcuccaggaagagggcguguggaaggcaggcaggaaggcagcaagacuggacuccacccggacacucgccuggccucuccuuccuuccaccacagcuccucacuccaagcugucaccuccagagcaaugaaaggacagcuggaccugaggcagcccuccuuggcuuagugggaccaaagaacacacacagauggggacacagaccccgcccccagccucugacccugagacccaggcacugugaugcaugcagagaguuuccaaggucccucagaauaugagcaauuccuguguaacacugugcaauacacagguaagccagcuuuuacugggacuucggagucauugacacaaccaccaaggaaggugugcuccaggcugccugcuucgaugcucaagugacacccacucccugagacccaggaaggaccuagggauaagcagcuccaggcucagcaagugaggucugucagaguccgcacccucuccagggccauuuuucccugggccccugauucacagacagggucugaggggcaggaaaacacuggagcaacauuggagcaucuucagucuggaagaguaaagucugaaaucagugucugcgugaauccuggcagcucugaagcaucaucucuucccugcagcucccagcgacaccauccucagcucagccuugagggccacugucuuagccaggguuucuaguccugcacaaacaucaugaccaagaagcaaguuggggaggaaaggguuuauucagcuuacacuuccacacugcuguucaucaccaaaggaagucaggacuggaacucaagcagguuaggaagcaggagcugaugcagaggccauggagggauguuacuuacuggcuugcuucuccuggcuugcucagccugcucucuuauagaacccaagacgacccccagagauggcaccacccacaaauugaucacuaauugagaaaaugcccuacagcuggaucucauggaggcauuuccucaccugaagcuccuuucucugugguaacuccagcuugugucaaguugacacacaaaaccagccagguucucgaaaagacaacuguggcuuguuguagagcccacacccauauaauccaaccagucucaaaaaccuuaacuaucacagcagcuaaggcucuuuguccaaaucaagcagaaauuacauucuuuugucuuuugaggggacacucugucuaccguggaaaaacaugggcccugcccuggcgugguuucucgucugguuggucuauuuagcuucccucacggaccugcucaguuuuuccuuuacaggauaccccggcucccauaugccccacauccguacuuggucccagugaaacuaaagcagaggaagaggguaggaaggagcccaaccaucugacuuaagucuccacaguagcuguguggccaggcaacugcccacucuccauuuucccccguguauccaagugagcagugggcaggaagggcaggaugauaacccuuggcuuuaaguacucagaacaguggguucacaagacucaacuaucaugagcuguguccuccaugccuggagguaccuccaacuuccagaccucaguuuugccccuaccuauuuccugcuacagagcugugcaccccaccuuugccuucaucucucacaucugcaccacccuacgcaaguggagggaggggaauccacagugccccccccccacugcucuugggaggggacaaguuaaaacuggaagggggauggugucugcuguaaagaagggcuccagaugaggggcuaagccacuaugacacaguaauaugccaaagaggaaagcaaaggcuucuccgagucccaaagucuuucccacgaaugcucaacucuguccagggugaacccaaaggcaauccgagaugauauuguaaauuaauuaagcauggcugugucccaauaaaacuuuauuuacaacugcaugcagccaagcauuuauugguuggccuuugaugugcuuuuucuccugggucuggggauugacgcuuguguuuucaucuagcuacaaauccuguucuaugauuucccuagagccucacgguucacucggaugccugcaauuagaagcggagccaaagccucacauacaaacacagaaaaauacacacucaaccccugagaaaaacaaccaaccuguuaccuaccaccaaaaaaggagaagucaagauuaguuuacagaccugaaguucuacagcucagcagcagaccuaggggacuggugucgugaugggaccuuguaggacucuuccccucuguauggcuguuaucaacaacacucccuacugcuuagcagggagggacugugcccauucaccuugcagcccagacaccugcaaagugucugucccaguauacaccuaguguauuccagggaaggugccaacaggggccacacauccugacucucaagggacugucagugcuagcuggcaucagggauggguacagucagccagcgcuccaccaggucacuauacccaacuuacuuuccacuucccuucucuccagaagaggugacuggaaccugguggugugggucccaggacagcuuuacaauagccucuuccuccuuauuugaaaaacucucccacucauuuuaaggcuggacgaggcaacccaguaggaggaagagucauaagagcuggcaaaagagucagaggcaccccccacucccacuguuaugagucccccaaacgccccaagcugaacaaccauagcauguauacagaggacccagugcagaccaugaauacuccgugacuguugauugucgaaucugucucugugagccccuaugaguccugcuuaguugauucuguggccuguguucuccuggaguccucgaccccacuggcuccuacaauccuuccucucucuauucagagggguucaccaagcuccaccuaauguuugcaaggccugcuccuuucugaagggaaagggggggggagacagugaaucugggggagaggcacggugggggaagggacuuggaggaucggagggaggaggccaugcccaagauguguugcaugagagaagaauacauuuuguuuuuguuuauuuuuuuuaaacugucccauggaggugccuggcuuccugcuuuccgaugucauguuaacuggcaggcgagagcucuacuaggaacuguuagccaagcuucagccaugcagaccuggcuggcucaggagugucauccucaugucugcagcagcuuucccaacccucgaguguccuugaaugaaugcaccaguccugaaggcucucuccucacacuaaucucccaucacaagcagaguccuccugugugcuguaauuucuugccaggccagauucucuuuuucucccauguccaugagaaccccaaccaagacacacaaccaggacagggacuugacuccagggaacaauuugacuggccaagaagugauccauuuggccuggcugucuuauaaugaaugggcagugacaacccuuccucgucuggugguggaggagccgccucuaagaggccugucucuagguccacugcucccagugugucucuagguccacugcucccagcguugaaagguaugcaguugagugugcaguaugaugugccacacggcuuaacaacaugauguaauuagaauaccuuggaauaacgacacaacacacaugcacacguauacacacacacacacacacacacacacacacacacgagaguggggauuaagaacacaucacaucucacaaagacuauaaaaauggacauuuauuuaagccugcacugucuucccucuccauuucccaaagcaggaggugaugauaauggaacucaggacgucacacgugcuagugaggcacuuugugaccaaacuguaucuacagccauauugugccuuuuuuaauuuaccaccacuagcaucgccuccaccaucacugccacuaccaccaucaccaucaccuccuucuccuccuacuccucuuucuccuccuccuccuccucuuucuccaccaccacuaccacuuggcacuugaugguuugagauugguaacuucccuuacagagucucacugugcaguccacacacuccuuauuugcaugcauccuguucugggucugaccgaaauuaagcuagucuaaagacauacuugucucucaauccaucaaacuauccaaacaauggagaaaugggaauuuccccagggagcgcaggcuggaagaagggcaaggcaccagccaggggaagaacuugucucccaggaaaaucucauagcucaguaacuugucagcaucuugcaggacgacugaagcccagugaugggucaguggggaccagcaccauguagauguguacaucuuugacccuucacuucagaaccccaaagauggacuugggaguuugcugaaugucuuuguccaccccuuccaguguggccacaauaaagucuuucucugccuuccuuccacuuuuuguuagcuuauuaaggacaggugagcaggccuggcuugggacaauccuacugcugccaauuggcuccaucauuugcagcugugaacugcagugccauguacacucaggcuguguccuaugaacaucucugugugcacaugaggcagcccggugacagggcuggcugggcccguugcugaggucuggauagaagaacggaaccagggggcccccauucccauguacaccaggccgcagcuggagucaagucuucucuacguggccacuccacucggcucugcacaccacccucucucuggcugucacucgguggugaggacaggggaaucgcucucuggagccagcagccuguucuaaggcugacucagaagcugaacaacccuguuugcacagaaggcacggaggguaagggaccuagcuaacuagcuagggucacagcucagugcucucucccaucucuucugauaaaacucagaaaggcccagcauaagcagugucccaaccacuuggcgcuucuccagggagaucaaggcccagaucucacucagcucuacccuugagcccucagcaggaaucuuaggaacauucugugacucagagaggaggguaagaagagagccuggaaugucauccugugcccagcucuacccugcugcuaccugugaagcugcccacagcugcucccucuggcuccccccccccccaccucugcuucccugccagucacagcugcccugucucuacuggaagcuucauuuaaggaugccagccugcccagcuaccuggagaagggaagggguggggcucuuccugaggaggaaugagcgagccauuagcguccuucaacagcacccucacagggccuccuaaucccuuggcagcuacuggccaugugaaucccagucagucggucugggcaaggugcccaggagcagccuguccacugccaguggugggcagggacagaggugaggcccagcugccuuguucaccccccucccccacugccaacacagguugcuggacaaagccacaacagaagacagcaccuggaaaaguguuucccaagggagcccuucacccugucacagcacaguuucaauaggcaccacacagaaagcaagggaaggccugaaauuuaugugggcaggggucucccagagccuggauuuccugucugacaaccaugggucaaaaugaacaaacaagagcggggaggggggugggaagagagggagagagggagacacacacacgagagagagagagagagagagagagagagagagagagaaagagaaugaacaaguauauaccuugagaaaagcaacaaaagacuuucaaauccacagagacaggaggcaagaggggccagaucaaacacuguacuguguaccugggauaccagugcaugauccgccuugcaaugucugugucuugauauaccugugaccacggagacaccaaggcagagguguggcuguauguucucucucucucucucucucucucucucucucucucucucucucucucucucucucucucucauacuguacaguuuucuauucaucccccuaguauaaagccugucuaccucuugucaggggaaguggugguacauaccuuuagucccagcacucaggaggcagagguaggcagaucucugaguucgaggccaaccuggucuacagaacaaguucuaggacagccagggcuaugcaggaaacaaaacaaaacaacaacaacaacaaaaaaaccaaacaaacuguaaagccgaccucuuaaauuuaacuaccaagguuuauuuacuaaagcuuucucacauuggccagacacagccuuucuauaccagucgggccauugcuuuaugacuuugucucccuuguaucaauaagaagaagcagaccacagacuuggguggcuaagugagauucgucucucagucaggugaggaaccuggacuggaacccaggcaacccagggggaccagagggcuaugcaacacucuuucuuagacugugguguggggcucugugguauuggcucauuguggugcuggcuccucccaguagagcgccucguacucgacccugcacauuccacauacaccucuuccagaggcaaagcgccugcgcauuuggcacaccacgcuucccuucacaguucggucaaaaacaaccucgguaaauauuuuucugagggggcgcgguaucauucccacgccgccucccagucccgcgaacauagccagaugcguacaguuucgaaguggcccccggaauccucugccagggaccagccuccacucuuggccugccacaaacaaaggcaugaagccagagggaaguccugcauccccagcuguggaagagccgccucugggaaccagauugaaaguuccgucugugaaauggagccugugaauuucccugggaaugacugccuuucaucagguggaagccaggggucaugaccacaagugaccacaagugaccucaagugucgcuuuccagauuucccagcuuuguguguucugugcuacagacgucccucuuccaggaaagacacccaugagcuucuggcugaagaauaauucucaccguuacaccuuucccaccccugugcuugguugaggcagaguggugugugugggggaaacauuuuguuaaggcguggcuuugucagcaccccaacugauaauuccugaagcaaaaaauaagaaagcgaacaucagcuggacccaggaggggaaagugcgaccacccaccggagugcacagagucuggucuucuuugagagugggugugugagcacaccaaaucaauggcuauaacuaagccacuccgggcuggcuccuuuuaaagccaagccuuaacucacuggagagucagagcuaguguaggaugcuuucuuuccacagguucagccuaggaugugagccuagaauccaggcagccgcuggaaaccagauuuccagacagcacaggcucauuccccuaagggugucgaggauuaccgacaucacacagugggcaugaccacaguaaaggcacacacaugcauacacaggacggggguuguuuugcagccuuaccuuuucuaggaaucgggagcugcacugaacguuccuucugagguuucccgagucauggcaagggcuaggcugucuuacaucacccgagcuggcuuuugaaguuugccuugagguggguagggaagguuccauuccuuuccagaaucccacgcucgcggguguguguguguguguguguguguguguguguguguguguauguguguguguguguauguguguguguauguauguguguguguguguauguguguguguguauguguguguguguauguguguguguguguguguguguguguguguguguguguguguguaugugugugcgcacacacacacucccaucguagcugcagagcccagauagauagccaggccagguuuauuccauggcucaccuguguaacgccacucaggcuaauccaaaaccaagggcuaugacucgaaaagucacuaccacucucccaucuccugaucccauuuggaaaguggagacagcuccacaccaagauuccucuaucccagaguggccaacagcacaaagcagguccucagcuugucucgacaucccuuugagccuggucccaacugggccuauggucaggcacuuguguccuccacugugacccagggguuggcagcaucccagacuguccuaagcaggccacugccuuuaagacacuuccccugaaggcauucacagcaggucagaguaucaauacggcacguuccuaggucccccuccuuggguguauccacacaugaagucaaaucaucaguugagacgaaacaaacugaaaaggcccccaggagcuacuccacugguaccuuauuugcagaugagaaaaccaaggccagcaggagacuucacgcugucuguccguccagguggaacagccucuaccauaagccagucuuccuuucucccugcuccauggugcaauugugagcucccaugaucugucucuccuuacucccccugccaaccaugccucucugccacguauacuggagcagcacaugugagcagccauagcuauaguuacagagggagagcuguggcuggcaugucguugugauuguccuaagggguccuggaaucuaucacugugcaugcucugugagcacacaggacagaacucucagguucucccagagcuuaaaaggauaaacucagaaaaugcccugccucagugccuaccccuaaccccaccccaggaagcccagcccucugaagcuacaaagccagaaccagggguggccucacaaugagaagcaaguguggggugcuccuaguugggcuacgacccaaccaugcaaggaagggagacaggggacacacugcacuuugucugcacucaggcuaggguggggacugaaccugcuuaauuaacuccuugccauugcuucaauuggggguguaacauaggggacagcugcaacugggaaagcuaaugccagccaguggcucccaguggcuaccguuuggcuuagccugaguccugcuuagccagcucuacagcauguccccuugcuccagaaugucucuuucccuuugacaccugggaccugagguacccaggagguguuacaggaauugggguaagaggcaagggggcggggaguggagccaagagcaaccagaaaaaugguuggccagcagggaacucaaaagaucaaacaccggaagcaaggguccccaaacccaguuuuugcuugcuugcuugcuuuauguuuuuuuuuuuuuuuugguuugguugguuuuuugacaaggucucacgcagauuccgcuaucuucaaacucuauguagucaaggaugacucugaacgucugauucuccugucuccaccuccccagcgcugggauuccagguguauacccucucagccagguagaugugcugcugggcuuaugugguaccgaggaucaaaccuagggcugugugcccagcaggaucucugccagcugaacugcaucccugacccccacaacuccuuuuaagucccagcuugcuaaggagcaagccuggcuaacacccacagagugcuccaaggcuugguaacuuguucccauguaccugacucaagcaccuucaaaagccugguuucccacaugauuuccuaagaaacccucuggaagaggucucugggguuucauuuucucuuuugccaccccuaggucaaaguguuuucacucaugacuuugcaguguggcccaggucuuuagagauugucuggaacuaacacggaagacagccaguggagacacugccuauccccaaaugucccgaggaagccugaguacuucagaaaauacaugcucucuucuuccuccgacuguguguguuuugagacagggucucacuguacauauaacccagcgguauauaugcucucuuaaaaagagaaacagauauuuucuauucaauacuacaauaugagacuguguuuagaaccagcaauggcagugcacaccuuuagucccgacacucagaggcaaaggcagguggucuacacagcaaguuccaggacagcacaagacuucaaagagaaacccugucucaaaaaaccagggggcggggaugguggugguagugagugaugaagggagggagggggguugauugauugauugauugauugaugauuggaaccgagccucaaugaagguggaagaguuaguggcauuucaccaucuuugcaccaugguuuccuuuuuaaucauaggacauguauuuaacccacuggccaagccuucacugagagacaaccuauucaaucuugaauaguguucuuuccaaacaguuugguaagcugcuugcuucaugcacugugaaaguacaaacacaguccccuaugaugcuuguccugacuuaccauuuggguaaacugaggcaugcaauggugccccgacggucuuucucccuuucuccuucuucccugcuuuguaggaaaacaaccacuucccuacuccaaccccgcaggcucucaggaagagggcuacaacauuguaaaucucccuucccauccucuaccugccccaggccaucgccagaguaggaaaauauagagccggaagcccacaagcccaccaccaaccacaccaugcuuagauggcagcccguaucacuggagucugcguaggguggguugacaccaggaagaaaccugcugguggaaccaaaaaagggagcuggcagauagauauacagcagcacuggccagggaaaaaaacaucagccaaucacauggccucucuuccugguaggagagaggccaggagagcccagaccacaaccuugagggcucccagggucagcacaucuguggcuccaggaaaacccgcacugacaguaacaccuaagggugagaagagcacccacugcccaggcuggggugagaaacauuugggugggaaccaggaaggcggggucuagaauccagagcacccacuaagccaaguuccucugaacacucucaucuggggcuguaacuaacccuuaaacgguggccaugagauggucaccuuggccuugaaggacaaagcuuaugaaguucccauggguggaagacaccaggaguuuggucuauuuaauuaccuccuccaacaggcuaggacugucccuuggaaaagggacauacuucugcuuugccacacaccacaucugugacucuauuugaccaguaauguuggggaauggguucauuacacugacuggaaaacaaggccaaggagcaaauccaaggucacgggcuagcaugugagaggcaaaggggaagcuaaaucucaagucugugacuccaaagucugggacacuguaucaggaugacuccauuuaccuuucucugacggugaaaacaguuuucucaaaggaacucccacguagaacagacaaaagcaguuaugcucaauggauagacacacacucagaugaaaacgauaagaaaacccuuagcauucuuucagauauaucccccaccccgaccccaagcucuugguagccccagagccccccuaccaggcuuguaagucauugaccucagcuguuucucaccucccaagacaaagacccuagggggcgcucuccucaucuuuugccauuuugucaauguuuuccugaagccacaggugugccuaccuaggugcaguuuggugcuggacuccuaagaggaugcugcccucugccaauacauguauccauagaaacaugaggggaaguaguguguguguguguguguguguguguguguuugugugucugagugugcgcacucuacucaagcacgcacaugcaugcagagagauuccaauccuaucccgaagccauugugggaacccagguccuccccuaugccugcucugcagcucaugggaaauuucagaacuggcucaguggccuggccgagggcagaggagccuggaugggguaauugguuucucugucuuaaaagguucuucucccucaauacccuauaccuagacucuccaaacuucagacugcacugaggucagagguauccaugccucaggccauggagaaaccaauuaauucucuuucccuucugcacaguuggacccugacgugucagggaaaggagggaugacuaaagccacaaguagccugaggcggccacaaacaagcacuccaguagaacuugccaggcaccuagcccuguacccaucucugcuucuuuauaacguaacuauuuugggucaaauaaaaguuacucuuucugaaggaaagcaccccuuccugauucucuugcuguuagauaucagcgacuucaguucagcaaaaugcucuuggaaaagucacguguaguuuuggguagauacccucaaaggaggagcuacagcgcuguucuuacuucuuccuuuuuuccugauaggcagaauccuaucauggaccauagggcugugagcuaaugagggcagaaucaacacugcuguacucugaaauuccaaaaugagagcaacauaacuugucuuagaugcugucuccacugaaagacuuuuagagugaggaucacauagccacacaggagacgggaggcugcucaacuccuguggcucuccuccugggagucucccuguuccgguugaugcucacuugucuguuucucaaagcucccuggccaacuccugccugccaccuccacccuucuggacucaggucaggaguggaggggacagagcugggacacaagacuaacucacucagcaaguuuuuauugagcaucuacuacaggccagggacuuuucuagaggcuguggcuacaguacuaacaaaaguuucugcccuuaugauacaauguagcccaguguuucuuaacaccucugaauacaguuccucacgcuguggugaccucucaccauaaaauuauuuuuguugcuacuucauaaguauaauuuugcuacuguuaugaauuguaaauaucugauaugcagaaugucugauaugcaaccccugugaaagguugaaaaaugcugaccuagcaggagagggggggggggcgcauuccacaagagagaacaucaagggcaaggaaaugguggcggggggggggggggcguuauagguccuggaaagcucucucaagaaggugacacuugggcaggguguggguccuuuggaagaaugcuagucuagcaugcaugaagccugugcauucaaucuccagcacuguguaaacuguuggucacagugauacacaccuagagguggaggcaggagcauaagacaaucaagccuacacaggagagucccaggccagcuggaguuccgugaaacugucuaaaaaaaaaaacaaaaacaaaaaacgaaagaagcuuugaaguaagaagcgggagucugagcaugcuugaggaaagacgugguaaggugauugaccgacucuaaggcuuuguaccagugccucaaauucccuuucucuggaaugggcagaaauagcggcuacccagugaugagccuguacuccuccagcuucagccgcugugacacuuguggggacgcucucagagagcagcagggccaccuaguuaguuggagucucaaaagccuugcagcucaagcuaaguucuguggguuugagcuucauagcggaagccuccgacgucggcuguauacuuaaagaucacaaaaugccugggccgggucacaguauugccccgacuacccugaccagucaguuucaagguuugaacucacacggccauaggacccugguugucccaaagcccucaggggccugguucuugggaggggguccuccagcaccccaauguggggcugaacgcaagccuagaucagccaguccucacaauucccuacccuuggguugaggcauguagcuuuccggcuaugacaauuggcggacggggugccacccugcacccuggcccuagggaagugcgagguggcugaccugagggggugaggauacgaaggaagagagagggugguggugguauaugcugagaggguagggacagaagaaggaaaggaagaacugguggcccagagaccaccgcagugacuauauugaugggaccaugucucagauuccgggagaugaggguuagaaugucaucaaugaggccacucccccgcuauacacacacauccgcagugagcucuucuuugaccacccuuuuauugcagcuacuggcugaacgcuguggaugccacaggagcucucaggcucgcuggagacacuggcacacacaaucacaacucaggcuacccacuuugugacuguacuuagaaguucugucuggcauugauuggccagauaacaccaagcuuaaguuaccuuaauggcagacaggaagggacagauuugguuaaagguacauuugucaaccuuuacuaaauuccuccaguccccagaagagauauggcaccaaaaauucugaauucacugguacacaggugucuuugccaaguauuugggaacacccagaaagaggcaauauuccaccuccuuggucuacaccucucaucugaaaaauaagugagcucuggcaaguaaguuccagauggcucucaggccuuggacaguuaugcagagaugguauagaaacuacuacccuugggcaauuggauuccguuauuaacauuuuucacuuugagacggggucuccuguagccuaggcugaccuaggauuuaccauucuccuccuggccaccucccaaauaccaggauuacaggugugcagcuaugcucgcucucugugguccuugaacuccauccccgguuccuggauuccacuuugaguaagcagugggcugcuaccuaaaggaacuuuaucucaagcauugccgaacacaagcagcuccuuacaauguugugcuuuugagacagggucuuauguaucucaggcugaccuccaguuuccuaggaaaccaaugacuuucaacuucugauggcccugcaucaaccucccaagugcuuggaugauagauuugugccauuaugcuggguuuauucagugcuaggagcugaacugggaguucaagucuguccccacccccauaauguaucuuuugaguagauuauuuucuugaaaguuuuuuuuuguuuuguuuuuguguuuuguuuuguuuuguuuuguugagacaugaucccacucuguagcuggccugggacucagggauccccucaccucugaaugcuaggauuaaggacaugcuccaccacaugcagcuuugaacauacuuggucuucuguguccaucccagauccgacacuuccuuggaccugccacagccucacaagcggaugagacacacgacagaaagacucgucccacaauguuucugggaauagacugugacaggaaaccauaccaacugaauuccuuccuugcccugccucagacacucugggcacaaagaagaacagaggccagagcugaaaguccuccggacccuaggucugcugggucuccaagucagcucaggcuuggcuccagcuguggagagcagcacuggcuggagcagagaccgguucccaguacacaacuggaaagggaguccacuaggcggacgucgaugcggggauucccuuucaggucugcauccaaggaucacgugcucagcacaagaucccgguucucuaaaggaucuacguguggacaggcacagcaggcuauggagcccaggcucaagacacaacccauucagcagccuccuccccaggggccucuaaccccauggucccucccccucagcuuccaaagguaggucuccucugugaggauggagaggccccaggaagaggcugacuggcaggcucucuucaccugagucuaacauuccacacuucucagcguaaucuccugaggacuuuaaacugcuggucccggccccucccugggaggccacacccuaccugaaaccucugugccuuuugcagucaggcuaccucuguugaugcauaccucagagugaauccugucagaaaaccccugcccccucccuacuuguggaaccuucccuucaggcaaguggcuggcucccuccccuauagaauuccucacagagcccaccacaaccccccuagagugacucccauccccaagccugcuuuuccccuacaccuuacaauucaucugagcuuagugacccuaggaacagcucucccacccccugcagauccucuuuuauuuuaaaaucuccauacgaaaacacuccuggaagcucuucacugggcucauuaagacagccgcccccagccucugggaagcaagucacucguccacgaccaccaacagcagcagaaucccgauguucaggaugucucaagccuaucaagugcccaauacacccauucaauucacggcaguaccacgcagcugcugacauccgugcuuuggcuacaauguuaaaucuguuacccuuaccauuguucaucagaugaaagacaaccuaugaagcagguuugugaucacuucaguaggaagccuaggcuugaaaaguccacagacaugcaaguguggggcccagucagagaguuuccaccaugccaacccaccugucuccugcccagguuucaucccucaaaaggcuaucauccagagaggccuaaaucagucucucuuuucaacagccaaggaacauggaagucaagacauccacaacagugaaaacagaggucccucuguuccuccacccuacuuuacagaaaggaaaguggagagcaaaggucugacuugcccuguggcaaaggaaaagcccaggaaggaccccaggauauaaaggcuguuuaccuccagggugagcucaaaccaccagcuuaggaggaaagcaggagaccuguugggauaaucccuuuguuacagagacuugcacuggaagccuacaguuuugcaucucaucauagaauuccaccaguugagguggugcugggggguggggguggggguggggguggggagauauggcugaugacaggccuagaggaggguguaaaaccaccacaacccaaacccagguuugcccccuaagccuuuuuugaccuggauacaauucaccaucaucaucgucaucauaaucaauuugcuguccucgucaucaguguaaccauuccuccucgccaccaaacacugucaaagaacgucucuauauugccacauacugugaaaaugacauuucaggauuucgguauccagggcucaguggugcuaagagacuugcuguuuggaacaaggccagguuucuggacacauuuguucgagcauauugaucucugacuaugagcugucccugugguagagucuggacagggccccucagcaggcaucauuccuaggcaguugucaggugccagacaagaaacccaaccuugccggggcgugguggugcacgccuuuaaucccagcacucaggaggcagaggcaggcggauuucugaguuugaggccacccuggucuacaaagugaguuccaggacagccaagacuauacagagaaacccuaucucaaaaaggccaaaaaaaaaaaaaaaaaaaaaaaaaaaaaagaagaagaagaagaagaagaagcccaaccuugauguccagggacccgguugggagcaguucacugauggcuuccagggaucucccuuuagccuguaucuucuccaagcuuggcuucuauaagauuggaaucacuguggacuaacuagcucaucuggcuuuugaaugguacuaggggcucccccuccaaaagacugcaugugaagaccaugaaguugccagggcacucuacagacuugucgguccuuguuagacuguggcccuccaagcucuucccaucuuccucgaacugcaccccuccucaaggagcacaggcccuucccccaaugggaguacucuucccuuccaggucccguuggagucccaggccacccuccggagguuuaaaccuccauucccugaggaccagcccucgccacccuaccaucucaucucucauuguucugcagaauccuguucccccaacacuaacucccacagcagcagagucccuuccccgcuugggcggucaccacuguacuuccgacucuggaaagccucccuucgcuacuuucucccugcagcuaccugcucaagauaggcuacuccguuuaugaaaccugccucucucuccugggcugagucucucagcuguuuggcagggacuuugggacaccugcucugguuauguuugcagacacugccugaccucucaaacagaaaguaacauuccaccuucagaaagaagguagugggaucgucuccaagcugggucugaugggagaugggugcccgagguauuacuaagacacaacucaaaccucauuugugaaagaaauuucuuguuuacacaaaggggugggaggggcccaccauccuggccaugcucugagaaagaauccgguccuuuggcaacaugaaggcaaggaccccacugaaccaggcucugggacccuggaaggagcgcuuauuccacccgucccgggacaagcuuaagaaaaagcgcuugcacaagaaguacgcuacacgcgugggcauuuagggauuugaggucaguuucaggggcuccuucuuguggucccugcccgcggcuuugcuuaguuucaacgaccucccaauacgguccccuaguagccccaaacacgagaaagagaaaucgcauucugguggucaugcgggaaucugggaccuccccacaacccaaaguuucccccccaucuccagcgaacccaccaagugcccccuuuacaaucucacaaccuccggcucacucuacaccagugaagacuaggaauaaauccacgaucuggccccgcaccugcgggguucuccaauuuggagggggcguggauggugccaaggucaggacucugcgugcggccacgcgggagaggcugcaagcgguccgaccacgcggugcagccggcuucccaggagccccaccaggcuuggggcggaggggaaugaccaggggucccggcagagccgcggcuguccacucaccauuaugggagugagaugcaggcgacaguagcagcagcagcagcgcggagagcgccguagugggaggcaugguugugcucgcccggggacuccgagcagguggcugcggcgcuggcgcagggucgcgcguccggacagcgggagcgucggcgccgcuccgggaggccuggcgacggccgcgaacuccggagucgcgauccggccgcuccuccugccuaccgcagagcugggcugggacacggagccagcagcgacgagcgaaggugucugcggcccgggcggugucugcgccgcugcggccccgcgcacguugcugcgaagacucccgccccgucccguccgcgcuggccuccgcccccucccccaggagcucgcccacagcggcggcggggucgggcggggcg

SEQ ID NO: 2893 - RNA, 3914 nt, Mus musculus
ugggaggggguaggcgugaggguuggggugggagagguugucacagaggacaucuaugucucucagucucagcugugagucugcagucaucacgcccacugcagaagaggcuuccuuguccuucacagucgggacaugggucauggauccccacauacuuucuggggacacacagacccacggacaucagcacagaccucagcuguagcacaaauuacagacgccaucgugguccucugcggcagcacaggucacagguaucaacauggccuuuaguggcagcauggggcauagacaccaacauggucuccagugguagcacagccuaugggcaucagcauggcccuuggcauggaccacggacacuaucauggauucagguggcagcacauuuauacagaucuguauaaauauuuuccucucugggcauuaagaagcaauccagaggaagaacaagucagacacuugucuccucuuccaugaucugugggacaguaaaccaugccaggaagcuugguggguagagcggguugagaccccggaaacucacaccugagauagaaggugccucccugcucccugcuagauaccuggucuggaagaccugccacacuucccacauaaggaaaugugaccuguggugacguucaccuagaacagaguucuccaugcuaaagaaguaccuagaggcacugagaguuuagccaauaagcuccccuucccagacauuccucccugcaaaugguauuuaaucucggguucauccacccugagaagaagauaugaauauuuuccaggaugaacaaucaauaaauaguuuggaaccuaggacugucucuuucaucuaccaccgucauggggagcacggagcaggucuucgccuacagagccacacagccuaagucucccauaggagggcccucugggcccucagacaacugcugcuaccuucgccaaugagcaaagcuggagcgcccagccccaggccuggucgacaugccauucucagccugucagcccccagugguuuuagccuugcuguggcccguggaccccugacaccuuguucccgacuccucugugugguucucuagcagcgacuagaugcucagaaguuagggaacaccagcuucggcuugcucacaucucggacuguuuucccacccccagagcggugucucugugcuucccugaagcccagcaccuaccaggcagcagcgugggugggauaagcguagucaagcucccugcguuucucuucccaagcggccgugcccugccacggggugggaugcggacccacaaugguccaggaaagaggaugcauuuuguuauugcacguggcugacucagacacagggaggagagaugggucuguucgauugguuuagucuugccacagucuagggagggacucuagaggaagaagacccguuguagcuaaagcagugcaggagaaaaucagaccacaucaaauggcauggaaggcugaagaagcuguccaggacagaaucugccucugagagaaagaaacggaagagggugaguuuuuuagugaaagaggugaucuagguuauggugggcuuggggcagcagccacauuucaucaaaauaccucuguccucuucuguuggucacauguggggaauccacaggagugcacgugacacagcagugacuggagcuccagccuugcagcagggucuguccugaggaaccuugggccugauuugcagcuacgcugggagggaccucccuucucugagagacuguugcuuucucaggucucugcaacacaauuucccaucuucuacagagucacaggucagcaucgaacauagccucuuucagaccacaggaucccuucaccaggugacaagugggguccaggaagaccggacaaggaccaggucuuguauuguagguguucuagggccuguuagaaacacaaaguaacaugugucaaagcccuaggacuccuucagagucuggcuauguaauguuuucuggggggaggugugggugaaggggacaaucuuugaucuuccauuuucaguugugcaauggaaaggccccacccugucccaccccacccugcccugccuucagggcucuuuuugcaaggugugaugccagugacugugaauacacugugcccuguguagcauggugcagacguggagagugucauauucuuucuucugguaaaguaggaccccucuuucucccccuugaaucuccucugcugccugucuccuuguuuuugugagaugucaucucucuuagggacagucagucccaugguuucaggugaagccaccaagccuguguaucuauuccccauugaaaggugaacggaggaaggggacagugcccuucuagccugguccauuuucucuuugggacuagcuuagacgauucucgagaguaccagcagggggcaguggcaccucacaucucagucuccugccuaugcuugcaggucauagcgcugggauggggcaggaaagccaccucauugagcagugugugugguguucaccaggcagaucgagaaugucuuaaugaccugugcaccuugcaauggauugcccaagagcccgguguggcagcaccaugccagcagucaggccuaggcauaggcaccgauuugcuucaggaguagaggaugaagggaaacuguucuggagagcacuaagugauggggaggcucucaaugcugcccauggggcagcuggugucccacugagacccgcucuagagacaguggccacagaugaggcucaguugagcccaaagggagccaucugccuggguccucuacaauuuacuucugagagcagauggugacaagaggcaggccuugagggaaggcccaagcgggacacaccagcaggaccaucggcuucccuaccagugucucuucuuggccuuccuacuccacucaaagucugcuuccagcuccagccccuggccccagauccuagaagccuuaucuuaugcccuccucaaacuccaccuguggacuucucugugcccaaggugugacuacaggagcuacugaauuaaacuuacuacagcaucagguccuggugacuguucuucuaauuuagcaccuggggcccgugcaggaugaugcuccaggaggguguaugcugacccaagagggcuugguccaggguuauggggacuaacaacugaugaagguuaggcuucuccucuuuggcuuaaagaagcuuuuaaggagccuuaaaggguguguguguguguguguguguguguguguguguguguguguuugaucguauuguucuuugccaucagaaauuauagcuagcccuguccugagcuuugcaagucucaacagcuccucaaagguggauagcacagucuucccaggauuccccucccuaagcggcaaggacugaacauaauguuuacucagaucugagacacgcaccaggccucgggauauucugggcugaggcugcaggcugcaggcuguuuuguucucuuuacucuuaucuuccuacugccucgugccaccacaauugcuaaagcauuuacucagcagcauccggccacgcaguccuuagcugaacccgcgugcacauaucucuuuaaaguuuuuaccaugugcuaacacccuuccuccucucguggauugcugucauauucuaggccccacgaauagucaagcuuuaccguuaugaugagauccagauguggcuccagauguggggcuaggcagaggguuagaggagggugggagcagaugacaggggaacagcaccgggagcaggcuggguguauugcaaggcagauauggggaugagcgugggucagaacaaggcaggagguagcacagacugcagggaguggagagagcgaccggugggccagaccagggagag

SEQ ID NO: 2894 - RNA, 3914 nt, Mus musculus
cucucccuggucuggcccaccggucgcucucuccacucccugcagucugugcuaccuccugccuuguucugacccacgcucauccccauaucugccuugcaauacacccagccugcucccggugcuguuccccugucaucugcucccacccuccucuaacccucugccuagccccacaucuggagccacaucuggaucucaucauaacgguaaagcuugacuauucguggggccuagaauaugacagcaauccacgagaggaggaaggguguuagcacaugguaaaaacuuuaaagagauaugugcacgcggguucagcuaaggacugcguggccggaugcugcugaguaaaugcuuuagcaauugugguggcacgaggcaguaggaagauaagaguaaagagaacaaaacagccugcagccugcagccucagcccagaauaucccgaggccuggugcgugucucagaucugaguaaacauuauguucaguccuugccgcuuagggaggggaauccugggaagacugugcuauccaccuuugaggagcuguugagacuugcaaagcucaggacagggcuagcuauaauuucugauggcaaagaacaauacgaucaaacacacacacacacacacacacacacacacacacacacacacccuuuaaggcuccuuaaaagcuucuuuaagccaaagaggagaagccuaaccuucaucaguuguuaguccccauaacccuggaccaagcccucuugggucagcauacacccuccuggagcaucauccugcacgggccccaggugcuaaauuagaagaacagucaccaggaccugaugcuguaguaaguuuaauucaguagcuccuguagucacaccuugggcacagagaaguccacagguggaguuugaggagggcauaagauaaggcuucuaggaucuggggccaggggcuggagcuggaagcagacuuugaguggaguaggaaggccaagaagagacacugguagggaagccgaugguccugcuggugugucccgcuugggccuucccucaaggccugccucuugucaccaucugcucucagaaguaaauuguagaggacccaggcagauggcucccuuugggcucaacugagccucaucuguggccacugucucuagagcgggucucagugggacaccagcugccccaugggcagcauugagagccuccccaucacuuagugcucuccagaacaguuucccuucauccucuacuccugaagcaaaucggugccuaugccuaggccugacugcuggcauggugcugccacaccgggcucuugggcaauccauugcaaggugcacaggucauuaagacauucucgaucugccuggugaacaccacacacacugcucaaugagguggcuuuccugccccaucccagcgcuaugaccugcaagcauaggcaggagacugagaugugaggugccacugcccccugcugguacucucgagaaucgucuaagcuagucccaaagagaaaauggaccaggcuagaagggcacuguccccuuccuccguucaccuuucaauggggaauagauacacaggcuugguggcuucaccugaaaccaugggacugacugucccuaagagagaugacaucucacaaaaacaaggagacaggcagcagaggagauucaagggggagaaagagggguccuacuuuaccagaagaaagaauaugacacucuccacgucugcaccaugcuacacagggcacaguguauucacagucacuggcaucacaccuugcaaaaagagcccugaaggcagggcaggguggggugggacaggguggggccuuuccauugcacaacugaaaauggaagaucaaagauuguccccuucacccacaccuccccccagaaaacauuacauagccagacucugaaggaguccuagggcuuugacacauguuacuuuguguuucuaacaggcccuagaacaccuacaauacaagaccugguccuuguccggucuuccuggaccccacuugucaccuggugaagggauccuguggucugaaagaggcuauguucgaugcugaccugugacucuguagaagaugggaaauuguguugcagagaccugagaaagcaacagucucucagagaagggaggucccucccagcguagcugcaaaucaggcccaagguuccucaggacagacccugcugcaaggcuggagcuccagucacugcugugucacgugcacuccuguggauuccccacaugugaccaacagaagaggacagagguauuuugaugaaauguggcugcugccccaagcccaccauaaccuagaucaccucuuucacuaaaaaacucacccucuuccguuucuuucucucagaggcagauucuguccuggacagcuucuucagccuuccaugccauuugauguggucugauuuucuccugcacugcuuuagcuacaacgggucuucuuccucuagagucccucccuagacuguggcaagacuaaaccaaucgaacagacccaucucuccucccugugucugagucagccacgugcaauaacaaaaugcauccucuuuccuggaccauuguggguccgcaucccaccccguggcagggcacggccgcuugggaagagaaacgcagggagcuugacuacgcuuaucccacccacgcugcugccugguaggugcugggcuucagggaagcacagagacaccgcucugggggugggaaaacaguccgagaugugagcaagccgaagcugguguucccuaacuucugagcaucuagucgcugcuagagaaccacacagaggagucgggaacaaggugucagggguccacgggccacagcaaggcuaaaaccacugggggcugacaggcugagaauggcaugucgaccaggccuggggcugggcgcuccagcuuugcucauuggcgaagguagcagcaguugucugagggcccagagggcccuccuaugggagacuuaggcuguguggcucuguaggcgaagaccugcuccgugcuccccaugacggugguagaugaaagagacaguccuagguuccaaacuauuuauugauuguucauccuggaaaauauucauaucuucuucucaggguggaugaacccgagauuaaauaccauuugcagggaggaaugucugggaaggggagcuuauuggcuaaacucucagugccucuagguacuucuuuagcauggagaacucuguucuaggugaacgucaccacaggucacauuuccuuaugugggaaguguggcaggucuuccagaccagguaucuagcagggagcagggaggcaccuucuaucucaggugugaguuuccggggucucaacccgcucuacccaccaagcuuccuggcaugguuuacugucccacagaucauggaagaggagacaagugucugacuuguucuuccucuggauugcuucuuaaugcccagagaggaaaauauuuauacagaucuguauaaaugugcugccaccugaauccaugauaguguccgugguccaugccaagggccaugcugaugcccauaggcugugcuaccacuggagaccauguuggugucuaugccccaugcugccacuaaaggccauguugauaccugugaccugugcugccgcagaggaccacgauggcgucuguaauuugugcuacagcugaggucugugcugauguccgugggucuguguguccccagaaaguauguggggauccaugacccaugucccgacugugaaggacaaggaagccucuucugcagugggcgugaugacugcagacucacagcugagacugagagacauagauguccucugugacaaccucucccaccccaacccucacgccuacccccuccca

SEQ ID NO: 2895 - RNA, 8678 nt, Mus musculus
caguuggcugauggugacucuaagcacauagagauuucuccccacccugagccugccacucaccgcugaaguacagacccuccuuuacagcuagaggaugggcuccucuuuccucucuggaaaccaggcaagaaaauugacaacaaauucccucaguuuacccuguagaguucuuaacccuccuugcuuggggugucaugccccgaccuuuuaaggaaacucaucuugaccuggaaguugggaugagauacgucagacuauaagcaucucugucuguugacacaaaagaguagaagcaggaccaacagacacaaaccaauagaagcagggaucacaucugaccucaggaugaggguuucugcuacucuaaauccuugggcacaggaugcugaucucuuuaaaucaaauggauacauaugcuauguucuuacucuauaaaaugggaaugggaagugaagaaugacggucacaaagagucugugaugguccacugguuggagcuaggaaagauuucuugcuaagaaccucauucccgcagccaaggcaaccagagaagcugacaaacguggcuagauuccaggacacugugugccuuggaugcagggugagcuggggaccagccaucucacuauagaaaacaguugaguuugcaauaagcuuuggacaucagguccccagaaauggcaaugagcuuuugugcaguuauuaugcuacaaggaacucuugccauugguuaccucaaguggggagcuaugguaggugggguuaagaagagacuugggcaaauauuuggccaaaguccaggucagcugcagagagacacugugaacucacaacaccugugcaguaugcccagcgguagggagaugguuuuguuuuugcacuagguugcacagggcauuguuuguagcauuaguauuguagaacauugccuguguagggcuggaguaagaaaacaaagcacagaaaacaaaaacaaaaagccugacugccugguguuguagcuugcccaguuagacgaggacaaaggaauaauagcucaucacccucacuccuacugucuguaucacuucuguccaacuguauagguggggaccgacucaccuggagagauguugaaguagaacuaugaaaaccaaacccaaagcaacuuccaggagacuccaaaguaagccaagcaugagugaugugaguggucggucagguuuacuuauggcuguggagccaggaagcuuaauuugagguuagugaacgaacagccaagucaccauauuugaguggucccaagaguaaccugagaagagaagcccacccuucaucuugcuucaccuccuggcuccuuugucaccugacacuucgcuuccucauugcugaacucucuggaaggaccauggauacugacaugagacgagcauacacuguuauucauucacguguccaugccuccuggcaagggugcguugaccuucaggagcuuuccacugagguacuuccuguuuccuuuccuuacuuuauccucaacuucccuuguccccuccagccugggcccucacaucaaaacgaguaacguaaaaugcauugagauaucuuucucuuugacuuccucugggcaagaggcucuagaaaaucaugagaaacaaucucccagacuuugaagacaaggcuuuggguccuggcucugaauggccacacaagugucucuaaguuucuguuuccuuguucauaaaguagagggguaagccaacagacgucucaggguuauugugggauaacuguaguagcaugaagcaugaguuaguauaaucugugacacauagcacgugccaugagaaagcggagugagaugcuaagcagacuugaauccccuccaguguggcacaguuagccucagcagcaaggaaauggaagcagaauaaaccauccuuggugccauggaaagaacaccagccccccauccaugucccucuccucugcccgccaugagcaaauggcuaguaacccacaguggcagcuucaggacagaugccuuuguguggaggagccagauuugguggccagggacuuggucccauggggcagcacaauugaauuuuuccuuuccaucugacaguucaggacuggauguuucuuuccaaaugaaggcaguucuggaaggucguugggaacagcggauugugauuaugcuggcacauuuuuaauucugucucauuacagcugcuguuaaggcugcauuauaauaauugcuuuaguucugcuuugguauuuucaggcuccuuuaauguagcuguaaucuauguguauauuaaaguaagcagagccaaagagcaggagcagccuuguuagaccagagaaaugaauguuuaggaggugggauggggagcaggcaggcuggagaaccucaggacaacagugggaguggagggucuggccccaagccugacgcacauucaugcugugacuuugagccgguccaagcugcccgugucaguucucccauccauuagauaaauuucaaaggaugucuuguaaaggucugaggaaaaagcccaaagcuggcaagcagccuggagcaugucagcauugggcccucugguguagcaagagcagaaccccaggaagagccugccccuuccuuuccaacagccuccagaaggauggucauaugaucucugggccaaggacagaagucacaugaguggcaagaccacccuaccccauuuccagggacaauuuugcuuggaucaccuucacuucccuuuuuuuguucauuuguuuauuugguguauuuuagcaguugccauucugaaggaauagccuugacccaagcauguuacccacuugacgguggccuugaucauuggggccucuuguuuuuaucccucuuuugugguuuggauguaaaaugucucccaagggcucauguguuugaagacuugggucccugcuggugaugcugucuuaggugauggugggaacuuuaagagguggagccgugcuggaggagguagauucaucacugugugcuaggucuugagguuaauggcugggcuuccuauuggguggagaugagaaucccuagcuccacuuucccaccaugauguagcugucuacugcuguccuaccuucucagccgugagagacugaauccucucuaaacuggguaccaaaauaaacccuuccuccuuuagggaggugucugucagaugcugagucacagugguaagaaagguaaccuaggcaaccccacaagaggacaaugaaugucagcuuggagggcacaguguccaguggcauuuggaacucugcuccucaaaaaacacuaugugccauagugucuuccaggcacuuacuuggcaugugacuuucuuccuaugagucccaugaacaaagcaucagucaucaguuuagauaagcaaaugaaacuaaggucaugccuaacuagugagggcuacauauuugcccacaucauaaagaacaguguauaaaggauugguacacugguucucagcacugucuccuguucccagcacccuaaguguuccaauccuccauuccauuuuggaguucaggucuggaauucaagcuugucaaugagaaugacuguugaaguugacacacagguuuacauuuuauauccaaaccacaagaaagggauaaaaaggagaggacacaaugaccaaagaauaaauaggccuccaucaagugaacaacaugccuaggucaagacugucccuucagaauggcaacugcucaauuacauaaaaaaaaaauguuguuguuggagugacccacaguucagugaacacaggacuguguagccuaggaaggggacccaauaggggugugacuaagcauacucuuagagcagcggaaccagguuguuaggcucuggguucucucccaauacugccuuuaccuuacaaaggacacugucaaggaagugagagucauggaaagucuuugcagggccuauucaccucuaccuccuucaccuuguauuugggucaggcaguacucaguuacucaugcaagauucuuuuuuuuuuuuuuuaacauuuuuuguuuauuuuuauuuuuuaugaguauuguuuuauuagauauuuucuuuauauacauuucaaaugcuauccugaaaguucccuauacucucccccuacccugcuacccuacccacccacucccacuucuuggcccuggcauuccccuggacuggggcauauaaaguuugcaauaccaaggggccucucuucccagugauggccgacuaggccaucuucugcugcaucauaugcagcuagagauaugagcucuggggguacugguuaguucauauuguuguuccaccuauaggguugaagaccccuucagcuccuugagugcuuucucuagcuucuccauugggggcccuguguuccaucuuauagaugacugugagcaucuacuucuguauuugccaggcacuggcauagccucauaagagacagcuauaccaaggucccuucagcaaaaucuugcuggcauaugcaauagugucuggguuugguggcugauuaugggaugcauucccagguuggguagucucuggauaguccauccuuccaucuuagcuccaaacuuugucucuguaacuccuuucauggguauuuugaucccuauucuaaggaggaaugaaguauccacccguuggucuucccucuucuugauuuucuuguuuuuugcaaauuguaucuuggguguucuauguuucuggacuaauauccacuuaucagugagugauaucuaaugacuucuuuugugauuggguuaccucacuaaggaugauauccuccagauacaucccuuugucuaagaauuucauaaauucauuguuuuuaauagcugaguaguacuccauuauguaaauguaccacauuuucuguuuccauucuucuguugagggacaucuggguucuuuccagcuucuggauauuauaaauaagguugcuaugaacauagagauggcucagugguuaagaguacugacugcucuuccaaagguccugaguucaaaucccagcagccacaugguggcucaugcaagauucuuguucauccugcuccauauuuaacuacuuccauauggaggaagagaucuugcaggcuuuuccagugccuugcucaguuacagcucaggaagaucuguaauccuucuucagugcccacaauggaaacauaacccauuguuguuccaaaucuacagaccugggucuucugaauguucaaggaggcugaaggguacugcuucucucagcuucucugaugccuuguagccuuggcucugacucacaguaacagauagcccauuuuaucccugaaggagucaucaucauuuaaaaagucuucauuaucaugcaucaaagucucccuaauuauccuguuuuagacuuugggaauuaaccuacuuugucuuagcuacuuuucuauugcugugacaagaccacaugaccaagacaacuuauagcuuucauuggggauguauaguuucagagggugaauccaugaccauccuaaugaggaacaugguagcuggcagggaggcaggaaggcuugggacuguaguggcagcugaaagcuaaugaggaauagugugggcuuuugaaacuuuaaagcacacucccagcgaugauucuauucaguaaagccacaccuccuaauccuucccaaacaguuguaacaacuagaggccaaaacaugcaaaacaccaccaauaucccuuuuacgcaauaguacuuugugacacagcuagacguucuucugagccucuuggcugcaagauccuuggauuccuuuucucuuauuucuguccaaauguuccuuagagaagaaaaacaaaggcuuccagccuaaaugaugccuauagauagcuuuuucuuuuucccauacagcauuauagucaaaauuuaggggugacugccaguaccaacuaggcugagacuuggagaacacagcuauggcuugguuuuugccuuggugaacugucaguaacauccacagucaggaaguagcaaugguagauauacuaucuuccucuuuuuucuuaaauuaguaucauaaguacauucacauuucagaacaaaugcuguccugcuucgaccaucagagcugugggacucacagcccauggacuuagcgcaacaucaauccacuccauccacaucuccuuucucacuguguuccaucucucuccuucaucuuccuccaucaaacuauacgguuuacuccuccuauccugcuuucucccaagaacagggcaucccccuuaaacgaggcccuuaauuaguuaauaaaauucccuccaugacacaggcugcucucccccagaaaaccagugacagauaugagcaccauuuggucuaauuaguucugauauuucacacaacauauuugugagggguuuuuuuggaggugggggugaggcagggaaaaugcuucuauuaaaagaacagcagggaagcuuggaucccgggagaggaagaguuggggucuuuuguuaguguagagagccuuugugaacacuugcccucuguuucuccuugcaccucccugcauuaauuggccuguccagggcugagauucacaccucuccuuauuccaaugacaugacauccugauugagggaucuuuucuauuuugguggcagagaucuauacaggaugaugagguaaccccagagguggcuuagcuaugaaguccuagagagcuggggcacaguguucugggaccuggcugugucuuacacuuugacauuggagugauuauuggauucuucaaggccacuuggcggucuaagggcuaugugucagggcagagaaagggagaugggguacgggcacaccuugagcuguuaggauagaugucucuagagauacagaguauugacuauuaugaaguguguaaauuaggaguugcucuugacauagaaaaucaaucgucucuuccucugucacaguugccaucgucuguuuauaaccuacaaguuuuaagagcuagguuuaccauuccaccaugaugagcugaaugugcccuuugucuucuuccagcauggcuccaauuccacgagccaccuuguaagacugcaacugggaguggacacuggcucuauuuuuuuauggaaucuaauccagagucuaugauggcccagaaaucuugguaaaacuagaaauagagagaaagaaaaaaaaaaaaucaagcuuugugagaguuuauggaggaagcucugggauaggacuuagaacucuugggcuccugauaaaacgaucccuauuucgccuuugggugaugacauccccucucccgaccagcucacucaucuaagaugcuggaguggaaugaacgagcuucacuguagcucuaauguccauggccaagcaugagggaaaggguuguuuuagucaacuuauuaguguagggaauggguaaagccagcaagaugaaccugcuacccaaguuugugagaucccucagagauuucuacaaauguugaccccuuagucuaccucugugugagugagucccuuagaaaccagugccccaucuuucccugcuucccaacauuguggugauuuggguaccugaauaaccugcucuugucuagguuuaucuugcuuuugacucucucuagcugagcccuaccuguaguggcuaucuauuauagcgaccccuaaacauggugugggugccccuuaugaagcaggaggcucacgaauaaaagucuuccuucaggugggacuucagagugugggcugggaaguuauccuaccuguggguuccaucucagaaucaccagacaauguccuggucuuccucaguguucauuccuccaucuagaaugcugugguaggguuaagaaggaaaauggauucuaaucgucagccccaugccugauuccaguuaaugcucaauguaugguagauauuguuauguugaugauacaugugguaaacuguuauggccccuuccuuucaaucacaaguauugucugccaccuaucccaauauaucgcugugcccuuuuaugagggacuagaaaaaaaaugucauuuaauuaucuuccuccucuaugaauuccaaauucuguuuuuuaaaaaaaggcaagaagucaaacagaggauuuuaaaauuagcuucaugguuggcaaauuagaagaauuagaagaagaagauuacacucaaagaucuucucuuuaaaucuucuccucuaguucaagaucuggagucacucuagaggagcggugaguaagagaaagcaaagagucugcagaaacaagccugcugcagaagagggcgcagagagaagccugcugcagaaguggcugcagagagaugccugcugcagagagaagccuccuggccagagaagccugcuggagaaguggcugcagagagaugccugcugcagaaaugacugcagagaggagaagguugcuguaaaagccacuguagagacaaguguagcaccuuaucagggccaagaagccaccuucucaccugacccuugaacauucuacucucccagugagagagaggugccggagggaugggcaagaagguggcagaaggcuuccuuccagggcuucagcaaaguuuggacuaggaugagguagaaaggcauuaaagguucccacagcuuccugcuaaaaau

SEQ ID NO: 2896 - RNA, 12788 nt, Mus musculus
guucaagggugcaagagauacguuuuaauaaagguuucuacauuccaggaagaggucacacaauaagcauaauaaccgagugcacuguagaguaaggcacagggcaacaggagcugugagagaagaaaggggggcggagaagacaaaugagaacuggcagcuauggaucauggguaauuuucaaaacaaaagcccuggggaaauucaaggugaaagugagauuuuucucaacagaugucuuugguuuguaguucggugcauacugguaggaaguggguaugcagggcaugagggaagccuguuugguaguggguauacuucucaaugccaagaaucagaugagaacgugaggccccaguucaccaccauacaaagcuggccucuccucuccacggauaaagagggagugauggaucaccuuccccaaaugucaaagguccucgggucucaccucagacugaccucucugaugaccuccugcauccuccuccucaucaucaccagaguugaaaaaccagcccucaccaccuuuuguaaaacuacaccagggaacuuccaaaggcuguguuucaacugaaagccacuucuuuggagacaaagccuguguauauauguggguguguuuauguauguguacaaauggaugugugcaugugugguauauguauguguaugauacuguagcaccucauacuagaguugguuucucagaucguccauuaaacuaugucauugacucuggcauucugugcuauuguuuucuuuuuuuucuuucuuuuauuugcuucuauagccugugugacaagaugcugaaaaaaggugaccagggcuauaucaacuagcaccugugguaaucgaaugaacaaacuacacaccuaggauccaauggcuguugaugugucuuccugagagaaucagagcccuauagugcucgucuguccuuguuccuuaccaagugcccucaucaugacuucugccucaaugauaaggccaggcaacagagauagccaaagucaugcacuugaggcuucugaaaggaugagcuaaagccagaguccuucuccuuccuccuuaggugcuuugcugacuaaggguggggugggaacaucuaguuuuuuuaccuagacauagccuagcauccaggcagguauagcuguucaugaugaagcuagaggagaauaugcagggagggaggagagagggaggugcagggguggcccacgucuucugagaugaauggcacuguuugcucauuagggagauuauuucaagcaagacggcagccagaacgcucuagugcaagcaucugccugcuacugggagacgauauuuauuguucaauccuucaauggauguaaauaaacagcccggcccagauaauguuccaauaaacaaacaagcagcugccaggagcucccuggauggcugaccuuuguggaggccacccugcugauguuucaauagcagucugccuggcagcccagagacucacugugccagggauggagauaggugccuugucgacugguggauaggcagagggccagaaggcuggaaggacaagggcuggcugccuagaaagagucugggcuggaaacugacuggcuggagaaggaggguagaguaaccuggucuuccaguguguguguguguguguguguguguguguguguguguguguguguccacuaagccacaauggagggaauggagcaguacaugcucaaugcuguaauaaaggcuccuguaugggccacaacgaggugauguucaauuguuaaguccuagugugaccucuccaguugucaauacugaaguacaucuguguauuugguaguuagcccauuaccaucuaauugccugccugccaccuucuccccaacagauguagcuccuauagccggaagccuccagaaaccugcucccacagcaaguguuuugacugguuggucugauaccacaagcagauguuauauauguugucuagcauccaggguaguaagaguccugccgugcaggaggcaugcccagaguaugggaaggaaagguaggaguaugcccaaaggagccuagcaaaugggaggcuggaucagaaccacggccaugcauaugagcaucucgacuuuccuggccugaaggaggccauaccacaggcugaggcuuacagcuccuggacagcacaugcaugaggacucugaaacacacugggauaugcuacagauggcaguucccugggagauucuaguguauugucauuaaguaaaaucuaugccuaucuuacccccaagaggauagucaccaagauaaauucuuccuucauuaugccucuuacauugauucugucuagcaacuuagagcccauuguuggguugcuagaauguaguuuucauuuacucaacaaugaguuaccaaguaccagccauacccuacaguauaugaggucugcaacagagaugacauccacccuugagacucauaccagcagggcuguuuuccuuaucacaggucuucucuuacugucagcccauggaagacagagcuucauucuguagcucuguccccauuguugauuuuuuuuuuuuuuuuuuuuuagcuuuaaaagcuuagaaucuucuggagguuuucuggucccuucucuggaucaugcauuaaaaaaaaaaaaaaaaaagacuaguggcacacaagugcuuugggaguucucuguacuauuucuccaugcagaaauaugucuuuuccugucucuaagucaguucuacuucuuuggucaaauugccugagaucccauggagacucauuauguuaaaauaccuuuccauguggagccuugucaaaggcuuuuggaaaaacuaaacagcaagcaggcaugugcugaucuagcaauugggagagaccugaguucuagguuagccugacauuggcuucccaaugaacuuugagcaagaaucagaucaguuuccauuucagucgauucaucaauaaagaugagaauaauuauggugacagucaacauuauaaaaauuuuaugaucaucagaugagagacugauccuuaaaaauauguugcaaggucuaaaacaaaaaauauaagggcuuauuauuuggaaaauccacaaccaugucuucauuaacuaugugcauuccuccccaaaaaaacuguaguaaagucacacuuccucuaaccaacaccuggguaauguuuguacaacacagacuccuagaaugaaaauuuaaauuagcaauagggcggaguuaaggguuaggguuuuagguccaguguaaggguucaguauaguguguaaacucauagaaacauggacaggucugggugugauuucauguccacauucacuagacauacaaccuuggacagguuacuuagccacccaugccucauccacaagcaugggcaauauuaauauuggugacagauuugugauaugugaaugccagccacauugccuaguucaugaagaauacuucuuauuugucuagguagagucuggagaacuggacgcuaguccauucaauccuaaaauuuaggauuuuauaccaaacagccaauucuauaauaaacuuuugcuuauaucuuaugucugguucucucaguaaguagauacaugagucuguuucuuucuguaguauauaaagcuguggucuggauugagguagaaggagaagagauacauucccaguugcucucccacuccagcagaauagggagaguaagaaauaaaauaggccaggucuaugaaaguuugccccauugguaucuacaggaucuuuacuucuuucauaugaugucuaucacaucuaguaugucacucuauccuagggagcaaggaguuagacguagguaauaaggaaugcugcuaaaucacuaaaucuaacuucuaauggggaucagaucaagggcaugggauggagcuuaguacuaccagcuuuccuuaugggagccugugcuuuucagaagcccaagagagucagaaaucagccagggugcucaguaucacucucugcucccauucuguggauccucccagcuggagaugaagccugguugggccacuggccacaaacaucacuccauugccagacugguuuugcaugaauuucugcuucccacugguggcucagcagugaaugcaaaaauggggcucuaggacauugagguguuuccacugcagggggagcaucacucugcagagccucugcuggcuuuccuguuauuuguuuucaugagcauaaugggaaaucagcaaagagaauccuucauuucauuucuuuguucauuugaaaaaauaaaugccugucucgaaaaccaaaaauagauagauagauagauagauagauagauagauagauagauagauagauagauagauagauaguggucaaacaaucaaacgaccacaaaaucagcuagcauccaaguucagggaacucaucagaaacaagagagucugccgaucugaugcauuauuugucaccaguuuuguugucacuuucuaucauuuaguuccucugaauaacucuuuuauucuccuugaucucuuaagagguugaaauuuauaagguaaaaauuaaaaagguuacauaauggacaaacucagaauguaauguguucucuaguuuuguuguugaaaucacuaacauuuccccacagauaccuugugaaaccuucuauuagcaguauaccaucaaguccucugaucccagagcucucaccuagcuacauccucaggagugcuugucccaacuugcauagaugguaccauucacauagggcagugcgccugcuggauuugugcacuuaaacuucagauggcucuagagacuugggccagaggccagaggccagaugagcauuguguacaguugggaaguccaaaucuuuucuagguuuauuuucagugauggugugggugggacaucucuucuggugauuuccagauugucuaaauauuucuaggaaggaguuggggguggcccagggauuaucauuagauaauaaaauauccuugaaagguugaggauggcucauaucugaggcacaauuuucugugauuuccuucaguugagccaugaauagaacuucccaagcugucucaggacugaucaucuauucuaaacccugaaguguaagcugcuggcuuuuaugaaccaaaggagaucagagaugugcagcuucugggauugacuccucucccaaaacagagcagugauaucuugguagaauuaucagugacuaagcucauauccauauaucaaaaacauuucugcuaauaaauguuagcccuucucaugcagguugauccucugaucugaagcugccucaguuacccaaccuagacccuucaucgugauaccagccccauacucaccucuaaaggccagcacagccucagcgaacugauccuagggcauagaaaaccagacucuuuacaaagcucauauuggucacuccccucccuucucugugaacuuccauuaguagaucgcagcaggcuucugacacuuaagucuuugguuuuggacucuaagcucugcagaaacagagcucucuacuccucuuggcuguagggagugucucuaggcugaagcuggguugugagcaauacaaaaucuaaacucauuguaguagguuggauaagaugucccucauggucucaggcauuugaaugucugauccucauuugguuguguuauuuggggaaucuuagggagugugacucuguuggaggaagcaugucauagaaccuggccuuugaguaugaaauacuucaacuacugcuaaguuuguuuucucugcuucauguuugugguccgaggugugaguccucagccucccacuccugccaccaugucuaccacuugcugccaugcuugucauagauucuuaucccucuggggaccauaagcucagauaagcuguuucuuauauaagaagguuuggcuauuuuuaucacagcaacagaaaaggaacugauauauugaccucaccuuuccccucucucuucucugcagauccggguugaugggcccaagggaaaugcccuccaauaugagacugugcaggugguggacucaggaccaguccuccgggacauggccuuuuccaaggaccacgagcaacucuacaucaugucagaaaggcagguaaggcuguugagcucugcucgacauuugucuugcaacuaaauacuagcccguggcuccauagaaaccuacaggagccagcugcagaaaggugauuugauuuauuuggcucagugugucucccugcacuuauacugccuggggacugggacuguguauguuguagugggaauggaacauuugaaauaugaaaauauccacacgucuaguacaaauucacuggcuucaaaaugaugauguggauaggcucaaagccaacauuuccuacuuugaagaaaaucucaagggcagaaucccaaguucucggucagauuuccccaugcaaaggauaaccacugaucaaaagucacauuucuggucugaagagguuugugugauagcaaagacuugguguaguaaaaaaccucagugaguaucacaaaagagccagguagaugaaggcuugaaaagcauucagugcagagaaaugagaugauacaucaugugcuucaagccuucuugucuaccuccaaauuuguggaaccucuagaagguuauaugaaagccagucugugaacagugagcacacagggaugguugcuggcgaagacuaaaggacuuuguaagguuagguuugguucuggagcuuagucacaugcuaaguaaauuguucauggguccucagugcagacaagugacccauuuauagcaagcaaaugaauauuccccugagcaauuccauauaauuaaagguguuucccauaguccucuaacucauugcccagaguguuacauucuacaauauaucacggaacccccaagugugacuaggcaaugcugcaccucugcccuauuguuucuagggguucauauuggaagcuguccauuuagcucaugaauauagaugccuugguacugagugacagaggcaguagccaugagggacagcucucucuuuuauucaucuucauuucugggccugaacucucuggaggacccugcugacagagucuagauuguucugccggucccaacuccacagagugagggauaugaauuccacauuaugccacccacaggacuugugcauuaugcccuggaagccuacagcagccccgcccuccauaggagcuugaugacaucuucucucagugugggucucuggaucugccagcuucagcaauacagggauucauugugguguccgcuggaaucuaccgugauuugaggauggugcaauguuuugcucugggguuggauacaacugacauggaaugaacagcuggugaugaauccaucuuccugucugcauuuuuuucuuuucuuaaugugauuccccauucuuuacucuuugccuaacucuauggccauaggagauggggagaagaauggcuuucuuagauggaauugaaauuuuuaagaaagcccaacaugaauuacaacaucgaacauauuucaacaugccuugccugaucugaaaccuggacuuucuaaaccuagcacuuaaaacacgaaaggaguuuaaaagaugugacagcuaaaugccuagugugagugaucaguccucucuggcaacucugagggugagcaucccucugccuuugaagaacccagcuggcgacuuacuugucucuguguucuaaaggugcuccaguugucucuagugugcucucuccccacucugauuugguaagguguuaugcugggaacuugauuaugacauauuggacaggaaaggaagacaggagugaagaccaguugcccauccauuuuggaauugcccuucacggggacggaacaugaaauccagaggucucauugccuaugucaacacugguauccaguggguuccuggauucuuuguguagcacauuaguuaagggcacaggccuuggcaccacaauaucugaguguauuaguuacuaguaacuaauaugaccauaucccugacaggaauagcuuaaaggagauuuuuuaaacucaugguucaagggauauaguccaucacggaaaagaagacuaguguaguucaguucauugcaauuggagcuuagaguggcuuauuuauagugggguaucaaacaagaaaaacagagcacaggcuagaugugggguuagguuauaauccugaaaaaccuucucccagucauuuuuuuccccacuagcuuggccucauguuccaaagagcucagaaccucucacaccagcaccaucaucugagggccaaguguucaaacacaugagccugugggagguauuucacacacaaacuguaaugcugugaauuaacccuuacgcuucuauuugcuaaauguaguaucaaguaaguucuggaguucauaaaagaucagcauccucuacuaucuaacagccagagcuccaaacaaaaagcaacaugacauauauagcaagcguagccaugagauuaaucccuggauuucaaggcagaccuacccugucugacuagugucccuagacacuuugaguuccaucuucugauuuucuuucucucaaaugugauuaaaacacugagcaaaaaagacuuugagggcuggugagauggcucagugguuaagagcacccgacugcuccuccgaagguccggaguucaaaucccagcaaccacaugguggcucacaaccauccguaacgagaucugacucccucuucugaagugucugaagacagcuacaguguacuuacauauaauaaauaaauaaauuaaaaaaaaaaagacuuugaggaggaaaagguuccucucaguuuacaggucacaguccaccauugauggaagccaaggcagaaguucaagguaugaagugaggcagagauacuggagaaaugcucuuacugauuugcucucuauuguuugcucagcugguuuucuuaggcaucacagaaccuccugaugauggcuggcacugcccacagugggcuccauccauguacaccaaucauuaagaucaacaacaaaaaccucagagaugcaaccauaggucaagcuaauggaggcagucccucuauuggguucccucuuccaggugacucuacuuugugucaaguugacaaauaauuagcacacucccagucuuggcuuugucaucuguaaccuaagcaugacaaugaugagcagcuucacuugagagcuugaauaacccaagaguaacauguacuagucuucagauuacuauuuuuuccuauaaagagaauaaagaccgaaauauuccagaaguaugugaauuaauaaugugaaauaccaaggaguuaguucugagaucugcagccuuuucccagaaguccucaucuaauguguaguugaggauccauggcccauaugggcucuguugcaucauccaacucugcugucuugacauaaagcugccguugauaacauaaaaauaaacagcuguggcagugcacagugcuacuucauucauaaaauguguagcaggcaauaguuuuacaaaacuugagucaguccuucgguggcaacacauugaaagauuccccuagcacugguggagcuaccguguaaagaggcucagaaauucaagaagcaaagacgucaucuaugagcaucauugcuuagaaaaaccaggcugucuuuggauuauuguuucuaaggucccucaaccuccugaacuuccuguuaccucugugguugcugcuucuugaucacuaccuggugccuucucuuuccuuuauccuuuuaguguuauauuaucauuuaaugaugguaggcagucucaugacuucacaucucgucugaugcucucuaaucagccugucuaauauagcuacucacagauauugccauauagguacauuccauacacuuucaacuuaacaugcccaagaccacauuucucauauuccucucuagcauuccucauuuguaguaaucucuaucuuucuuaauagcaaccaaguuauucaagcuaaaaacuuuauagacauccuuaacuucuuuuucaacccaugacucuacauccaacauaucagaaaaauuauugauucuuuaagauacuuauaaaauaugauaauuucccuuaucacugcuaccacucuggaucaagacugauauuuucaauagacuuucuuuauucuuucugugaccaccauuauuuucccaaacuuuucaaggcaaauaacccaaucucuuaagguuuaaguuaaaacaugucauuuuaccagcacugacaaggacccagaaagccugugaaguccuucuacucaugucugaagguuguuuuuuguuuguuugcuuguuuuuuaagaguauuggguaucccaccuugaacuugaauuugcuaugcuaagaugugccacucuucuaguuuuauuccuguugcuguaauaaaucaccuagacuaaaagccacuuaggggaaaagggaguuguuugauuuacaauccuagcuucuaguccaucacaugggaaugucacaguggcaggaacgucaaguugcuagucauaucuagcaagucuagaccagagauauaaaacuaaauacaugcuugcuugauuucuugccaagaucccaauuucugcaugcuuacauaguuuaggaucuuuugaguagagaaugguucuacccacaguggguuaagucuacccaugucacuuaaggaagucaagauuaucucuccaugaacaugcccauaggucaacaugcuguaaacagacccugauugaaaaaucuuucccuaggucagccuagauuuuguuaaguugguaauuaaagcuaaccaucacacccaccauuccuagugauacuuuuuaugcucuauauucuagaauuaucugaacuuaucacccucuaucucacucuucucucauaccaacucugcagaaucagggaagggugaguaaguguuccagacaaagaaaugcuccugaugacaguccuuugcugugccaggcaugcucauaucugggucuuuguucuuaugauccucaugccugaaguugccuccaggcauggaaccccaaggcugacucucuuccaaguguuugcuuccaagagguuccccugagauccucggaaaauuucaaccugcucuccacaagguccaacuacuaccaacuccccaucuuuaucuauuuccaucuaggcuacuuagucucuucuuaugcaugccaugcacaguauuuacuugcaugucuuucuccuuuagaauguaaacacuaggagaauaaaaauguuggcauuucaucauuuaaguucauguaugacugggcaccccagucauaagcucaugcauuugccaaccucuugagaaagccugagaaaguuuccccuuggccauauggugagaggcucagacagaagcauuaauuuugaauguaugcagcaugagaacagaaauguuauuauguuuuaucuuuuuaguucacuuauauaucauagcccucuagaauaauaucagacacauaagaauguaguacauauguguuaaauggguaagaaaauaaacaaguugagcuccuccuggauucuacggccuugagcuucuuguuucaauuauguuacucugacuuguuccccucacuggacccucaaagcugaccacaaaccaccccagggucuacacuuuccaaccuuauuagacaggcagacucacucuuacaccuagggcaauagcaaucugaaucauagcccacuucaggguuaagaaccugugucagagggagcugguaguggagaaugccagccaugauucaccacauuugccgagagagagagagagagagagagagagagagagagagagagagacucuuccacucuucuuuugaagcucuugagauuguggcaggacaguugccuaauggaacuuuugguucuggugcugugucugaugaaaaagcaagaaggaggcauccuggugagcaguggagagagaagagagacucuggaggcugcaagcaagcuagcuaacuucuucuaccacugguguuuuucuguuccucuuggcaaaaaaauccaaguucuagacuugggcccugcucaaagucauccugugauuuucuccugauucccuuugugucggccuccacuguaucgcuaaacuugugcaguuccuuccagaugaaggaccuuggccaucuucucaugcccaguuggucaucuaugcaugccuccuucuuguguugcugacugccuaucuagagaugaucucccauccaaaaccagcauuauggcuucuuccugacuuucuuguuccuuccacugccuaguggccugaacauucccuguuggcuuauuuuuuuuucucagugccuuggcaugggaaucuccagaggacuuugucucucuuguguuuggaacuaggagaauguuuuuccuaaaguaaaggcccuaaaaauuccucuaaauuccugugcaguugcugccaagggcagaaucauaggccuaaauauaagguacaauccuucucuggaggcccuggguacuaaagauuuagaugagcuauuagacacaagcuugggguaagacccagaaaguauugguucugugaguuccuuaccagcucugugaugccacugcugggccuuaagaaauucccacuugggcauguaguaagaggcuacggcaauagggucugccuuggacucauccuugcccauucccaagcuccuuuugugaugcug

SEQ ID NO: 2897 - RNA, 4757 nt, Mus musculus
caagaguacgcaccgagccuagccaaguuccacagggaauaugcugagugcuggugagaacaguccacuaaaacaacgcuauuuuguuaaauaauuuauuuaaagcuagaccuggcuauguaugccuauaauccuaauacuugggagauugaggcagaaggauugaggcagaguucaggaccagcuauacauaacaaauuuugaggcuaccaagggcuacauuguaaccuaucucagaaaaaaaaaagcaaauuggugugaaucaucagacaagauucagcaucuauaaccuagcugauaugacaaaacaaugaaaauguuuuaggaguuacugaaaucaaauucugcuuuaauacuuuugauuuaaaucaaaaugauccugaacacaguaauugauuucuguaucauuccucuggucuauccugaaaaacaacagccuacagcaaucaauauuuuaucuuauuuuuuaaagucauuacauagccauuaugucaacagcaagacuaauuacaucugauaaauuaaauguaccuacuaaaagaaaaugcugagcaaaaccaaucuggaacaguccagcauauaagaguuuuggguucuuucuuucuuucuuucuuuuaauauuuucaauuuuuuucucuguuccuuuuuuguuuguuuguugcuuuuucuuuccuuuuuuaaacacauuuguuuguuuguuuguuuguuuguuuguuuaaugcauaugaguaugcuguagcugacacuccagaagagggcaucagaucucauuacagaugguuaugagcuaccaugugguugcugggaacugaacucaggaccucuggaaaagaagccaaugcucccaaccccugagucaucucucuagcucuugggugauuucuuuauuuagcauuuagauauugauuuguucgacuacacagggaagcuagucucccuagcuccaacacauuggccuaagcuggcaaaaagcaguagaccuuccuuccaccuaugucaggacaccagaagcccaaggccucagagagcuauccuagggguuucgagagagggggcagauaaucuauccuuccaggaaaagaaguauaaaccgagguaaagcccuacaagaagguaugguauaagcaaacuuaauuuccaaggguuccaaagccccaagaaaacaugaggaccugguccugagaaaacagccacgguuacugaccucuaggcccagacacacuaagcuaacuaugguggcuuaaacagauacagucccauagacucauguaguugaaugcuugucacauagggaguggcacuagucagagguucagccuuguuggaggaagugugucacuguaggggcaggcuuugagaucuccuaugaucaagcugcaucuaguauggcucacagucuccugcaaccuucagaucaagauguagaacuuuuagcuccuucuccagcaccaugucugccugcacaucucuacauuuuccaccaucauaauaauagacugaaccucucagacuguaagccagccccauuuaaauguuuuccuuuauaggaguugcugaggucauggucucucuucacagcaguggaaauccuaaugaagacacuaaccuaaaccaaaaucccagcagcaaagcagcuaugaaggaaaaaaaguagaguacaggaggagcugggagcacaacgacccaaaacccaacacccugcuccagccccuuucauacucuggcaagucugggcuuaugauuauuuccuuugcaagccaaaucaauaacuaggagugggagcagacuccccacagcagccuccauucuugccacugccccaagcccacuuucuuaagaugguauucuaagcaccucuuucaacagggaguccuugcacagcugagaccugaaacugaagaaugugaguaucaucccaagcaugggcaagauccucacauccauucccaccagacccaacccaaaggaaaggccccucuccuccuugacucucacuagcacaucgaccuacacaucaggcuucacuuuucuggcuuguuucagcccauuuacucuauaaacugcuacugaacagcuggcagugcaguccuguagcugcgagaacagaaguugagcagugaauaaauagucucugcucucaaaggcuuuuaaccacacaguggguaaaagagacaagcacauauauaccuacauuacaaugaaauauaucugacaaggauaaaucaaauuuaugagccaaaaggagguguuuuaaaaaucaucaguuugggcggucuagucugggaagacgagucaguggcuucugaggaaccuugcagacucucagagacuuucuuucuucuaugccuuuuagccuaagugcaggaucaauaggucaguguuuaccuacagcaaacaacagcucugcaacugcuacccugcucagcaaacagacugucaacacugaagccauggaagcccagaagcaagugcccucaaggagguccugauagaacagaggagaaaacaaugauucucugaaagagacuaaucaaaguacaacuagggaacugcacaugagaugcugcauacaugagaaguacaacagaggcuguggguccacagccuggggucuaccagggugguuaccagccugggaucacucacagggugguucugggaagaaaucuaaaacgguauguaggacuccuccugauaaacuuggguaaaaaguaaaguggggugggguggaguggggugcagugggcuucacaguugggggaguagugcggagacagaacagaacagcacaguccacacccucaaagggacaaguucaaggacacucagagcuucaauucuggcuacaugaaaagaaguuaggcaugacagaggagggucuaggagaugacagaaaaaacuaaccgaggccacaggguguuacaggaccaugaugguuguagauuuagacuuccuccuaagagggaagaggagccucccacaucuucaaccaaagaauggcauuauugguuucaucgaaaugaaagauuucuagggcuacgcugagaacagggagggaaaugcaaggcugaaggcagggaccacaagcacaagaugguuugagcaaagcagggguaaaugacuggccagacuaaagcagcgacaccaugauggaagaaaccauagaaccugacauuagaaagcagacaacauagaagaaagcuauggagcuucuaaccaaacucaagaggagaaagucaagguguccucaagauggcaaugacagcggagcaggccuagagcaagagcagcacuacugccagugugauaaagcugggaagugccaccaccacccugagugcagucuggcuucaagagaccauguacuucaguaccccacacacacacacacacacacacacacacacacacacagaggccaacaugcuccuucaccuuccaccuuuacaguaaccaaaguguuaucaauguuaccugcaaccaaguaauuucaggcuccaaccauuggcugccagcuaauuagagcacauaaucaacuauccacucacucaagggaaccaggaaauugucucaaguaugcucccaaggccuugcaagauccuccaguacugugacagcugucaccaaagugucgaguagcccuagggauagaacagguuuaaaagaaaacuuauaaacaguuacuguugcacccaagcagcagggacauggccuaauacagagcacuucagcgacagcuggacugucagggagacaggaaagggaacagggagaaggaagauucugggucacauaucaccuuguuuuuaaaauguuuuuuaaaagaaaaacaucaccaacaacaauaaccuauuauuuggcugacagcuggaaagugaauggauuuauuuugaauauuuccacauacauuaggaaaauguacauuugaaacuccacugggcauuuauucuaagagaucugggccuucccaaugaugcccuauaaaaucugucaaauuccaagaaauacuguaagauuguuaauuaggcauuuauuuuacaacuggcauauaaaauuugucagauagcauuucuauauauuggucuuuauucuccauacuccaaaagaauaguuuauacagacaaugucuugcauuuuauaaaucucgacacagaauuacaaauuccuacuuuacaguuuuugccucuaauaauuucuaugauuuauccacaaacaguucugagaaaacacaacccauucuuauaaucacuguagacuuaguauccaaaaucuacuguaacaaaaauaggguguucucuuaaaauagcuucuuuuuccuauaguccuugaaugagcaaguagcugacagaacuccagauacaggaguguggcuccugccauuacucccgcucaaucuucacauccaggcaccccaugcugcugcugcuucucaggaagccacugguccccaugccaccuauaggcacuuauacaugguaaauuacacagagcuggucucuagguagagaccacuuaaaauuuacuaagaagcagcagagccaacaguuaauacacuaacaggaaaucaccaggcagggaacaacugcaaaguaugacucagaaacauuccagaaaguacuaagcuuugcucugugauucccuucccuauggcacucuagcuaucgugugugggaacccucuugcacugucuucagacuguccugaauauauaaauguccuagccagggauuggcugcuacauuaaaaggcuuacaucu
